United States Patent 7,625,699 (GENETIC POLYMORPHISMS ASSOCIATED WITH CORONARY STENOSIS, METHODS OF DETECTION AND USES THEREOF) - sequence listing, part 4

SEQ ID NO: 12229 - DNA, 400438 bp, Homo sapiens
  misc_feature (1)...(400438): n = A,T,C or G, or insertion/deletion polymorphism (see Tables 1-2)
tagcccatccttgaacagtcaccataacaacataggcacatggagaggaatgtggggtaggcaaaaactgatgccagtccaggggagaatagagctttgcagggagtgggggtgggtcagggaacacttcctgggtgtgttttgctatgttcttttcatgatatagactggaaatgattgagaaggacactgttctagtggcttttagcaacctgactcatccaggacaatacctcttaccaacttagcacaacctctcaggctgacacactgcttttaggacagtgtttgaagacatggttcctagggggaaagggtgtctattaacaatgtaggttcctgaacccacccaagatctactgcatgagaatctctgaagagacatccaggaatctgcatttttaaccagcaatgtagatggttctgatgtacattagagattgagaagtgcggtcttaggaagtcatggtaaatgaaaatcatgcccagcttttactcctccttttgcagtcaggtagcaggctggctcagctaagaaaaatccctagatgaatatttatttctgcacagggaatgtttcctctcagagtaggcgggtgagtatgctgagtaggtcattccctgccattcctattgctgggcaggaaacccattttactgtatcagttctctctcaagagaatcatttttagaattaactcaacacgatatataagttgtagagtatcatatctcaaaatttgtttccatcttataacttttaatttctaacaggtgggaattaggacatctttaccctcatccagcctatggcagacagagggtacagagccaagatagctcagggccagcttggggacacttgtatgcctaccactcacctcgtagtgttcatcagttccatttctgtccactatctcttagccaatgtgcttggtggtctatgcagtggagatttctttgctgaactcagaactttcagggaataaagatagtagacttagaaaagcatgagtttcattgacttgctggtgtatccacttctcacaaggtaagttggaggatgcacatgttctggaggaatcagaaagagagtggtggaggggtgggaataggatgggcatgcacccaaggaaaggaagatgaatgtcctcaatgtgacagactcatctttaagggtctgagaggcacagataagccaaaggggtgcatggaccattatttctaaagcagtaaaaaatagatgaattaagaagtaaaactcttgatagggtataaagggaaagatggtgcaaaggacataatatttcttcatggacaaagatcttgactttgactctggaagggtgacagggaagacaatttcagaagtaggctatgagctcgagtgtttttggcagtgcagggtgcttgtgtgggggtggaggaagagagcccttattctgccattccactgtgccctgacagggaagggaagggtttttctggggctgctggattacactaaacgctcttccaccccaggatccccataatttaaaatcacaccctctgctcattaaccaaacttagcaatgaagaataagaagagaagtaggtaggaagcaagggttagagtcagactggtgctctcaaagctttcattagctcgttcttgggcaagttttgcagagctcatcttataacttttaatttcgaagcaggccctcttctccctctcttcaggagtgttgagtgtgagctataggacagcaactttgctctcaggaagctgctcacctgggtccacccctcattctcttttgtagatctccatttcctatttttgccaggttctctgtagaacctgcttccatgggcgtaggctgaatgacaataatggagtccaagagacgcagatgaaagaccaaagtttacaggactttataaataaagttttatcagaacacagtcattcccattcatttacatattctctggctgctttcatgctacaacagcagcgtttaaatagttgcaacagagattgtgtggcacgcaaagctcaaaatatttattttctggtcctttgcaacagagattatatggcatgcaaagcttgaaatatttattttctggccctttgcagtgtttgccaatccttgctctagagagttttgtatgggcatttaaatgctacccttaagtaacatatatcacttccactcacaactcactggccaaaatggtcacatggccccactcaaccatagagggccaggaagtacatcctactgtgtgcccaagaaggggataatcagaatatttggcaaacagcactaatggtcaccataagcacctaatatgaattgaactcagtactaggtgctgggtatagaaagaagaacaagacaaaattgttgatctcaaggaatttaaggaatgccagaatttggggattggagggggaaggctaagtatagattcgagtgtcctttcctagaagatatagactggcttgtctgaattgcttgagatctcggcttggtgctagccagaactggggactgatcggcttggcaagcagtgggggcaacagaccctcctggtgaacatttgtatcaataatagaagggttgtttaacagaaattcttaaaggaaagatgagataatttcatattttgatattcataacataaagctggagctccgcagtgcatattattgctgttgtaattttggcaaagatgtgattcaaattggcaaagtgtctgggaagaggaaatcatgtaaggagagagggtgggatgggtcaggaaacagaggtggggagccaggtactggtggcctggtgagagctgggagggtggcccaggagcctttgtcacagacagacacgagggaaaggaggctgcagccagcagggcctgagaattcttggagttgctggagatgctaaggcctggggagggagtgggagcagcaggggaggggtgtgcgcgtgcatgtggtgagggagagacatttaaacatcgtaggaatgaaggataaatttaaaatccctcaaggggagttgagacagaatgacaacgtgaggaacgtgaatcactctttctagggacccacccagctgttggcatgatttggaatacattttcttctccttaccaagctcattctggactccttatcttccttctccctgatcccttgacctggccttggtggccaagtaccgagtgttggctaccatgtcctgggagcttcaagctcaaaagcattgaggccttagggtgtggtgctggtagggcaaggaagaccagtccagatgctggagatggagaaggggacgaatagagaaggtatcttagggctccaggggcgtccgagtctactgaatgctcccatcaggctttatcatgtatgcgctaagatcatcctctcatccagactttttgtttctatttattatcttagcataacgaggaggggggctgggagaggcatttatggattctgcttcatgtggtagagacactgtgatcaatatagtggagaaaaccataagctaggacttgaaatctgagttctctcccagctctgctttttattggcagtgtgatcctgggtggggctctctacctttgtggacctcagcatccataaaatgatatggttagatcattataattcctaaccattgaaatagtctttgtttttgtgacttgcaatttgacttgccgtccaacccagggaaggcggggtgggagatggtgtctggagggcaactttctgggaggatgccaccctgggggcccagtacagctcccaacacatagtgggtgctcaaccatccaacactggttgaatgatctggaggccagagttcctctgagcatgtagagcacgggacacttcttagatgccacctgtggtcactgagacgtgtggttgggaggaattctggttttgggctcctggctaggagggaggcaataagcaggtatcttgaaaaggtggtaagttcaggccctctcaagccacaaggactccccccagtacttagacctgctgtggggactagcaatgtgtgagtaacttttacgtctctcattaagttaaacctttgctaattggagcatgtcaagatctagtaccagccacccacctggagtgctgctttcacttgggcaggtccatgaggcgtaaaacagggaaaacacctcaatggctttggactcaacctttaggggtgtagtagtggaggaacagtgcacaaaggaggagagaggagtgaccagggaggcaggaagaatcctttggtttccctaaatcctctctcatgcacatgctcttccttttgcctgttttcctctcctgttcttcaactggcaaactctgtttaacccggctccagggtcctttccttcacaaagccctcctgaccaaccccagctgggctaggtgcccctcttttttttctttttttgggatggagtcttgttctgtcacccaggctggagtgcaatggtgcggtttcagctcactgcaacctctgcccaccgggttcaagcgattctcctgtctcagcctcccaagtagctgggattacaggcacacgccaccacacctggctaatttttgtatttttagtagagactaggtttcaccatgtcggccaggctggtctcaaactcctgacctcaagtgatctgctcgccttggtctcccaaagtgctgggattataggcgtgagccactgcgcccagccaggtgtgcctctcatgtgctcctctagcaatcaggcctacgccaatcatagcacattctgtgatgtggtcacaatcgatgttcttcctgcctcttccatgaggatgatgtggactaagtccagctcatgttgttgtgcctagtgcctggcacagtgccttgcacatggtaagttctcagtcaacgctgattgaatacgtacgtctttcagaggccaatctggttatgtcctccttggcatggaaaaggagaatgatgccaaggggagcagcaggggcatctgagtcacacgtggccccaggtcctgaggcaggcacaggcattaaaaaaggaggaaggaacctgcatacaggacccagttctcaagaagagttctccttaggctgggctcagaggctcatgcctgtaatcctagcactttgggaggctgagtgaggaggatcgcttgtgcccaggagttgagactagtctaggcaacacggggaaacgtcatctctacaaaaaataaaaaaattgctggatgtggtggtgtgtgcctgtggttccagttactcaggaggctgagacgggaggatcaccggaccctgggaggttgatgctgcagtgagccgtgattgcaccattgcactccagcctgggtgacagatcctatctcaaaaaaaaaaaaggagagaccaccttgtggcttggtgcccccaggcacgcacttgggaggcagggcagcaggtggtggtggcaatccccccagagtgggccctggggaaggggttagagggattcttctaccaaaaatgggagggaacagccagctagctgtccgaggtggggctgagatgtgcggccctcggagttctctccttattgcagcacctctaaaccttaccaacgcggcatatcattatttctttaatctgtgtcttctgcagtagactgtaagtttatgagggcaagaatccagtccactttgttaaattctggacacctgggggcccagcctggtccgccgcggatgctcctaatttcaacatcatttatcgagctccactgtgtgccagtttgtgggtcaggcccgggatgtagcactgagcaagccagaagccttggcctggaaggcaatgccattaacctctttctttctcttctctatttccctgtgaccttggccccattcttcctccctccctcccttccccactccttgtctctgccctctccctcccacagagcaatgttctgtgatggtgcccgagatgcgtggactgagcccagaccgcaggctgcccgagcccgccccctgcccggctgcggggagccctgagcccaggtccgcgggccgccgccaacgccacgtcctggccctgccggaagaagaggcatggcggccccagcagtgcgctctgctcgaggccgacgcctcggacgaggtgggcatgctgccggcttccccgcgcgccgcctctggcttcgacaacttcttccaggtgcaggagggcgagggccagggctgggagggcgccatggcactggaggcgggctccagccctttcctgccggtgagccccgaggtcatgaagcggcggcgcgggggcctcatcgagcagcgcgacatcatcaaggcccacgaggcgcacaagatgcagagcaccccgcaggcccggcgcaaggaatgggagtgagtatggcggggacgcgggggcgggcatggctggctgggcctgaggtcggggtgggttcctggagcggatgggccccgtgaggccgccctggagggtcgggagatgctttcgctgtgctgcgactaacgagaggctggaccctctggatgaggtcctcgtggtcagtccctgatctcaccacccggctgtaggcctcgtccagcctcactgaggcgttcagctgtcagatgtgggtgaatcagccttgcccccaaggctcacttgttttactaagagcctgtggagaaagaactggggtctgtttcattctctgagctttcctgaaagccagggagaatccttcacaacgtggatcatctatttcatctttacttcaggaactgcagctaaccctgcctttttaatatcctccttggatgaatgattacattttgggcacatctccagtggatggaggaaaatgtccaagatctgtgtggccactcctggctttatttctgctctgtttgtgtagggcaaaaggccaactttaattcacacctgttgagaattttggctttttcttcttaggagtcctaaattaaaggaagatgggatttcacttaattctctcggttgccccaggtttttgctccatagaaggactttgctttgtcctgtggatgccggagtttactcggcatgctggcatgccctgtggtctgtatgtcttcatctcttcttgctttagattgttgacttgctagatgtcatcaagtacaaagagattagtcacagatgtattttgatggtggtggtcgtggtgggatttacctmcttggtttcagtgaatgttctggatgatacaagtaggggtaaatgagctgatctctgtttcataaggatgttaatgtttgttagttcgctcattcattcattcagtgagtccgaatgtatgccgggctcctgggattcagagaggagttgggcacagccagcattcaacaaatctcttggttgttcatctctcagcactattagtatttagagccttgcatacctgtctttaagtgccaggcaacattccaagcaccttacatatatccactcatgttaatcttcaccataactatgaggtaggtacagttattagccacatgtaaccaatgaggcacagagaagttaagtgactttctcaaggtcacgtggataacaaccgcattgttactgtgatttgatattaattagtaatttgaaccctggcagtctggttgtggaatccatgcctttaaccatgatggcacagtgcctttcattctaactctcaaagtacttctctcaacaacctattgagatgccatggtaagagcactggtgtkggggtttggagacttgggtctaattcccagggtgacctaattagtggtgtgaccttgagtaagtcacctcatcatgacttcgaaagacaagtaggagggagtagacttcctttaaatacaatgcagctctgatagctggcctttcttcatatttagaagtactattttttaatgcacctccatcttatctttctaagaggaccctgaacaacttgagggctgagactgtcatgcacattgttcatgtcactcaatgcctatcatctggcctaacccaaaaaatcccacaatactcaatgaaaaactagctttaccatgactagcaatgtggaaataacttttatgtctctaagttaaactttactgattggaggatgtcaagatctagtaccagccacctacctggggtgctggcggggatgattgggagactgttttcacttgggcaggtccatgaagaggtaaaccagggtacacacatcaatggccttggggaatgtcagcctttaggggtgtggcagtggaggaagagcacatgaaggaggtgagaaggagtagaaggaggtgggagggtaaccagagggtatagggacaaagaagtaaggaaaatggtgtgttcagaaggaaggtcatcatctccatagaatgttgctgagaggtcaaataaaatgaagatagagaaggaaacactggctttggcaacacagagatgacctgaatgggagtagtttccacagggcgatggggtcagtagcccagttggagtgggttgaaaagaaaatgggaagtgatagagacagtgatgttgccccatccttctctgctccccaacactcacggcctcatcatggcttttcccctcaccacccaaattccttagcctcatggctctgtacatgccttaatttgatcttctccacacccctccccagttctacgaaccctaatgttactgagcaaagagggcttgctgctcggggcactagaagccaatactacagcactgggtttttgagaagagaagctttttattgcatgtcaattcacaaagagacgggatgtcaagcccaaatctgtctctctgtcctcgcttcaaggcagtattttcattagaaaaggttcaagggattagtaagtgattggtggagggaaaggggaggtctggaaagtccttggacatgctcagttatctcttcatgctacctcacaggtcgcatgtgaaaattcttgaggacttagtatgaaacatgtcatggaagttcaggctgtggtgtcagcaggcttgttctgcagacgccagtaggccaggccatcttggttccaaccgatgtcagccagttttttcttgatctcacgttgtggggaatttcagcatttctgcaagttgtttcttttcttatctgccattctgcaagctcaagaatatctgttagtcattggtttcttactctttggggcacagtttcagcttcagcttttcagcaggttgtttcttttcttatctgctatcctgtaagccaaagaatgtagtcattggcctctttaactctttggggcacggtttcactaatacactgtctggcactcatgtttcatcatcagcaaagtcctgttcatcctcctcatcttctctggaagtccccttcactctcttatttctgctggagcctccccccaggaatgcggcttgctctgcagctgcctcatgtgacagctgctttcccttccacgctgccttggaccctggagtctagagaagcaatttgctcctcactattgcttccagaccattactcccctctyctgtcctaaaaatgccagctgtggcgtgcatgtcatcagataataccacctactacccctcgttgccaccatctacaaactcccaagtcacttgcttcattccaggaagaatgggttagccctgggtttactgcctctcttccccacgtcttcagctgctgkcagttcttagtgatttcagtatccaygtagatgacccttcctgcaccctgacctcttggttccttagccccttctgtttggtgactttgccttcttgcttyctgctgacagctcacctccatggtctgcctggacattgtcrtaactgcattactccataatctcggtttcaagcatcccactgtgtgatcaccccctcttttctctccactccctctagtgctcagttcccaagattctttaatcttactgcatccacaagacactgatcctattaccttttcactatccccttccccagtcatgtcaccatttcccatcttatcaaactgaactccatcataagcaccaaacatattttccagataaaatagtgacctttcacttgaagtctcctcctaccctctcaagctctttcttctaccaacttctaagatagaatgaatcatccacaaagggcaagaatgctggagctcaagttggtttctagtgtacttcatgcttcaccatcattataatctccttattttcaccctcaactttgttgtccctctgctgctttgttataccttgtctggcaagacttcagccctgctaaatcccacttkcccctattcttcatgtacatatgggcaggtgaccatagctatagaaaaagtcacaaccacgccgattgacctcactgtgaattgatgactgccacctccagttggcccttagtcctgcccagaaatcttactacttttcccttttctattcactctcacactcctctagagattatttcacatgcttttcccttaactctcaaatcccatcatttcctgccagctcgctcctagctcatgactacaattgccttcctacttcactgggaaaatagcagcaatcaggagaggcatgtacaggctccatccactgcactgaccgcctgctgcatctggtccctggtaccaggcctttaccttctgttactgtggactgaycacccctcaagttccatgtggagtctgttgcccatgtagagaaaaatgagcccctttgtttattctgtctccatttttttttcttacaattttctctggaacccattccaatcaggtctttgtcccaggcaaacaaacagctgttgacatggtgacattggccttcccaaggcagaatccaatgggtgttccttcgtgtccatcttccttgacctagcagcaacatttgatcacttcctctttcttgaaactcttttgtccttattttttatattttatgtttttttagagacaggattttgccgtgttgcccagactgatctcaaactcttggcctcaagtaatcctcctgcctcagcctcctgagctaggagtacaggtgaaagtgttttgtcacatggcttttacgatacccactcttggttctcctcctatgttgtgggttgcttctcaatctcttgctagtttccacttccttttcccaatccttactaaacactggatgtcccagggcttggtcctcagcctgttctcttctcaccagtgcttacttcctagtgctcttgcccagtcccagacctttggttagcatcgtatactgctgacctctaaattggtgtctgtactcaggacctcttccctgaatttaagataccacccacttattcaccatctttacttgtacatccatcgacatctcaagctgaacatgtctaacatcaaaatattgatttctctccaaacctgcttctcttgtagttttctctttcattaaacctacattttttctgttgctggggccagaaatgttgaagtcattttgattctcacattgacactcaattcttgccaatccccagtgtctcccccctcaaaatgtatcagatcaccattcaccacctctgctgctgtctccctggtccaagcaccttttattatttttattccacacacgtatatgatactagatgcccagcactattctaggtactttataaatattaattaatttatccatgtaataattgattgaagctggtaccattattaccattattgtccccatttttgcacttggggkatagagagtttaagtcacttgcccaagatcataatgtcaaccacctcttaatgagcctccctgcctctgcccctccctgctagactctgtttccccaactgcagctaaagatccttactttttcttttttgattcacaaaggatttagaaaggtagaacaagtagtttctgtccaagagtcttaagaaatatttcatatcagtccttagctcagtgcatgatttccatcttctccctcttccccctgcccagccagcctcctaaagatgcatgaatgtctttggtttgatttcttcatctttccccttaactcattctgcactggctacactggtcccttgttatgccttgaatgtactcagacctcccacatcaggcctctgccttttgctggtccctttgcctagaatgcttttcccatttatcaggatggctcctctctcatttcatttaggtttctgctcagagagaacttcctgatcaccctatttaaatagcattcccccattgtcactctctttccctctttattttgctttatttttcatcatagcccttattgtttccycaacggacacacaaacacacacacatacatacaagcacagatattttgcactggagtrcaagcttcttgaaagcagggcctttgtcttaccttcagggtccaraacagtgcctagtgtgcagttgactcacaataagtgtttgctgaaagaatgatgaagtaaacatattgaggggaattgatatccattctaatcagctaagttccagggaaggaggcagctgagttccctgtgtccactgtgtggttgtacaggttgctgactgcagagtcctccagttgaatagtcagcagtggaagtggggagtctgttctctgccccacttcagggctgcccaggatctgcatgcactttgtagagatggaaatttttcctcccttctgtctcctgcctttcagcttctcctgacttaygttctttagacaggatccctttggctctaggacaggggcagcctggtcctttcccagggcttggatttactgtagtgggaaatcaggcagggttctctgtgggcagccctgacagcatcttgctcctcccaaggccctgtccactgcttatacaggtgaaagcctgggacacataccaccagctttacaaatcctgtctcctagacactgagtcaggaccctggtgatagtgaaacagactagaaaccaacctgggaggtctcctgcattttttttttgtctttggctgggtaagccaaatgctgatgggagaaggagtactttaggtgatttcagatgaagcagattttcttgtacagaatgttgttttcctaagaacctatttaaaggtttcctcaggcccacttttcaggtgatgaggacctcttggttagcaccaagtgtttattgtgtactaagttttataactttagcaagtgggcatgtcacaatgttttactaatactttaatatagttctctccagcttaaaacatttttcatacayatgatctcatctgagcctcacaatgacctcatgaattagctgttattatttataatttacaggagagaaaaatgagctccgaagttagaggtggtactaggtcaaaaacctatgtcttgataatgactgccaccatttattgagcactggctatatggtaggtgatttgcatgtattatttattctaatggaaataataggtaccatgatgaagaacagaaacattttgtatggcactattattgcatatgggtctggaagaaaggaaattatgtgtaactttaaagtctgcgtaggttggtatgacttactctataaagagggagggggtatttccataatcatagtacttagcacactacattgtaattgcctgtttacatgtctgtgtcccccactagattgtaagcagagaagtctgtctgctccccattgtgtctcctttacttagtactgtgttgggcacataataggcactcagtagacatttgcagatgaaaaacaacaacaacaacagcaacaacatgatttttcatattgggaaactgaggcttgataaggttaagttacctgcccagtatcacagagccagtgaggattcactccaggtcctctaattccgaagcccatgtttgttctactgagccatcctactcactggtgtccctacagtaactggcacagcactgggtaaatgacgggaactcagttcatgcttgaattcttgcaatgctacttgtaaattgtgggcttgggcactttgtaacctccgcattttttgagtagaggagagaaataatacctaccttgcaagcctgttgcaaagtttgaccacatttattagatcatatagtctggtggggggtcctcaaaatgttgatgagcaccagggttattctgggcctcttctctgcctacagcctccctgggtgacctcaccaggtccacatatctgcagatgactctcaaatgtaaatttccaaagaacccttgactcttgaagccaaatgcttgtctggcatctctgcactgttgtctatctaatcagcttctaaaacataatgtggctagaacaaaactcctgatcctcttctgatcctgtctggcccctcatttttccttatctcagtaaatggcaccactatttctccagttgtcygagccaaatattctcattatcttttatttctctccatttttcctcacttctgatcagtggtaagccctgtcaytaacatctcccaaacatatcccaagtccaaacacttctccatccccactgctaccaatctcttccaagccactatcctttggaccattgcaatggcctgctaacytgtctttgcatctttgtttccctagaataagagaatgtgatctattgacacaacaggcagggacaatatgaactctttttgctggctcataaagccctatccgacctgagctttgcttaactcctggcctcatctactctctcccttgttccctgtgctcctgcccactcgccttttatttaggctatgcctgtttatgtctctaccctggctcctgccgttgcctggaatatttctccagatctcaacagggttggttcattcttgccatttggaccttagctcaaatgatacttcctcagagaggctgtccttcatcacacagtctaaaatagacacctggtcactgtgccatatcacctatgcagttgaccaccaacccccacaagaatgttggtgccytgagatcagtgatttgactgcctcgttcactccatatccccagtgctgagggcaatgctgacatatgggccctcagtaattatttgtgaatgaatatttatgaatgttccgtaacagtggctatggttatagttacgatctatgtgttcacctggcctctgatagccctagccataccaaacggtctagtccaggaagctcaggacaccactggctctaggtctagaccagggtcagcccctggggtgtggagattcatgagctgtaaaacacaggttggttaacttacaggttgtatgagaactgtcctccttcaagctattgtttgatcaccacagagccatgtcttatttgactttgggtaagatatccaacctttgtgggcctcattttgctcttttgctagattgtggatgagtacagcaacctttttgaattgttatgaaggaaaaacagcatgtaaagtacttagtccgatgcttggttgtttttctccttgatgtctggttcctcacctwcaggagcctgtcacttgctatcacttatagtttaaccaaaacattagattgtgaatctaacaatagaagcctgcaacttcttrtctaccgagaaagtgtacaagaactgctaactcatgcccccatgcctagcaacatggctttctcaactttgaaaggattagagtcatccgttggtcttaggaaccaaaaacattgatgcaactccaaataaaagtagcaaacatgtatttttccactaccataataaccctaatccccttaatcttacccatcattactaccttagccaacccctataaaaaaggttcatatccaaattacgtaaaaacatctatcgcatgtgccttcatcatcagcctcatccctacaacaatgtttatatgtacagatcaagaagtcattatctcaaactgacaggcatcagaggtttgccgaagcccraggtgcagaggttgtagttaggcttgggatcagctgtatacatcaacggaccacagcagcatgtgggagactacaggagggaatgcacagtgcctggcacaaggtcaacagtcagtgcatatgagccattattatgatcattattattattcatctggtctagctgcttcatttacaggtgaggaagctggggtcctgagagcctgggtgactgctggtgctttatgtgaaggtcagtggactgtggtgagtgacaaggtaggaggaaccagtcctgsaagtcccacccacttctgtctcatgtgccctgcagctatgctgacttagtaggggtgatcacattcaaacaacagtctcaccggcattcacaccgcattcagcatcagcaacatattctgtaaggcaacacctgtctcaaccttgaagctttatgggtgaatttaagggccattgggccaattttttttttttttttgctggccttttgaaaggcggccagcctcctgcagatctagtgagactaagtggagacctcagtccacatgctgccacctgctgccagcatcagacatcactcgggttgttagaatacaggaatctgtggaaccactattgccaaaagggtgcatggcagaatttgttcttatatatgagtgctttgttgaattatcggatattttaattttatttaaatgtgtatgtttttagagggggcaggaagtctccaggtcactgtattccccaccattccctactgccttagggctattagaggactgacttggtcctgaaggcacctgagtttgcaggtctgcaaaatccaaccttctcactcagagacgaggcatttcaggatcctagggctgtagtataacagggttgcagaaaccaaaacatatgccagtggaacacagaaatcatgagccttcaacacactgggttatcactaaccaacagcaagtttgaaaaccaccagccaagaagagaccggagcacatgccctgctttcttggaattctgagcagagcaggaaggtgcagagaatccagagaattgggcttcccttaggaactgacacaatttgggtgatttctagagatttgctttaagatgatcctttggggaacttcagcacacacccttgaattttccttacctgtcctcccgggattagaaaaaagaggctgtttctagatctggtctctggtgactcgcctttcccttcaaccttccgcagttctagaaatgcttccctagagaactgggtttgagaataaacaaggtggtgcgcgagcagcgcggttttctgtgcttgcagtggagaccgcctgtgacaaggagggtcctgtactgggaaggagggggactggccccctgctaagtgcctggcgactctcatctcttgcagagaacgaatgcataacctctctgccactccctttctctttctgaagccattggatgccctgagagaaagcagagggtttccatcttttccagagcacagtgctgggagcaagggctgggggagatctgttgtcccagttcttcccttctaaggcaggccttgggggaggactctcccccaagactctgcagcctgktgctcaagccggatcggcccgttctgtgcttccttttgtggyaccatcagagtctcctccctgtttggaggctcaggtgaatcagtcccctctctcccaccctgcccttgcgctgggctgcctccactctgctcccatggccatatctgtagaaggaggctcttcagtcttctgaacatgtcaagattcggaaattctgcccccagccacctttttgaagaaaatgggaaaagcggcgccctctagcgccagctgctcaatttgttttccctctttttcagaagagatattttttcttcttttatggtgcccccaagtggttgtttctgtgtattgcagccgcrgtctcactgggatgctttccgctgtgtagctggaggggctggggcagcctggtggtcagcactcacatcacaagaaaggaaagcgaagccaggaggagaagggccttggcagggcacgatgagcgccccgagactcccaccgcagtccagggccttccccctccctgaccactggcaaccccttgccatctttaagggcttgcctggacccatggctgcaaatgagccaaaggcgttttcctcttggatgtgaggggatgggtgaagacacgtgcagaaaaggaagtgctcattgtggaggaggtgaacataattggaggaattygctttggcctttttggctgaaaaaaatatttatgaaattgctgtacacccccgctcccccccccsaccccaagcagagttagacacctatagaattccaggcaccgatgaaaagacctttaaaattaatcgcacataacttctcattgaaggngcaggtgagaaggctgaggcgcagagaaggaggtgggcgtggggcacccttctgaggaccccacctcagccgctcataccccagccacactgtcctccttctcttctcttctgcttttagctcctttaaccatctttctcttcctctttttctctcgaagcctgtagcagggagggaatgaaggcatgcasggttggcgtgtgagtgaggaagagggcttgtccncctttcccctctgtccctgcccccgcctctcctggggacctccttgcagaccctctgcagctgtgctcacatcccactactcagcctcactgctgttctaaaaaggcagcattactgcctgctgatcaggtgatgaggaacctgcaacccttcccaaatttataaagaaaacagaggaattcagtaaattctctttctgctcttggagtaggacagaccagtggtcagttctggggacagtgctcctggtgtggagacagtgttggctggacacacccagcttgggtgcactggggtcaggtggtcaggtctaactgcatccccctcctgtcactccatctcaacaattccccaacccagtcctaccccatctcaacccttcctcaacccaacctstctccatctcaagtcctccccatttcagccactatccgtctcaagcccttcctatgtcaacccttatcaattaaactcctcctcatctgaacccttccctaactcaacccagctcatctcaaccccttcccatctcaaccgcttcccatctcagccacttcacaactcaaccccttcacaactcaaccccattcccatcatggccccatcacaactcaaccccttcccatctcattcccttcaaaactcaaccccttcctgtctcaaccccttcacaactcaaccccttaacaacagaaccccttcccatctcaaccacttcacaacttaaccccttcacaactcaatcccttcccatctcaaccccttcccaactcaaccccttcccatctcaaccccttcccatctctacccctttacaattcaaccccttcacaactcaaccccttcccatctcaaccccttcccatctcaaccccttcacaactcagccccttcccgtctcaacccctgtcaatctcaaccccttcacaactcaaccccttcctatttcaaccccttcccatctcaactccttcccatctaaaccccttcacatgtcaaccccttcacaactcaaccccttcacatctcaaccccttcacaactcaaccccttcccatctcaacccttcacagctcaaccgctgcccatctcaaccccttcacaactcaaccccttcccatctcaaccctttcccatctcagccccttcccacctcagcttcttcacatctctaccccttcccatctcaaccccttcacaactcaaccccttccttactcaatcccttcctatctcaaccccttcacaactcaacccctctccatctcagtgtctccccaacttgacccttcaacatctcaaccacactcatctcaacgcctccctatttcaccctctccccatctcaagcctacctcatctgaactctacccatctcaccacacccatctcaaccctcacccatctcaacctctgccccatctcaacctcactcatctcaactccttccctatctctacccctgcccgtcccaacccctcccatctcaattccaccgccatctcaactcctcccccatcttaacccctcctcacctcattccttctccatctcaaccccctccacctcaacttctccctcatctcagcctcttcctcatcctaacccctcccacctcaacccttccccatctcaagacttccccatctcaactgctctctacctcaactcctcctccatctcaacccctccccaacttcaacccctcccccacctcaactcctctccaacttcaacccytcccccacctcaactcctctaccattgcaactcytcccccatctcaactcctcctccatctcaacccctcccccacctcaacctctccccatctcaactcctctctcatctcagcccctcccccagctgccatctgttatggttgcttctttcccctgtgtttatacttaagctgggaaaaattccccctccctccctccctcctccccttccctctttctgtgatgaacatgaaattatattacacatataggtctttgttttgctcttattcttttagtttttaaaaattacaggatatggtgtgcatctttctttggccatttctggaaagatgtccataacatctctttcacgctgcagagtattcctcagcatgactgaaccacagtttattccagcarccctatcaatggatgttcccagttgctttgcagttaccagctgtgctgtagtaagcctcccctacatgcctttaggatgtgcactttcayttctgtagggtcaagtcctagaagtgggactgtggacaagtctttcccacgctatgccctcactctccggaggactggcacttctctcaacacccctcctcagcatctcagcctcaaattgaaatgtgaactttcacagtctgtgttatctctctggccccactggagaggcccgatgaattaataatatgccagcaggaaacagagagatggagttattaattgtcagtccatgagcccaccctctcaaggtcctaattagcatgctgacagcttcggttttatccagagcyagggcaaggctctggggacactgtggctcagctaggggcatccggcacagagtggagagccctggtgcctttctgggtggggtggaggggcgcttgcaagaggcttgtgaattcagaagttccttcagggatccctttgtgcctgctgtggggtaggggagagaaacaggctgggagtgggggcaggaatgggagttttagtgtccaggtggtggtgatggttggtgtgtgctgctcttgggccccagtggtgggtttgtgattctggttctgctgcaggacagtgacactcaccaagctgtgytgggtgtagttgtctcagggaggtgcctgctttcaaaccaaagttcctttgatggggaggactgaccccaggaagactgattgcgtatcaatattactctaacccatggccctctttcataacatgcacactcctggaaaggatatcattaaatctggcattggtgcatggccaggctcacatagggttgctcaagaaatgttgctgtaaaggaggccgggtgcggtggctcatgcctgtaatcccagcactttgggaggttgaagtgggtggatcatttgaggtcaggagttcaagaccagcctggccaatatggtgaaaccccatctctactaaaaatataaaaattagctgggcatggtggcacacgcctgtaatcccagctatttgggaggctgaggcaagagaatcgcttgaacctgggaagcagaggttacagtcaaccgagatcacaacactgcactccaacctgggcaacagagtgagattccatcttaaaaaaaacaaaaaagaattgtttctgtaaaggaaactacctataggaagctgcgtgaccttggccaggcctcttcacctctctgggccctttttaatgtggattagaggtggtccttattttggtttgctccatactgggcagccagaaccatctagaacaccagccaggacttgctccccaagggtgctcctctgttgcgntgcctgcctctctgcccaatctctctccacacagtggaggctctgagtctttcctactttgagccctcatctccaccagcatctatgcgtagctctgctgtctcaggcgcctctcaagaagtttcaggcagcagagttggtggaagctgaaaagtcatttgaattagtttgcctgggtctattgctcaggagcctgggcacatctcttaacctttctggggctgaggacaccagcattcagggttgtgtgtgaggtgcttagtatgattattactcatgtttgttattaggctctgtcctgcttcccccaggctgtggccgggaagacagaacagccatttacacagtaagctgcccaatgaccctgcctttcccattcccagtctgcttttaaaaaatatgggtgtctagaccccaaccctcaaagattcagatcagttcatcttaggtgaagttttaacaggaagatgtatatagatgtatatattttacaagctcttcaggtgattgattagtttaagaaccattgattgagacccatggcaactgggcgggcaggtaccttgtgctcatggggcctgcccagccagacacagcctttttcaggagcaaatccccctatctcccttttgggacacagcagactgtctgagatcatctgatgacctctacatactcttttctgggactaagctgcctttctggatcagttagaaggcaactggaacatctctgaaaggttctggatctctgtgcacatacagtaaggggacagagctcattctgtgacagtcttaccaatgcaccacaatgtagcagtctctcgttgtaaggcatcacccggagttcttcgtttcatgaccaaaaaaattaaggagtgtggacaaagggtgaggttagaacgaaagtttaataagcaaaagaagaaagtcctctgccacagaggggacccgaaagagggttgcctttttacagttgaattcaaaagcttttataagaaactcccctcatctctgtagctgtttgtgtaattccccttatctgtgcagctgcgggcatgtccttaggcaagcacaaagcacagcttctcttgttcgkgttactgtggttatgttttgggtargtcccccacctccctgtgcaagttcccatggagcccactrtgtacatgcccgaaaagaggaggaaacctttctgtgggagcccactgattacaccaagaacaaaggctgctatgttgggccttacttgcttrtctgtgcagctgcagcctgagttttccccaggctgctctatttgtgcctgtagcttgatttttcaggctgtctttcattttgaaagaattttaccaaagacaagytttagctgtctgcccaactagtttttccttttctcctccctcaactggatcataacttatgactctgaggctgagtcctgggatagttggatgtagagggggcattatctggatttgaacccagtaattcttagctgtctgatattacataagttacttagccttcctgaacctcactttcaccatctataggacaatatgtgctttgcaataataacattagatttctagaaacacacacacatgcataacaccaggaacaaattttcctataacttattttattgatttcttttacatatatgaaatagaaaaatgatattccaaagaattatacctctcaattttttttaggaaaaatgtttaaaaaataaaaaaaaaagaattcaaattgtgcaagtaaaacaaaaggtaaattggagctctgctttaaagtaaatttcaatagaagattgttgttgttttctttaagtaagaagctgaaattgcggagtgagttttgatgtggcagtgtgtatgctgtcttggttatccagctgttttgactcggttttgatggcaacatatactgaccatgaaactcagaggtaagtaatttcaccattttgaagacacccacagctcttgacattttcaaagggtggttcccaaaataggagttcttttgagatggcattggtatattccagggtgatggatgccagagattggctgggtggcttgatctgggttgcagacagttaaaagttaaagaaaagtagggtagcttctacttccttcatgacctggtccaggatattaacagacatgccagtggacctgggtgcttgatgttacttaacacaggtatcatttccactttttccctctgctccaagccacagggaaactcagccatttccagggcccttggtttcaggaaggtctctgcagttgcatggagcctgctttgcctggcattctgcaggattctttagtacaaggattttgactgggtcaaatcagagatttgggcaaattcctgcattttaaaatagtcttctcctaaaaccctttcattctatgtgatggacagataagagatacagggctcctgtatcagaaattttatttgacttttggagtagagtgacctgaagaacaaattgcagttttatttttctcattacagcaagtcaggaggaggcagcctgggcctggtggggcacttctctgatgtcaacagggtctgcccaccctgccatctttagtgtggcttcctgcatcgccgatygaccaagtggcagacctgagggcaaaaggaagcctgatattggagtcagccccctttggaagaactttccctacagcccacctagtaacttctgatgatacctccttggcctgatttaattcagtgcaccaaaaatattatcatttcaacacaaaaccaatgcaaacaaagaatatgcccctaaatgaaatggtgggatctagtttaatttttatcaagagaccttcctgaagccaagggccctggaaatggctgagtttccctgtggcttggagcagagggaraaagtggaaatgatacctgtgttaagtaacatcaagcacccaggtccactggcatgyctgttaataaaaaaattttttaatgttttcattcatgtatcgtttcaactgaatcacatgtaccctaaaacttaaagtataataaaaataaataaataaaataaaataacaaaaaaatgttttcacaaagacagttttcaaagtaacaaaggacattgagaaaaaaaatcctttggttgttccaagtgtacagaacatcagataaaaataacatcaattttccacagagaaaccaaatatgtcrtttaaatgcttccagaattaaacatttgatgtgtatgttgggtgaggaggcaacaggattggatagggtggtgggaagtctgagttttggtctcccctctctcactaactagctgtgtggctttcactaaacaactccagccccttaacctcactagctcagttttatcatctgtaaaatgaaaggattggtctcgatcagtgctgtccaataaaaataatatttgagccacctgtataattttaagatttttagtagccatgttaaaaaagcaaaaggaaacaagtaaaatcaatatattttatttaatccaatgcaccaaaaatattatcatttcaacacaaaacaaaattattgagaaagtatyttacatttttttgcactaagtctttgaatgctgtgtataatttacccttccagcacatctcagtttggactggcacagtgtcaggcgctcagcagctgcacacctctcctggctactgttttgaatggtgctgccctccagagctccaaggtttctttcagtcctgacccttgaggattgtcacctttttttcttgactcagctttgagtgtcttggcctctctttccatcccccaacctggggcttctcttcaggcatggggtgaagggatcaaaaccctgagggccaccccsactccatgatttctttctgcactgtctgctctctgtcctgtgctttcctgatttggaatcacttccctcgctttttctcaggctgagatccctcccagcttgccttatctctgcctggtccctgaggtaacccatttgcagcctcccattcctgctctgtctaggccatttcatgttctcttaattttgcattccattgcctttaaaatcttcaaccacttaaaaatgtaacaatatacatttttttctttcattacaaaagacgtgctcattgtgaaacaattgggaaatataggagcttataaagaataatataaaaatcactcataatccactcactccaacccaaccactgctaatgttttgatgtgcttatctttggtctttttctaagcattacgtatacatgtaaatgtgttttaaatttctttttctggagattttacagaatatatagttttctattctatttctttcacttttcattatactgtgagcgttataacaatatcattaagtatcgtttgaaaacatcatttgtaattgctaatggctgaggttcagggagagattttgataatattatgtcaccattaagctagggacttagataaacttagtatctgccctgcttctcattcctccttgttgaagagctcttgaccaatgtaaaaagcaatagccaaatgtgaaataaagaactaccttattaacagctcagcaagcactggagaccggcatgtttgcatttccacgctcattggtctaggtgaggcttcctggtccccatccctggaatctaagatgagctgggcttgtggagcaaccttgggcttgactttcctacttggctcagactggctttggcaaattgcttaaccgctctgggtatgtccttatctgtaaagtggtgattataatagtgctcacctcataggtctgttgtgcaaattaaatgagagagacatataaagtgcttatcatagttcctggcagatagtaaatgatccataaatgttagttttaccatttccctatttttggacacttaagtggcttaattttttttactattataaattaatcagtttatcagtaacaaatatttattgagtacttactactggccaattttttttttttttaaatactagaaattacaggggtaaccaagaccagacaagtgtctgatctcatggaatttaaattttaatgggagacatgatcaataagcagggtaagtttggatatggaaaaggctatcaatcacatacaacaagatgatgccctgagcttcaggtagggtgggcagcgaggagctttctgagttaggtgatgtgtgagcagacatctgaatgacaagggggagatctggggaagagcaagttaaagaccttgaagtggaagtgaacttgaggagttcaatcaaaattcagaagcagggagcgcagggggtttggtgtggtgggaggagctacgggaggtgggcaggagccacctggtcagggaacacttcggagctcagggtgaggactgtggacttcattgcaaggtrtgagacatgcactggaggcttccgtgcagcggagggatgcctactcagtggtgtgctggagcgggctcatgggagcttctgagagcctcttggcacgtctcttcccagctccttattcagtgaaatcatgttgataagtggcttgatctgggttgcagacagttacagattctcctcgatttatcaggacacaatctgatcaacccattgtaagtgaaaaatatcatcagtcaaaactgcatttaacaccatctaaacccttcctaaagtcaaaagatcrtaagtcaaaccatcataagcccaggactgtctatatttataacacaggagtttatagcagatgctactcttcccctagagagcyagttgttaaatgtttaccagcacaccactggaacaaactaatctaggttttaaaaaattctctttgcctatgctctgtgaagaatgaattacagggaggcaatatgcagttttgactgtagttttgagaatttccttaggataaattactggaagtgaaattactacagaaaattatctaattgctccccctactgaaaatgttcatcatttatacctccactagcagcaaggtaccatttccttgtactcttactcacacttagctttagccacccccatagaatgttccttctatctagaactttgcattctgttctctatgtgtagctgattatttatttatttatttattaatccttcaggtctggtctcacatctctcttctcagaggactttcctgaccactctatttcattgtaattacttatttgccagaaccatggccatttatttatgtctaggacagggtctgccacatagtaggctcccaatatatattattgaatgaatgaatgcatccgcctacctttctgaattctcaaattgatactaatacagtcaaaggagttcctttccttggaatgtctaggattggcttttttcagcttaatgatatttctggagttgaggtatattaagtccaaagagttcaataattgataacaaaatactgtgcaataacctaacattataacaagatattttgcaataaaatgcagctttaaaacatctgttatccaagtgaagtgatgactcacagagaaaatatttccaaaccatacatctgataaggagttaatattaaaaagatatgaggaactcaaacgacttaagagcaagaaaacaaataaccctattaaaaaatgggcaggggacctgaacagacatttctcaaaagaagacacacagatggccagcagatccatgaaaagatgctcaacatcactaatcatcagggaaatgcaaatttaaccacagtgagatatcagttcacacctgttagaatggctataataaaagagacaaacaatgaatgttggtgaaaatgtagagagaaggaaattcttatgtattgttggtagaatgtaaattgatacagccattatggaaaatagtatggcggktctttaaaagctaaaaacaggactaccatatgatccagtagtcccacttctgggtatatatccaaaggagatgaatcaatattttgaagagatatccacactcccatgttcattgtctcattattcacaatagctaagatatgcaagcaagctaagtgtctatcaatgggttaatggattaagaaaatatggtgtgtatacacaatgaaatactttcagccttagaaagaagaaaattgtcatttgtgacaacatgggtgwacctggagcatattatgctaagtgaaataaacaggcaccgaaatgccaatatcatatgagctcacttatatgtggaacccaagaaagttgaactcagacatacagagtacaatggtggttacagaggctggggacgaggggggtggatgagaaaggggtgaggttgttcaaagggtacaacattttagttagacaggaggaatgtgttttagagatctgttgcacagcatgttrctatagttaataatagcagattgcgtatttcaaaattgcgaaaacagtagattttaaatgttctcaccacaaataggtatatgaggtgatggatatgttaattagcttgattttatcatgtaaaatctacaatttaaatatatatgaaaacatcacattaaaccccataaatatatacaattattatgtcaattaaaatgaattaaaataatagaaaacccccaaaaaagcatgttatccattaaaacacgaaaaaccaagagccgtcaataactgcatgtttctagtgagactacagcaatttctctgtgcacttgccagaggcttctctgacatgtggtcaccctggagcccatgcaacaccctcttattgccacagacttctgtgctcactgcatggccaatatgtgtagactaacttctgacagttttatattctcttttaaaattttccacatttgctcttgatctcattctttcttttttctgtgctataaatttctccagctctactagatcatcccaccagtgtaaaaacatgcaatagaatgtcacatataagaacaaaacacaagaatccttgctacctcatacgcctctttatcctcggtcccatttctctgctctcctgtatagcaaaacttctcagaaaagtggcgaatgttgtccccactttctcatctcctgcccctcctaaccactctaacaggtggtctgctcacaaaaactgctcttgttcaggtcattagtgatgcccacattcctgagtcccatggttctttctctgtctttatttgatttgacttctcagagtacttagactctcattcttgaagcatttgcttctctggcttttgtggtagcatgctgttctagttttcctatttcactggctgtcccattccagtctctgttgctggttcttgctcctctgctatacccctgatgtaggtgtkccccagggctggcttctgggccctcttctcttctctgtctatgctcactcccaggatctcacccatttttgtaggtttacataaatccacatgtaaatgactcccacatttatagattcagccttcatctctcctctgagctcctgaggctgaaatccagctgttcccttgacatctyaactcaggtgtctaatgagagtcttcaactgaacaggtccaaggaacttttgacttatgccatcctccagtctattcctcctcatgtcttcctttccccacaaatgacactaccatctatggtgtggctccaattccagattatactaaacagttaagggaggtgtgtggtgagaatggtggccatactcccttggggtgctgtcaccaggaccagtcttgagcccagttcagccctccttgtttagtagcatatgtctcaraacatgatatgcacggccasttccacccactgctttcacttccggccccttttcttaggagttttggtctcataatggctctagaagcagaggaactgaaggctagagtgggcaaaagtattctctctacttccaaaattatattcatgcaagagaagttgacttcctggttttctgggtagtacaatccctaggtccatatgatgtggagctggaattgtggatggggaatggtgcatttatggaaattctttcagggcagtaggtttgttccaattccattctcatttttaaaaataccatttgcttttgcctttttatttttttaaatcatcaggtggggagtgggaaagtctaaatcaaagactgtcattcagatggtattttaggctagaaatccccaatatagaaatacaaatataaacaattaggagaaatttatttatacccatgagaatggcaaaattcagaaaggtggatcataccactcttgtcactgatgagggagatggaaatttgcacgcgtacactggtgggagcataactggtacgcttattttggaagaatctagtgaagtgaaatgtgtgcctgacctataatccagcaatcccactcttgggtatatatgtcctagataaattctgaaaagatgtgtacaaagatttcattgtagtattttacttgtgatagcagggacttagaggcaacctaggtacccattccaagggaatagataaagtgtggtggagcatctatgggagggatatgcagtggagaagcgacagcctaaacacatatagcagcatggttagattttcacaacagtgttgagtaaaaaacaataggaactggatgagatttataacatattatgacttatatgttaagttaaaaacatacctaccaaacttttcctatttgatttgratatttgaatatttaagtttgtatgttaaatatgtcagagatggtacccatgctaggcagggggttgaagggggaaaaagccctgtagcatctggagtcaattcagacatagagaataataatatgtctaaaattaaagacagagatttcaaatttgagatattttccctgtaaattttagaagrttagagtttcccaaatttagatttttttttttttttaaagaactgcctttaaaccaagtttcatgccctgcttgagtaggccatgactttgtctatggcagttagagctagactctaccttttttctgctcccaaattgctccgagttgcttgtggtgtgaaaccggtatacacaatcagttgccttactttctagaggatgaaccccttaaggacagggctgcaactcagtcatcctggtgtccccatcacccagcacagtgaccagcagtgatctgtacttatttgtcacctttaattgcatcacggtgtttgtagtctttttggtgtatgtgcgtgccctggcaagaggctcatctaaggcatttccccacaaaagggcaagcctctcccacagatacagtataatactaacttccaagaacataacatgtcatatggtcacaggtataaaaacataaaatggattttcccgartgatggccaaatttatccccacagggaggcagcatcttttctacttaagaagtacctttcggaagtgcttttcaagttaatccaatcgcaaaaacattgaatcctactaagtgccaggggacagaagtctagggggcatttccaccaagatggccagaaggctctagatcaagtggtaaacagagcgtggtatgtggagtacaatcctttcggcaataatagtcataataggaaataataaagacctacatttatagaatgctttagacctttcaaaagtactttcgtgtcaattatctcagtatggtttggtgaccaaatctcaggcagcacctgtgatcaggtagatgttttctttggaaaatgatctccagcattgggctacatattttttaggttgcatgagtgtgcgggggaaagaggcaattgtcgtatgcttccatagaaggagatgaaggagcgaagaatggaaactttcccatccctgggagtaaaaccttacatcrgtgatacccaatcctgcttattgatgccccaggggtgtcttgaaattcttcaaakgaaattaattgtaattcacttcaatttttaaaatccacagatatgctgcatagcacaatgcttctgggcagggtggcccaggggaggtggactgaaagttgtgtgtgtcaaagaagctgtcaatccaccaaagaacaatagcaagctgaaactcccccaaatttgggggagtgattggtctgtgtttgaacctgcagggtaggcagaggcagaaagggttgatgttgattactgaaaaagttgaaatagctttgtgggtgaccagaatgacatcatgctctcaacagaggatgccctgcctggggccactgctattaagatgcccagcttggctggacaccatggctcactcctgtaaactcagcacttcgggaggctgcggtggatccaggctggggtaggccttggattgcctgagcccaggagttcgacaccagcctgggcaaccttgtgagagccctgtctccacaaaaaatttaaaaaaattagctgggtgtggtggctcatgcctatgatcctactcaggaagctgaggtggaaggatcgcttgagcctgggaggtcgaggctgcagtgagccatggtcatgccattgcactccagcctgrgtgagagagcgagacgaccttgtttcaaaaaaaaaaaaaaaaaaaaaaarmwmaaaaaakagygcycagctcttcccaaagtctggaaaagcaggcttcctggcccctaggggctatgtcaaatctgtgttccacagtggatggcaaggcttcattttatccttatcatctttaatcggctaagttaacaattcattgctcttttttgagacaaagtcccactctgtcacccaggctggagtgcagtggcgcaatctcggctcactgcaacctccagttcccgggttcaagcaattcttctgcctcagcagaagtccagagtacctgggactacaagcgcctgccaccacacccagctaatttttgtattgttagtagagacggggtttccccatgttggtcaggatggtcttgatttcctgacctcatgatctgcctccctcagcctcccaaagtgctgggattacaggcgtgagccaccgcacctggcccaattcactgcttttaacatttgttgatgccaagaaagtgctactggaaggctghtataggtttaagaacacaatgattggtcattctttttctttcctacccagattggaaattccaagtttkctctgtcatcacatctggttaatgcagacactcgaatcactgtgtgttctagtactcagaacttaaaagtcatcatatcggatatgggagactcactgacaactgggcctcaaaggaatttatcaagcgccgcctctgcttttctcttcctgctttgctgggtttgcatgggagctgggatttgcgggcagctgtaagtgtgtttgggctggaggcaaactcttgtgtctttttagcctgattctacatagcatagtaggaaaggggccagagaaagtggctggcagtaagaaagcctctgttttgagaatgtgaagcagcctgggagagagtgagggaagaaaggaggggagccgagagttagaaaagccttaattcatttcatctgacagctcagagccagaagttgccaggtctactcatttgcaggttgtgttgtcaacacaatcacagtattttayagcccacacggaccttggactctggcatgccatgtaataggctgcaaaaagtagcagctctgcttcccatctcactkggggcatggggagaggaggattgggtttagggaggaagggtacaggtgtgargggcacaggtatgaggtgcataggtatgagagactcaagtgtggggggcacaggtatgggggcataagtatgagggrcacaggtgtgaagggcacaggtatgagggacacaggtatgagggtcagggcatgagggagacaggtgtgaggggccaggtgtgatgggcacaggtatgagggacaggtgtgagggacacaggtgtgaagggcacaggtgtaaggggcacaggtgtgggggaacatgtgtgaagggtacaggtataaggggcacaggtatgaagggaatggatgtgggggacacaggtgtgaagggcacagatgtgaaggacacagagcttcatctttgctcctcattttgttcttgcgccttctctttccagctgttacaaagtgccttccagtgggccacctccccacttcctctgttgggggcaggccagcacagcctattgcccagatggcagggtctcaaaacagcctcccagtgacctggttctataatatcctagaaggagttggaggacatgaccatgtcctggttctttgtgttcagataaactcaaaggccctcaatttcaagcccttccacatcctgtctctttcttccttccattccccagaagacagtgattggtgggtcaatgggctccataggtgatgttccaccccatgggagagaaaggatcttagtgcagctgtgcccactgtcccatacgtgggctgctccctctgcaggaagtctatctctgcagaccagccttgctgtcaggagcgccctggtcacccggcctctctggcttattgtgcaggaggggcagaattctaaaccaaggagaagaaaagcccaaatggagataagctggcccagtgcagaggggcagcataacttagtaggaagcactaggctagagtttgagtcctggctctggctttgcaaagtgtgtaagtttacacacaccactttacttttttatactcaatttctttctctgcaaactatgggaaaaaatctccactttctctactttacagaactaatataaaaatgtgtgaaagcactatgcagaatatgaaataccagatgaaagtaaggtggtggacagaactgtacagcctcaggcttctcaaccaaagatccaggtccattctgctgtctgcctccagtagatgtttgacacgaactccatartctcaatttcaacctcatacttcatggtttctttgtctcttccctgggttttccccatggcgataagagatcagaaaatgtgctctctctttgtgtctgagatgttggagatgactaagaaaatatcttaaatgtattttgaggcctggtattctaaaacaaagcctgctgctgaggaaaactacaaagggtggtacagatttaaaaggaggcagatagcctgctgcaggcaggaccacagtcttatcaccycactacacagctataaagacacacaggttctgaggtggcatgtcctgcagcaactgtgtaaggcagggcttcttatccctgttttacagataaggtaatactgaggctttgtgagcagacagaggtctctccaatggtgaggccaggatttgatcccaggtccgtcaaactccaggatccattctcttccccctgcagcacaataaatttgattatgcatagaatgtatatgtgacagctctcatcctgtatctgcctcacagcaggacttagtgctttgatgaatcctcaaaataatttagtttcatagtacactgatgggaaatggagcttttactgaagattttctggggccagatcaagaagacattttgcattaaacatcatctaaacaaacttcctttaattccttgaattcattcttaacatctctgttcttcctaatgcttgtttctcagctctacttccaggattggttcatctattttttctcactcttttgctttgatcccttggtatctcctccaktgttccaagtaattcatttccctcccgcagcataggcagggtggccgagaaaaagccctgcagttagttgagctgccttcctttgatagcaatccagtgagcatctgggttattctggcatgtccccaggtggggctgaccaaagcattcactcaacagagtaggtgtcctccaaggctaaggtggactgtgctattaaaaaaaaaaaaagatttttctttatattgtgtgatgtgggagagatggagaaggagaggtaaaagagagggtgtaaggtactggaactgctatggggggaaagggaggagggaattgayaggggacattaaaatttgaattacaggacttggtgattatctggagaagkagagaaaggaaagagaagggaggactcccaggtacttgactacagcagcagggtagagtaagatggagaattctggaagaaaaatggatttgagatgggtgagaagaagaatagtttggggaagataatttagtttctgaatgtagggcttccttgctatctacttgggaccctgcccctcctgtctgaccccagcagatgcactttttgctttagttttaggtcatctgctgattcatctgctgattcaggccagcaccagctggggagatgggagcagccagcaagctcaggagctcagaatgtgattccccagctcaccgccatgatgagtgctccgtagacaacttactctgcttggagtcccctggggttgctcccacctctggggtctcctcttccatttttcccagctgtggttcctctgtcttctctctctgtaaattttttgacttctgatctttcagaaatttctcacatctctggctcactgatggcattcatgttttccagtactagttttagatatgttcctaaacaaaacacaacaaaatggaggaaaagaaagagagatacgtactgagcctactttcktgatcaacacttctatacttatttgttttcatgtctcattccccttcatgactttgaatttcttaagggcaggaatccctttctttctgagcactaaccaattctccttttccatgcactagggaacttagtatttaggaaattctgtggctacttcttttgtaattgaaaacaaagattaaaatacaatacataatcttccaattcaagatttgttttttcatatatttccaagtcaacactattcctgagtgcctcttctgtgtttagcatgaatttaagcaaatatgtggaaaagtggaaaacatgaacacaccagatgaccctgctattccccatgcttctgggtttcagggctggagaggatgaaggataggaagtgaggatgaaggatggaagtgattctctggcctagaggaagtgccttgtgtagctggctcattggtaggtgagcttctgtcagtcctccccaacttcatgtctttgctgcatacttgtcctgtaattggtattacaccaggagtatgaggtacaacaggtgatgtagcacacaagggccttgccctcaatgaactgggtggatcagcctgacacagaggcagcagttggggagcattctaagttaagagttaaaaattgtagctcttgacagatctggtctcargctcacctgacttgctaaattagtgattcatgcagtaagatcattcagattccaaaaagggaggcatcagtatggggagagcatcttttcacctttgcacatggctccagaatttccactggttcaaaagaatccccagcaaccccagtctcaggagataattgctcttaacagcgcaccacactgggcaycccagcacttatggacagcagaggaatgtaagggtgaatgcatgtttttttttctgcaaatgactgtcactcattcatcttggagcccacctgacaacttgctttccaggtaaaatagcatcatttttctaggctggcttcttctatgctcactagcagggctgacctcagatgtctggggcagtcttargtaccttaccagactgtggtgttctttggggggacttccaggactgggagaggatgtggcaggggccattgttctggagtctcccaatatctgtgaggtcatcacaggggtgccatcctgcccttgcagcacagcttagattttgccttggtctgtaataaaggatgaagtgaatctctgccaaaggtcccaggcttgcttggtgccaagggtttcattctgagcacgtcagcatacagtcggcctaatggataaagctattatagattatctaattaatacagcagactgctgtttcattacaggggctatggactctgtcagtgcacaatgcgtagaggtactgccatcagtttcttgttcctggtgttggggtggctaatgtactatatgaagattcagaggcatttaaaaagatgatcaagtgccatgctgaattcatgtttacagcttcttggcttgggctcttgaaatctagaagtctttgggactgaaagcgaagaatttgtcttggttcaaaygctgtctgctcaatcccattattgccttccagcacgtgcccttggacactctcgtatcttgttgtctggttgtagagcagattttcacatgctgggagacatcatgaaatgtgccatttgtttcactgagaaagctcttctggtggctggtggggctgtggcacctactagatcactgtgttatttccagatcctgtgtttggtgtaaatggtacctggtttgtttcctrtctttaaattacagtattcttaggagtgctgttcttttgaactgcacctgttggactcttcttaattcccgaagaatctgggccattgttttttaagcttgtaatattatccttcactgtagggtgatttggtaaggttgcacttccaaggttcttacattcttcccaaatgtacctcattgcacaagctgctaccaggagaaaagggtgcctggattagtctcagggttcaaatatccagaatatcaaggtttctcttaggaatagttaactgagtaaaagaaaacctgcttgttattctattttgggatttyccccccctataaaaatagaactgtatttaaaagttaaatctagactgggcatggtggctcatgccttcattcccagagctttgggaggccaaggtgggaggatcatttgaagctaggaatttgagaccagctgggcaacatagcaagacctcatctctaaaaaaaaaaaagaaaaaaaaaattagccaggcatggtggtgtgcctgtagtcccagttatccaggagcctgaggtgggaggatggcttgagcccaggagttcaaggctgcagtgagatatgattgcacctctgtactccaacttgggcaacagagtgagaccatctcttaaaaagaaaaaaaaaaaaagcagttaaatctacgtatagatagtaaagtgttttagtttttctgttactgcctttacaaatgaccacaaatttagtagtttaaaaaaactccaaatttattatcttacaattctgtaaagcagagacctggtatgggcctccccaggctaaaattaaggtgtgggcagactgtgttcctttctggaggctctcagggagaacgtrtttcctgctccttctggctgttggcagaagtcaagtcttgtggctgtagggtcgcagtttccttcccttgctggctgtaacctaagggctctttcatgcttctggaagctgctgcattccttggcttgtggcctcttctctccatcttcaaagccagtaatagcgggtggggtctttctcatgctctgtcttttgaactcactcttttctcttcatctctgcttttaagagctggtgtgattagataagagattatgtaattagtcagaccatgataatccatgataaatctcttcattttaaggtcagctgattagcgacctcaatgccatctgcagtcttagttcccgtaatttacaggttctggggattatgatgtagacatctttgagggggacattattctgtgtaccacatatgatttcttcattaaacacaatacatgtaatttaaattctagaggttacaatggggaggaggtaaattagctttttttgagcacctactgtatgccaaacctcatgctagatctgcacatgcatcccctcattctaacatctcaacaaccagatgagatagatactatccttgtttgatgatgagttaactgaggtttagagaaattaactaactttcctgaagtccaaaagctagtaaacgtaggagtcaggactcaagctcaggtggctaagattccaaatctgaatgtttctctttccaccacatcatattttttctcctgggatctcaactaaaagcctcagaagtaatcacttatttaaatgtatgtgtttcctccaggttcgttatagtctgtttgaagtctgagtttgacgtagatagattactcatttcccctactccagcctctgataagcagcagaccaattgtatattaccacaacctgggaaaagagagataactgataaagtgaagagactttgtctcaaggcctttggtggggctgagctctaagtcaactaagtggcttaaagtggaaccaggcatcttatccctgcagggcctcccctgggtgtgacaggtggagggcataccagtcggaaagctggtccaagcctcctctgtcctgctcatctcagctgcctgggactctgcagagaggctgcctgggactctgcagagaggctgcctttggtcaattcaagctgccccagccagcacggttgactggcacagaacggcctggagtggctgtgccaactcagtcataatgggaggagctgtgcagagaaagaccttccaggaattgagggtgcaaggagataggatggggcagatatgagcggcaagtttggtggggccattggcagggccacatctggaggcctcccattctgtgaaacaccccagcagtgtgttaattgatttattttgagtgcagtttgtttggatgtgggtagactattgatgctgtggcactttggaagctcacgtttccaagccagagatacttcatttgtgtctgaatgagaaaaatctcaagatacatgccgttccatccctgagatgcctgccacagtaccaactcatggaggctgcagttacttcagtctcatatacacatatatgtgtgctcacatacacacttttaaataatgtgatcggcttatgtcctgcttcagtattcttgctcttttcttccaatttgggtactgctctgacaggctggcagcacaccacaattctgtctttgcacattgattgacctgactctgacatatcaggattgcaaattactaacttgcttttaggccctggctcctgaggaatttataatgtctattgggatctcttctcccccttagcttctgcattgagagtcagaagtgtgcatgaagtggtgttggcttctttctgtttgtatccaggagggtgggaggccccaggagagcagacatctggggcttctttctgttgcactgccaatgcctatccacagaygaccttatgtgaaggtgctaggctgtgaattcctttgttttatttcaggaaacattgattaaacatctattttggatattcaaagacaaaaaatgaccaacttatttctcaattaaaatggcaaatgcaatatagtgttatcatkgctatggggagtggttgggaaatataakgtattataggggcacaggggcacataggagggtgcctatattagtctgttttcacactgctataaagacatactgagaatgggtaatttatgaagaaaagaggtttaattgactcacagttctgcaggctatacaggaagcatggctggggaggtctcaggaaacttacaatcatggtggaaagtgaaggagaagccagcatgtcttatgtggctgcaacaggaggaagagagagagcaaagggggaagggctacacactttcraacaaccagatttcatgagaattcactatcacaagaatagcaagggggaagtctgcccccatggtccaaccttctcccaccaggtgccctcccccaacattggggattacaattcaatatgagatttgggtggggacacagagccaaaccatatcagtgagtgcccaaccccatcttggtagtggatggtcaggaaaagcttcctttaagaactgacatacaagctaaacctaaaaacaaagtggagattttcaggtgaagggggattgtgtgtgtgtgtgtgtgtgtatgtgtgtgtgtgtgtttgtgtgtagaaggggttcaagaagaaggaaagacaagttctaggcagaatagatggcatgggaaaacacccagaggccaragataatttggcaattgagagaattagaaaccgagattatgggtggtttttagagcgcagtaatatcatggatggaggtatggggagagattagattagcaggaactaaaaaacgagataataatgtataggccaggtgcagaaatttgtgctttaaccttagggaaatgcagagctactgaacaattgtagaatagtttcatgatcaaatttggctttaaaggagatgattttagctgtgatacagagaacggcttggaggaggcaggaccagcatcagggagacccactgcagtggtcttaggtgataagagcagtagcctgacctaaggactagaatggagaaagcaggtgaatctgaaagatatttaggaattgcaaagagtaggactttgtgattgaagaataggattgagggagaggaggtggcaataagaatacccctatttctggcttaggcaactggatggtgatagtggagccattgatggctacagagacagagaaggcagcacaagtgtggaggcatggggtggaaagatgagagctgtatgggcatgtggaggtatagaaatacttctgtgctgttgacgaatagtcagcccttagcaggcactcatatattttcttccactgcctcgctcaccctaactaacccagtacctakggcattctcaagatctagaaatggaacagttactgtgtgacatagcaggaggtctcctgttctgactggttagtgcccttgccataccagatcaatatttttaacatcccttctgtggagacagttcctgtggtagggttcctgtggcagttggttgtaaaaagacaagagctgaggagaaagaggttatagccaaccaggcacggtggctcacacctgtaatcacagcattttgagaggctgaggtgggtggatcacctaaggtcaggagttcgagaccagcctggccaacatggtgaaaccccatctctactaaaaatacaaaattagccgggcatggtggcgcatgcctgtagtcccagctacttggctgaggcaggagaattcacttgaatctgggaggcagaggttgcagtgagctgagatcatgccactgcactccagtctgggcaacaagagcgaaactcagtctcaaaaaacaaagaaaaacaaaaaaaataaagtcatagctagcaatgttttatttgagagtcaccacctaaagggtaaagcctttgagtgsatgaaagtcttcaggaagagtgtagcaagaaggaagacagggcccagggctaaggaatttggactttaccctacgagaagtggggagccaatawtgtattttaagcaggggcatgaggcaactggtgargcctgcaggactaaagggagtgccagagatgtctgacaaggttgctgccctcaatgaactaattggggtaggcgagataaatgtctcttggaaagtaatggtcatgccaggtgtgatgattaagtagcaggtgtgtagcacagagagtaagggggctaattgtttcccacaaagtaacttggagcccctatggttagggccggatgagggcttagtcaatcaatttgcctttgtggtaatcctgaatagaagaggctgctccttgggtgagaagacaaatagacttttgagttccctttaaaggctagacacttggataactaggaagggttcttagtaaaagcraatgccttttatgagactgtgcagtttacaaagccctttgatgtctgctacctcatttcattcttttaacaagtaagttagaggacattgcagagataaggaagtgaggcccagagacgttagaagttaattaataagttatggagccagtcttcatgtctgggtctttagatccaaagtttgattctttcacacttctccagtggtttgcaaactgtgttccttggagcccttcagggatgccttgggcttgcaggtgatggggaggggatgggaagcattcagggagcagggcttctgctcccagagccctacctcagccagggctctcaggaattttccagttttctatgtcagcctgttttggaaggtttcccccaaggaagcatttcccaatgtggaaaaacctactctatgctgtcttcaaggctatctctaggtaggcctgtccctaaaccctcctccraagttggtgtgaattcctgtgcttaaccacatrcaagatctagcaaaacacttcttcttttctaaccctaactcttcagctccagctccagcctattccctctggatcttgttctaggttgtctggtggttcttctcagtacaatctgtttcgtttctgccccaacaccctaccacctttttctagattcctggcactccagacactggaagaacgagtataaacatttaccagcttggatcctttcccagacatgcattgttgctgaccctgtgaccatcagctggacagttttagtgtcttcaaatcttgatggacttgtatttggacactttgtggcagtgtttttctgaaaccagtgcatctcaagtagttggatctaataattcctttgttctcagaaattgtacgttcattaaaacaatcctttgtccattaagttactttttttaaaggctacagtttgcctggatgtatccagtaggcatgagttagagattaaagacaaagggcccaggggcaaaggaaataattttgtttcctaatcatacagtgacattacaagttagcatttctgtagtttccctkgctgagaactgcctagaatttagtgataatttcctgactcacaaattgtgaaacctaggcctaagcctttctcctyttcttaaatatttattgagcacctacagtataggtgcaaagcttagctctaggctctgtaaaggatacagattttaacaaacagtttctgccttcaagggagttaatggtcccagcatgtgcctaagtaatacaaggaggaggcagggaggggtggatggagtaagtgctgagggtggcctgaaaatggaagtaatcagtttatttcagggttccaaatgagaacattagtattatgctaagtaacttctcttttatatcctgctccagaagtgtaggggttggtggcagaatcccrcagtggacagaggcccagaagccaactggacagaaggtctagcaaggagagctgaccctgataaatctagtcccagctgctggtgtggttgatgatagagagctgtgggctccagaggaattctggtgctgagacaaactcacgtatttcagttgtatgctttgcaaaatctgtttgattgccagtagctcttgagcccttagcccctgataggctggtcacccaccagatccacagcagggagaacacaggctctgcagacagagactgggtataggttactgctctctttctcactttactgtgttggttgcttaacttctcttgcctcagggttctcacagtgcagaggggaaatgatacctaccttgatgggtggttgaaagggtgggagagcgtgcagggaaagagcttggcatacagtagacactcattagatagtacctcattacttttgttatgaatccaagggcttcatggtgggatcaaggaccacagctgtggtggcctagcacagatgttgcattttactcttgtgagtggtcaggaaagccatgctgtatggtggagtgagggtctagagatcaggcccccatccccaccccgctccccagagcctccaggggaccttggacaagactcttaaccttctctgtacattattcctattcaaacactgataaaatggaagtgaaaaatcacaaccttctgaattgaaagggacctttcaatataatctacaataggtgtatttagtagaagagacagttgaggcttagacaaggtgaaatgaagctccaaaggcaaatcagggggtggccctgtcttgactcccaatataatgctccccttcacatagttgctacccaagtaggtggtggcttgagagtttgggagcattcatgaactattgcatctgaggtgcttttggctggaccacttatatcatagacaaatccatttttattagcatcattcaaggttcatagcataaaggcagcaagaaatggtagtgaaaatatgctgtcttccccctaaaccagttttaatttcttaactccctcctgccccttagttcctctaagtattttcctcctctgacctgatattcattcacttggtatttattccacatgtactaggctttgcgtactacagggacttcatagccaagacatgcaaagttgaaaagttggataaacaatacaggaaaaacaaaagtgaacaaaaatgcaaagcactatatgattaaatgttaaatgagaaatctatgcctgtggttcccaaatgctaatttatggatttgtacttgttgatgataacattttcatcagttttctgtgaaatgagaaaaatagggcaaggtgtgattatttcataaggctacatttatttaataggattttctgagattatatccttccaacattttagtgctaaaatgccctttcttttatgagatgttggagcataaatagtggtggttgaaagcccatacttaaaaaaatagaaagttggccacattatattggtttcttttgaaatttggctcatccttgaaatctaaagctaagacaaccactggtgggcacaaaagtccagagtgaaggggaggagcaatttttgaggagtggagtgctcagggagagctccaaggacaaggacaaacactgataaggaattgaaggatgagaggattcaataatgtggagaggtttggggagrcttcctcttgagaggataacgtgagaagagccttgggagcaagtgtggagggtctgttcagggcaatagggagaaaagtttggatgccttgtctttttacctgctgtgctcgtaaaaaattcacccagttgttaccacaataaaaactgatctttggctcctttcaattaaccaggtcactgtcctgaactacttgccccagtcactgaatcaatgccccagttcaccttgtattccagaactagtctttcatctgctcaaggcaaggtcaaaaacaggcatacaagagcatctgatgctcagtaactcagctccagttctgacttcttttttttcatccttgaccataatttagactcattaatgggttagatggtctttgctcattctggcctcgtttctgggccctacaccctaggccatgcccttgaatgtgtccctagctctgtgaggaggacccatgagcagtagtgtgccagatgcgtcacagaggggacttagggaatggaagaaggctcaacaggatgcatttactgggtggagagggaggaactggtggcctatgcctgtgggactgaggttcggatggttaccattgactaaaatgggaagagagcctgtttggaggagaagaatttggtttcagggatgttgagcccaggaatgggaagggagaactggtaagaaattggagggaggtgaagggaggatgaggagaaggaccaggtccatttggagtcatggtcaaggtcttctggagagagactgcatcattgctgmwggtaccagtgagtgaggaggaaactgaaaagagttcagcctcacaggaaggctggaaattagtgcaggagggatgggcaggtgagtaggaggctggggaggtcacasaggacaagatgagagagtccattaacctagagaacataccatttgtgtctgtagggggtactcctgtgttctggactaggaggagttgtgtttcactatgggtgaagagcctgagggtaaggagaggctgtgcctgttctgcgaccctccatgtgatctgaggtattcccttggcacatactcagacacccacctcctttgcttggtgtcttcaatctttccatacctcctcctcagggggaagaagtccttgcttcaagtaactgactggctgcaagtcatggagagggttggggccaagggagccatctttttttacgcctccctctggggctgctaagagcagtagatctgtttgagcttatttatgtgcctggagttgagagctcatattttgcttattcaaccagcttcccacgctgccaggaaggcactaagcagcagaaattcatgttcaccctctctgtctccctctctctctcactctgtctttggtattcttcagctccaatgggagctaatatttacctgcagtgttagctgtggggccgtgggatgtggcagctggaggtggagaagacttttttctcccttcctcctccacctgtctttccctagagatttgaaaagggaaaaattgtaattttaatctttaagactgcctgtttgagatttcagatgttgttgagaaaagtcaaggggtcttgtgctcacttttctactgaaagataagtgtcttagtctgtgagcctctataataaagtaccacaaagtaagtggcttgtaacaacagaaatttattttttatagttctggaggctgggaagtccaagatcaaggcactggtagatttggtgtctggcaagggccctctgcctgatggatacctttctttccactgtaaccttacaaggtgtaaggggcaaaggatctctttggggcctcttttaaaagggcactaatctcattcatgggggctccacccttatgacctaatcacttcccaaaggccccacctcctaataccatccccgtggggggttaggatttcaacatatgaatttgggtgaacataaacattcagtccatcaaaacaaggaggaagatgagattggtgggcttttaggacatgctgcagagaagggagaaaatgtcagccaaggaatactgtcatactgttccttacaagtggagtgactcccgcgttggtgacaagagggcatggatgacagagtctgagacattactrtgactggtcttacttggtgctggtcagctcggacaacttctgcagggggagcctagcagatttcatgtgctaggcacaacaagcagggctggcagccatagcttctccctacctgcagggaatgtgcataggggcaagttccctctgagcccactgcctggtgctgactcagcccaagtgcttacctgctcaccagtcaggagttgaacatatagatgaagttgaacgaatgtctgaggycaggaataggaaaaatgtctcagctcaatgtggtttgcgcatgacaaaaagagtaactggtgatatttctaagaccttggtacattcccactatgggacaggatcgtccctctccaggatgctgggggaagggacaggtgggagatggggcagggatgaaaaggagaaccttgaggccgggagtgggtggggatgttggcctgcatggattccacacaaggtctaagtccatctgtgtgtgtaagccagcgcccatagcggctggaggctcctccactcacttctccagtgccttttcctgcctttatagcagttttccagaaagtctattcctgttcttcaaactgctcttttatgctgtgtgtcatgatttctcatgccccagtttgtcctgttgttgccatggtagctggctaggggtcgtctccagttgggtgggaatatcttgctggcaggccacggaggcagaagaagatatgggtgacttcaggctggtgcttcggggactcctggtgttacagaccaccacctggctccccattccyacccctctgcatttcccacagtttcctatgcccaccagaaggcaaaaacagaggaggaaataagtgtaatatttgcctttgttacggccatttcagaaaaagcctggcaaggcatagactgcccctttcaagattgagctatggcagaactaagatgggacccttgtctgggcaagaaccgcaagggaacacttgtcccatcaacacttagaaagagaaaagaaggcagcagacagcaaggcaggatttagctgtgaaaagccacttccaagaaacacgaagataaactgaatgcccttgacacctatgagctaagcatctggcagctgggactctccatgcctatgaatatagaaacttttgtatgggcccttgacttcacttttgtgaagtttcctgtgatttgggcacactgcattattgtttgcctttctatctttcactttggtttctatcacatttgatggctacttttcacatgatacattttaaatcatttatttacccatccatccatccatccatccatccatccatccatccatccatccacccatccatttattcaacaaatattcaagaaataaccattgattacatactatatattatgtactgttccaactatggggagatagcagtgaacaatattgacagtctctgctctcaaggagcttacattcatctgagatagatcaataacaaatagacaagaaaatacaggatagtaaagagtggaagattaacctggggtgatgtcacagactgtgactgggtggatggtccaggaaggctctgcaaaggtagcrtgtgagctgagatctgaaagccaggaagcaaccrctatgggaggatggggaagaacattcctagtacagggaacaacattcccagtacagggaacaactagcttaatgccctaaggcagaagcaagattggtatgtttgagaaacctcaaggagggcagttgagataggtgagccggtgagcacttgggctgagtcagcaccaggcagcaggctctgagggaacttgccctttacacatgttcaggtagggagaagctatggctcccagccttgcttgttgttgtgtctagcacatgaactctgtgaggattcctctgtagaagctgcccacgctggccagtgccaagtaaaccagtcatagtaatgcctcagactccatcatccatgccctcttgtgcctaacactggagctactccacctgtgactggagcgatggggaaggacgtggaagatacagtcagagggttagtgtgccagacaccttacctgcaccacgtcacagccttgtggcctcaactgtttctgggacttttggctgcttgttcaggttccagttgtcactgcagtgactgaccaactccatgcatgtaaaacccgacagcacttcacctcatgaagktgtacctcccacctcttaccctggagcttccctattgacaccaactcacgagatgcacaggactctcctgggcaactggaaggtggagaggaaattaactccctgagtgatgaacatttgatcagtgagagattgagcagatgaattcttctctgtcttctgatggactgtcctgaggcacagttgtcttttaccaatggccagctaggtaatgcaccatcatattggctctccctccttgcctgccttacttcccttttccctcactcctgcttccttgcgtttgcataccttaataaaggcacctgaacccttgcctcaggctctgctttctgggggaaaccacacttagacggagaggcaggcaccagctgatatagggcctggtaggacatgataaggaatttacatttcattttgagaattaggggaggttattagagaatactgaactggagaatgatatggtctgttagacttttaaaaaagctgactctggttgcagtttggagaatagattgaaggaaggcaggatgagcagtgggcaggctactatcacagttcaggggagagatggatgatggcatgaaccagagtgggagcagtggtggtcatgagcctgtgtgtttgtgaagggcaaccataagacaaggctgtactgagaagcatactgggtagtgggccaggaacaggacccacacctttgcacagcagctgttatggttgaaattcaaatatgtggttcagcaagacaacaaattacaacctaccaaggaccttcatcacctgttgaacatagagagacttcagctggggagaactgaagacctttacagaaacctcaggacatttttattcaaacccatccrtggagttccctcaggaggaaggagcttgggttcagctcctagttgaatcaagtaactctcygccttcatctgtttaattcatttayacttagagtagtatttcttttgcagaaagggatgcatggctaaaaatgtactactgcttccattaatgaaaattaatttagcttaataagatgagtctgaatcttggattctgccagccctgagtttgaattctagtttgacccgtttctaggtatgtggcctttaagtttctcatctgcaatatgggaattaacactaacttcctggagttgtgagagttaaatgatttgggtgtataaaatatctgatacatgctctttataccctctttactccactcatagtaaataaatcctgtgggaagctgaagtacggtggggattgaattgaggtgggtgcaaccttagccctcacctggtagacttccttctagagtttaacctggagatactggagcttttgccattaagggaggtaacagatcattacaaaacattcctctggagttattcaggagactagaactgagccctttcttttgagagggtcaaaacagtatcggtttatgaatgactatgatagtacccctgtgagatagtttaaaagaagtgttgggccgggcgcagtggctcacgcctgtaatcccagcactttgggaggccgaggygggcrgatcacgaggtcaggagatcgagaccatcctggctaacacggtgaaaccccstctctactaaaaatacaaaaaattagccgggcgtggtggcgggcgcctgtagacccagctactcgggaggctgaggcaggagaatggcatcaacttgggaggcggagcttgcagtgagccgagattgcaycactgcactccagcctgggcgacagagcaagactccatctcaaaaaaaaaaaaaaaaaaaaaagtgttgttcaatccattttatagatgatagtttctaatacttcaggcagttgtgccttccctctgcaatcaaactctggggcatttttccccttgatgctgtcttcttcacttgctcaaccaaaaataccagctcttgcagaataaatcatcaatttctgagggtggctgatgtgaacaactcatatgaatctcaggcccatcttagatttttttttttttgggaaattacaaaagtattttacatttgttatagaaaatatggaaaagcatatggaagaaaatgaaaattatccgtaatgccatcatgtacaactgatcgttaataatggataaatatccttctaggcttttttttccctacacacatacctgtatgtatattcacacacatacatatacccacatacagcttattatactaatggggattatagggtgcacatcttgcttttgtaaccagctttactgattaataatatattatgaacagtgtactgtgtcattaaatatagttttaccatgtgattttgaataattgcaagaattctcttatgtgattcttatgatttgataacaagttccttattgtttttcacttacaatacaaaaagattgtagtttttaatattcaaatgaacaatccaatgaccagttttataaatgcatcttcatgtgcaagtctaatgacctgataaggagaaattcctaggattagaattattggggcataggctgtgcacatatttatgactcttgagaagtattgccctacctccttcaggaaaggttgtgctaattccaacctcacccacagtgaatgagattgcactcatctttgccaactctgggtatttcagttagtaagaatgtctcttkaacttctcctaaacacagtttaattatgatatatttcgaacatttgtatagaaaacaagagacacccacgtacccactaccaagattaaatacataataatatttgccatatttgcttcatccctctcccattttcaaataaatacaatgttacagatgcattttgtatgctcattctttgttccttgctccggaagtcatcactcctctgarattgatatttcattaccatgtgcatttttgtaattttactacatgtrcatttatgaaaaagcatgtatatgaattttttgagttttaaagttttatttacgtgatacatagaatgtgtccttttgcagcaaaatgaacatttgtttttaagatttaccagtattattacatgcatactgagttcattatttcactttctgcatagaactccattgtataaataaatcacaggttcttaattcgcttcccttctgaggggaggctaggttgctataattttttgttattacagataaaatgatcatcttgtccatgtctcttgggtgcatgtgtgagattttctctgggaaagatacctaaaagtggaattgctgagtttaggaatacacatttccaacttttattaggtacagtagttcccccttatctgcaggggataagacccccagtggatgcctcaaactgtggatagtaycaaatcttataaatgctatatttttcctacacatacatacctatgataaagtttaatttataaattagacacaggaagagatgaataataactattaataaaatagaacaattatgtgatatactgtaatgaaagctattcacataacttatatgggctctctctccctctctaaaattatcttaatatttttggactctggttgactgagggtaatggaaagtgaaactgtggataaggtggggactactgtattatctaacacattgcttttcagagtgaatgtrtcatttccactctgcatatcatatgcagmactcccatttctatatatcttcaacatcacttgagatgttcagaattattaaagtgtgccaatctgatgggtgtgaaatggaatccaattattgcattaattgcactttccctgattactaatgaaattgagcactgaacatatgtttgttggccatttggatttcctcttgtgtgaactgtagattcctatcctctgcccatatttctatgaggtagtatgtgtttttcttatgatttctgagaatcttgtatatgttctagatagaattcgtgagttgtcagtatcttctcccccacatgacttgtctttttcactttgtttatggtgctttttgtcatacagagttattaattttagtrtggtaaaatgtatctgcatttttttgatgatttttgttcatcttctctcattaaaaaattccttccacatactgagataaaaaagaagtcatttatattttttaaataacattttttacagttttgcatatcacatttggctcttttaatctatctggaattaatttttgtgtatagtgtgaggtgggctctaattttatctattttttctctgctatgattagtcctttgactcaacaccatttagtgagtaggcaattcttatctgctgtttctgggcactttattttattccactggtctatttgtatatccctctcacccatgtctcactaatttagtttttataactttgtagttttggtatattaattctccccaaattgtcttggctattggctctttattcatcatatgatttttaggatcaccttgtcacatttcactaaaaagattagattttaattgaaatggaataaatggatagattaacctaagggagccttgccatatttaagctacttcgttttttgttttttttttagtccctgggcatgacttatttcttcttatgtttagagctttcttaaagtccctcaagagagttgaaaatttttctttacatctttaattgggtttgtttttaggtaccttatggttttgttgcttttgcatggtgtcttcttatcattactttttctgagtctttgttttaggtgtaccagaacttgtacttttgtacactgatttcatgtccaccatctttgtagaattctcttactactgtgagtggctttttttttttttttgtaggcaactcttatattttggatgcaggcagcatcacctgtgaataatgataactttgttttttcctttataatccatatgscttttctttctttttctttacttattacattaaccagtacttcaagtccaatactgaatagaaagagtttcagtgggtgtcctagactgatacttcactttacagctatgtcttgacttagtccgtgttccctgtgaacaccaccttacctctgaccatcctgcccactttacgtggcattgttgattagtaatttagttccttttttgtgtatgtattcataaattagacattatatatatataaataaaattgtcattatatccactaatatcttttgctcctcacaccattttcttgcagaccattcttttcttccatttaaatttcctccccaagaaatgtcttatagtacttatttcccctgaacttgtatagtaaactctctattttcctggaaaagtctttatttcgagtcataatttagctattttcaacacttgatgatattattctatcactttctggcctggcctctattattataattaataatctaattgctgcttcttgtaggtaatctgtctttcctctcaggatgcttttaagattttttccttcatatttttggatcttttgatatttcactagaatatgtgtgtataggttgaatttatttttatttatcctccttagaattcattgaatttcttgacttggaggatttatatctttcatcaatactagaaaatttatcctacagatcttcaaatattgtctttctgcagtctctatgatctctttatagaagtcccattagatatattttgggtctcttcattctgtcttccatgtctgttaactttaatcatattttctctatttttatctccctgggctgtatactgtggagtttcctcatatgtgttttcctgtttactgacactctccttagttatatataatctaatagttaacctatctattgcctttaatttcaatgattatatattttattacaagaaattttgtatttgccactttttcaaattatctttttttcatttcattgcattctattattttatttctttacatatcttttctattatttcaagtactggagctttaatcttcttgttctttgtattagctaacttatccttatgctgattatttccttgtgtgcttcaaaaattttgattacaagtcatgtttagtagtgcttgttttccccatggaaatgcagtgtactcaggattgtgagagtagcctaatagagtagttttgtttggttttcttacttgacccaggggtgttattttcttggcctaagtgttcctgaatcccgctgaacadgtaaattcagcccataaatccatgtcacacacaatcctgagttttgatttctcagggttttgctttttctcattcactcagagacagaagcttccttgttatctatttttgctgtagagttgattttcatgcagtttatttaactgaaggtacagttctttaagggttatagcttagcgcagaatcttagttccaacttctgtccacataaggtctaaagaccttatcacttctcttgagtggacattaaaacttacccattaggctgggcatggtggctcatgcctataatcccagcactttgggaggccaaggctggtggatcacttgaagccaggwgtttgagaacagcctggccaacatggcaaaaccatatttctacttaaaaaaaaaaaaaaattaagccttgtgtgggtggcgtgtgcctgtggtcccagctactcaggaggctgagacatgagaatcgcttgagtttgggaggtggtggttgcagtgaactgagatggggccactgtactccagcttgggtgaaagagcgagactctgtcttaaacaaaacaaaacaaaaaataaaacaaagcaaagcaaagcaaaacaaaacaaaacacataaaaaacccaacccattaaatctttgttaccaggactagttactgcctatgggacagctgcaatttcaattcacacgcttcctcctttgtatttcaattcctcctagggatttccttttatatctttcaagttcagcaatatatcttttcaaatatatttgaaaatatatttctgtactttatcagtttttctagaaatgtgtagcaagagattttcttattctgccatctttctagtactgaatccttgaatgacttttacaaagagaataaaataggaaagcataaaatagtccctgggaaatacacacagtcytctaagacttgaaactagatgttcctaatggagaggttagtaagagtgccggacacagcacaggggaagatttgaggaaggaagtgggtgagaaacagcagtgcattaatgggcaattactttctgccccctcagatggtacgtgagtgcttagctaatggcagttcacttagaaaagtgatcattggtaagtccttaccagcagctcccaaaaatatcttgcctgaagtgatcgagcctttttaggaaacgaaagatcagattcagaaagcaaggagatggttctcaaattctagtgaagacaaattctagaagaaaagctttcaaagggtgttgttgaccagagaagctgaaggattcaagctttcttgtagctttataaataagaagggaaagaaaacagaatgaaaagcaggggatgagggtacacagggttgagttgaaagcatgagtgtaggagttttcactgcagacatagctgatttgagggggaaacattgttttgcagggcttgtgaccaaatttcttaggatccaaagtgtcaggagaaatcctatttatttgaaatctagttgataagccttaagctgattatgtcaggttgaggtcactttttcttttcagcttgggttgtcccttcagactctgctgtcccttcagtttcttttatcttaaggcatggagccctgtgcaggcctatgagaccatcagaaaaatagaggtgcagctctgagttcactccaactctcaaaggctgtgacttactagatatgagggagaaaatgaaagtgtacatagtgaggcaaatgcattccactggggttcctgcattcctggtcatgatgttgatgagtcctatgagctagagcaatctatttaattattctacaccaggagtctcaactgggaggtgatttgggccccaagggtcatttagcaatgtttggaaacatttttgattgtcacagctgagtgggggaagtatatctggtgtctagtggctacaggccagggatgctgctgaatatcctacagtgcaagsgcatcccctatgacaaagaattatgtgactcagaaatgccaataatgctgmgcttaagacacccttctctacatgtcttttcttatctgcaacatggaggggttagaagaagaggttgatgtgtgtggctagattaggttattacccatctgtctaacagagagcacttcaacccacatcacatctctagatacatggaggaaatgaaattagttgaaaatgttccccaattttctaccaaagaacaaaatattgtactcgagatgtgagctttgcaggttcacggtgaccactgtgtctgcctccacgcattgggtcattggtcttgtcatgttaggtttgcgagttgcacttgcacctgtgaagggaaggttgaggacaggcttccttgagctgaactgattgtctccagaatggttttatcagctgtagcttctcccacagcaccttcccaacatggtgcagatcctaaggagtccatgtcctgcttgtgtccatttggctttgtttatagtttccattcatttatttatgcatttattcattcatttaataaacatgtattcagagtccactagacataaggcagtgcattagttactatggagaatgcaaagatgaatgagccaagccccttgtagtatagtggggagccaagatgtgtacaccacagtatctgaggcagggtgacataaagtgccagcagtactcagaggagagagagatcacttttgtcatatgaccacaaattgcttcataagggaggtagcatatgggctgggcttttaagtctaaataattttttggcaggtggctatggaagaaggggtaaggaagggagaaagaaaatgagaaatgatatggaggaggtcaattacaaggtgttctcagggaagggttaacagtcctgcttcattggagcagtagtaggagatattgctaggagcataatggcaggtaataaggacttagactggatgacatttaagttttctttcaaccctaagatgataagatcttatgattggatagttatatttgataggcactagaaaactcattcattcattcaacaacaacaaaaaatttattaaaattttttttttaaccagatactgttctaggcattggggatacaacattgtacaagcgcttcaattttattgcactgaaaggtgagatagggtcagagttgagctgtgcaatgaatttttgtggtagaacctggaagaggaagatggatgaggagactctgcccatctcctgaatggaaggtaatactgactcgaggggtggtggtgcaaatggcaaggacaggaagactgtgactgtggcatagagagaaaaatgacagggcttggggaatgcttgttgtgggagttggagtcaaggatgcagccaaagttttgtgcccgagttagggggagactgcaatgctgcaaacagcattagagacctaggagggagctggtttgtagagaaagaggatgagtttgcttttaaacaaactgattcatggtgctgtcaggtcatccaggtggaggtgcccatttgagccatggtgaatatagtaccagacaacaacaaaaacaaaaaccaacaaaaaacagagccgaagataaaggtttggaagtcttctggatattagctttatttgaagccatccatatggatgagatcactgagagagtgcatacatagtgaagaaggcagacaccgggatctgaggaatgttcacatttaggaggcaggagaaggaaaggtgaagaagatgaaggagcagttagggaggtagaaggaggagtttggaaatgctcctgagggaggcaggaagaggaaagccaattcatgctgagtcccaatatataagaatgtgtgcacaccctaatagcctccagggaaacagactttggggtgaaaaaattccctggaacatatttagctgtaaaagtgttgagccaccttatcatgttatcacttcttagtgcttcagccagagggtgaggagggagggggagtggaggaggctttccagtgagtcatccctcctgcatgttaggagttttggttaaaagatttasagagagagakagtgagagagagagagtgagagagagagagcgtgagagaaagaaagagagcaagaaagcgagagagagagcacgagagcacacaagtgagcgtgagcgagctgcttgatttattttaattttttttagagatggagtctctaaaatatttttttttttatagataggatctctgtcacccaggttggagtgtagtgctgtgatcacagctcactgcagccttgaactcctgggttcaagcattcctcccatctcagcctcttgagtagctgggattataggcatgtgccaaaacacttggctaatttatttttatttttatttcttgtagaggcagattctctatgttctctatgttctctattctctctatgttgcccaggctgatctcaaactcctggctttgggtgatcctcccatctcggcttcccaaagtgctgggattacaggcgtgaactgccacatctggccttgatttrttttctaataggttcctagggcactgtggcaacaatgccttttcccctgagaggtatataaccaaggagaggacatttggggaccttctatgattgatttttgtctgtgccatcttgttccccatagccttgatggccaagtggctatgtggggatctgtagttcacacaaagcctacagttcccaggtaaagggactttttatcttttcacctttggccatggcttggaggaagctttgggcctactgcttggctcttatcaagtcctgagtgaccccctgctcttctacgctaggcccttgaaactctcctcaactagtcttaagttccaggctacaatttctccttcagcttgtctcttgcaataaggttgtcttggtctgtttttgctcctataacaaaatactctagaacgggtaatttataaacagcataaacttatttctcacagttacggagcctgggaagtcaaagatcaaagtgctggcaggttaaatgtctgtcgaggacacggtctctgctttcttgaatgctgcttcctccagagtagctgatggcagtatcctcacatggcagacagctgatggacaaaaagggcctagctacttctctccagcccttttataaaacactaatcccatccataagattagccctgatggcttaatcatgtcctaaagactttacctcttaatacttctgcattggggattaagttttaacatgaaatttgaaggtgatgcaaacattcaaaccatagcaaagggcagtagtaagatgtagtctctggcatttggcaggcccaggctccaagtgtagttctgtgtgatcttagtgtaggaacttagtttctctgatctttattcgccttatttgggaaatggttgaagctaaccatacctatgttgtaggattcttgtgcagatcaacgaggcaacacatatatagtgcttcagccttccacagatgttggttactgttgctgctttgaagagtttctttgattttttttttaacttaatactcttttggttgagttgctttcagaatttctttcccttttctcccaatgtttttcaattaagaaaaaaatgtaattaatttgaagaaaattataacctaacacctcttagccaacttctgtgcggctcttggggaaataaagggccgtgaatgctttgattatagtgatataattcccttttggaaataagtttgtttttttacatcatctataatgcctggtgtctgtccctgcaaatataacaataataccacccacagtggtgtgacactctgtgtttacaaagaattttcatacatatcaacaatctcagtatcattctgtaaactgggtctttcaccctcagtgaaagtaatcccttttctgatatcaccacctcataaaggtatctgcaccctcatgttcattgcagcattatttacaataactaggatatggaaaaaacaaaatgttcatcgatggatgaatggataaagaaaatgtggtgtatgtagacacacacacacaatggatttttattctgctgtaaaaaagaagtagatcctgccatttgccccaacatggatggacctggaggacattatgctaagtgaaatacacacagcatgatctcacatatgtagaatgaaaaagggaatgaaacagtggttagcaccagtgggtggggggtggggactggaggaggaagtagggagacgtaggtcaaaggatacaaagtaggtatgtaggatgaatgagtctagagatctaatgtggggcatgtggaataaaattaataaaattgtattgtattagagacttgtgttaaataagtagatatcagctgctcttgttacaaaaaaagtaactatgtgagataatggatgttaatcttcttcactgtagtaaccatcttactatctatatgtatccgataacatcctgttgtaaatctcaaatgtacacaataaaatttattttttaaaaaaggaagttgtcttttgacatcacctataatgcctggtatctgtacctgtaaatataatagtaataccacctacagtggcatgacaccgagtttacaaagcattttaatacacatctctaccatctcaacatcattctgtgagctgggtctttcagccccagtgagctggtgactgtcttcaggttttagatgcacgcgtgcgtgtgtgtgcgsgcgcacttgaggtattgcttcttttaacacaaaaagctgaagtttcaaagcaggtggggtgtgggttaaacaccgttctaaatggcaggcctgctgttcatggggagggagagtggcctgaaagtttaaaaataacctgaacattatagactcctgtgaattctacagcccagagcactgtgagtctgtgggtgttttacctgctggagtgcaggcaggaaaactagttgagatgcaggaggatttaaattcgctgagtcctttagtggcatgggctggcagcagaagtatttgtgaaaaaaaattaaagccagaactaatgatcaggatcgatgttcctgaatggtaggaacagtgctaccctttgatttgctgaacaccgcatagtatttgtatcgccggtgcagcagacccttgttttctatgactgaacaactatccttcccccttgctccctgaactcccttactgacctctccagagtttggctgataccttttgcagatagctaactgaggctggcctaccagggagctcagggttgggacattttggatagacttagccattcattgaaaaacaagtaaatggtgtaaaaccatgctmattatgcataaattatgggcaatagcataccctttgaattttgagagttttgaagggttgaaataatttttgaattagcactcagttcttgatctgactcctgttgctctgggatattgcaatgcaaaatgacagcagcagtaggaggagcaggttgggctacgaatgtatcatcacatttggtttatcagtagccccatgcgattcagagggcaggtactacttttgccatttttgcatgtaaggatataaacccaaccaggactgaggtgcaagcctcctggtgtygtttccaccctgataactcatttattctgaggcccttcggcaccatctgtagagtctggatatattcttgcctcttggaactgtagaatcatcatgaaatctctattctctagctcaaatttctattaatgatatcagcgagatgaattaaagtggctaagataatgggttttgaagtcagggtgacctaggattgatcttttgctatgtcacccaccacctatgtgaccatcagggaagttacttagtycctttcagtcttgcttctcttcctgtaaaatggggtttataatagcacttgccacatgggcttattttgagaaataaggaaagtgaatctggttagcatggagccttgcacattgtaagtatttaatacctaggacaaataatattataaacagcatcacctatayttttctttgtaattattctttatttgtttgatccatgtccatttttcttttttttacagctccagaatttgcaatatgaaaatagagattatttaaacaaaggaaagtagcataactggaaactttgaattattctattaatacttgactacatatggaagaatattattgaaaaatatgatccagtgatggggtggttttgtgaaaaaatacaagcctttaaaggaaaaagctaaatcttgagtgcatgtatatgtgtgtgtccaaggagttggcttgtcagtggtgttaggaggatttcagaaattctctcttgattgagaattacatttccacctttccaatttgtaaactgcacattaggaatattcagaaacctgcaaaagagcctgtaattcttcacatttgaatgtactgtattaagcctgtctgaaaacttcccgtagcatgggaagataacctgcatgtttgtacacttggctggcagaacgtgagatcacatcagaatctagtgcatgtctttgcaaacgtgtgtgtcattttcatatgtaattcttcataagagaaataggcatgatgacatttgcctttttgtaaagaagagatagaacgaattaatactgtagttgatatgggttttttttgaagcaggactttattatcttatgtttaattttctgtggaaagggatctcaaaatattctttaggtggggagctgtttccttttaataactgattccccagatcttatttcaactccgtttctaagagcaagaaatattcctcataagacaatgaaccctattgtttaatgattgataagatggtgcttgggcagttagtgtgctggagaagttacccctgagttagaggcacttaatttcctacaagggaagtaaatacccctttttgatatatatttattcctgtttatatcatctgggttgatgtccactcaactcacaagaaacagctgggaacacctggcagcagagagaggcttctagtcagagctagaatgtgttaggggaagggtagctcctcagacagggcccagatacctgattgatgcccaagctctttttcaccaataacagttgcaggagatccatgcattcagtgacaatttattttgcaaaggcttgctatgaggataacataatgcaggcactctaggtaaaagaacaaagagaaagatatgtcctctactcctgagaagcttacaccatagttgaggagacaaggcatacataattgaaaaactaaatatgaatataatggcaaagttacagttatgacaatatcagtgataaaacagtactatgaacgatacagaaattctgtgagtttataggaggtacaggtcagtgttggagagattatgaaaggctttgtgggagagcagatttgaactggaccatgcatagaaggatgcctaggagtgggagaagcagaaaagaggaagaatatttttggggcagtgtgaagcaggcgctgtgagcagggctttgaggcaggaatgggcatgacacgtttgtttatgtacctcatactatggtaygtgaggagatagtgttggaaagataggttgaattctgattgccttgaattgtcaggctaaggtgtctggccattttataggcagtggggagccaccgaagtgatgacaatgtaacatgcatagcaactggcattttgggagggggagcttgctttgaaggatttacaatgacgtcacttttacacatattgagtctggggatgagggacaatccatatgcagctacccctaacttcattggacacctgggtctggaaatgaggcgaaaggtgaggtctaggagctagatgtggtgtggagggggtagttgaaatggcaggtaaggatataatcttgaagggagagaagtcagacagaggaaaggggttggggacagacccatgggtgccctacaggtgagagcagtaagaggaagagaaggaaacggtgagaaactgggagatgtggtggctgggatgccaagaacgatgasctctgaggagagggggaggtcagtggtgtcaaatgctgcagagtggtcaagtaggagggtaaaaaaagggaccatcaggggttcagtggtagtcttagagcaatttctgtggagtggaaggggcagagctagtaaatggcctgcccaggtatatatttcaaaactggccttaagtccatatcatatgggaatgccttcttccctttgattattttatactaggtgggtgtaaccagctgctcagtgtaggagagagtgggagagagagggtgtggtgatggacaggtggtggcttaatctgctgatgattccaacacaaagggttcttggagaggcaggattggtgggtgcagtggaatcttattctctttctctgggccttcagggcccctttaggcttgactgcagctgtgagctgcattttctgttactgcggcattatcttcaagagtgaaatgtagggagtggatcaagaccaggcaagacacgaatccaacctgggcaccttctcctaggcactgcctcctttgggctagcccctgacatgatacctgacacgtggaaggtgctcactgcatgtctgctaaatgaaccaatcggcctgagcccacccgggctgaacgagctttgcaaggtgtgggctgtgttgtgttttctgagtcaagaggccgtgggggtggatggatggatgtgctcctgccggttgttctcaccctctgctcacccccatcagtgggagctggggcgctgctgagtcctcctgctgcactttgccttggctgagcagcaaggttgggccctgagggtgggaagggaggtagacagtgatgggcatgggatcctttgctgtctggggctaaactccsaacctccaaatcaactttcccaataaagcttaatatctattagggtaagcatatttttggcttttctctgggctgaaaggtgacctcatcttatgggaaagaaaggcttgaagtggtaatgctataatcttcgtgatcctagatacattgaaagaaaataaaaatgctgatttactaattaactccatgcatcttgtgtactgcccccctccccaccccccaaaacatcctaaacattcatgctscaggctgctgctccatgcctccaataaactagctcttcaaagagatctcttttgtattcttcccttttccagctgcctccagtgggaggggatggctccctgctctgttgtctcccagtactctcctgtggtgcactccacatcccgccttgtattcgagccctytgtgggtatgttttcccttctcctcttttgaactgtaagtttttagaggctatgactgtgtctaatttatctctgagccccagaatccctgagaacaatgtgtggctcatcaaaggggattaatgagtatttgttaaatgggtttatgaattcatgaataagtaaacaaacacacagctctctcaggtatcatggcctttgggtctccagacactggtctctactatttttttttccttttttcctccattcctctttctgacctgatctcaggcacttacatgtctctgctcctctgtccatcccccgcacaacagagtgtgttcatccctggctgcacttctgaagttggctttcagaaacagagtctgtagacatgcagtgtttccagtgtgttaccgtggtcacagctactgaaggtgaaatgtacataacaagtacttaygtagcacatacttattgtgtgcaaggtactgatctaagagctttatgcatataaactaacttaattttcacaacagcccagtggagcagaatggtattattcttaacaattaaaccctctgggagactctctggttcaaggtcatgccttacctctctaaagctcaagatcctgcctataacttgactcttaagcaaggaaaatattattttgacatgcagtatgttaataatggtcacatattgtgaagaatcctgtccttattattaggagatccagctctgctatttcctagctctgtgcacttggacaagtccctgactctctgggtgttcagataacaggatgtgcctcacagtccttctgcaaagatgcaatgagaaaacattacggttggcacccaggaagtgatgggttgtcataaatgaatggtttttaaaacactttaaaaccaactttgctgacctgtggttagctgatagcatgttggagtgtggggcttctcaggcttaggtttgagagatgctgattctagggacggacattacataaggatgtgaagttatgttttcacccaagtaagggctgtgaggtattgtgaaagccaccagactcccaagatgtctgcattgccataatgctcctctgctccactatgcatttgcacatggtctcctgccaacttttttcttaagaacccactcccaaatcctctctgcattatgttccttagagcactgctttgcataagagtctatttcttggaaaagctcaacggaggaaaaatagaacaaaaggggctctgataacttaagcataagctatctgagtgtaactggcagggtgggggaagatgaaggagcaggcctggtgggaggggcacaggccatttggatgaagcccacattcacagacttctcagtgatgggtgaaaaatctcttatgaagatggcccaaggcctgacagatctgggaagagcttaagaatgagggtaataggccaactgcttctccaactttgccactcatgtccatctgtcttagtacaaactcccacaggctgcctgatctggggcagtgtggacaccttgttttctgccttttccagaagaggctggagggactacctaccagtccccttcacacctgattgcagctcgatgatacactgcagtagaggggctgcaggataaatgctttgaaatgtaatagtcttcatgggctttataaagtaggaaagttttccacttgcttccttagctcctgttgggtttccactttgcaggtcattgctttcagaaaaacatgtggagcatttggtaaccccatcttaacttgggagggtgtgtgtggggctgcactttccaactactgtgagatgggctggctgcattgtggtgaaatttagtacctcaacaaagtcccataggggagtagagggctgttgacaagaggtcagagcctaggaatatctaagctctgaggcatggtgcatggggtgctgggctgccaagcactcgtgctcagtgaccagtagatggtgctctgacaacaggaaaatacagttactgtccctctgagactggaaagggattttcagatggtcttcagactggtttccaatcagagttatgactaattgctrattttccacatttccatttgtggatccttaataggacagtggaactcggggcactggaaggagaatgcccaccaaattcccatatgaagaaattcccatatgaagtmatgcaataccgcatgactacagtattctggtcatgaactttttctgaggatcctcctggatattgagggcatggtgccaggaacacttggcctctgatcaaattcaatttgaggatggtaagcatagcatttccataggcttagtgtcaytgtatagtttcttctcttgataaacaatttagaattaccctattgctgtcctgaagggcagcatgggttttagaaagagccgcagattggaagtcagatgtgttagaagtccacactctgccgcttatcagatgtgggcaaacggcttaacgttgctgaaactctgctgctttgtctgtcaagggtcgtgatacatgtgttaccaggctcacctcagaagtttggagtcaggctcagctgtggggcttatgtaaactgaaaactattaaacacatgtattattcaaccattaaaattgtagccactggcggggcgcaatggctcatgctagcactttgggaggctgaggcaggtggattgcttgagcctaggagttgccagctaggacaacatagtgagaccgtcgtctctataaaaaaaaataaaaacaacaactgtagctgccttgggggctggtagaatgggggattagagagtatgaaaccagtatagaaattcatagatctcaaagctctcaagagctatgacagccaggtgggggtggaagatgagagtctgtcttcctgctagcactgctgcccttaggccaagtctcttcacaaagccatttatgccattatgtttgcccctttcctttttggctgcacyctccaagaattatcccttttaactcacataggtgctgaaactccctaaggtattccacattaattcccaacctatgcatttatgattcctgtctccttggaaggcaagaaggcagatatcaactccagtgtgtcgtcgcatttgcacatgtagtatcccatcttgagtattctaggtctctgaagaattacaacagccaaagagaatacaggacgtggaatactggatctctgctgacatctgataacactgaagagacaagtcggggatctctgatgttccaagaactaagtctgggaagtaaaaggctagtgagccctgcttattctgggcattgagaaggtatgccgccagcctgctgaggcagaaccacaaaggaaaggggtgaggtgacagcatgagagtgaagttcatgaagctttctggcctgcaaggttatacartctagtataatctagtgtaaaaagctacatgatttatgtcatcacccatcttgttcattatagtatcctcagtgcctaaaacagtgcctggcacctggargggactcaaagatacttctctaatgatttgaatgaattttgtgctatggattatggtactgtctgaaaggagcgacatacacttaataatttctgaaagccctttttctaaccctatgtagtttacagggataccgagatagccacttgggactagttctaagtgactggctgatgggacttcatggttcacagcaccaccctccctccgtttcacgactgactaggtattcagacagaagaggaccctctgattaaagcaggaggaaggacagagtaaggcagtaatgtgaaatcaaagtaacaattacagctgactcaccttgaatagtaatttcacctgaaatgggctcccctgaatccaaaggtcaaatgccttccccaagggcagcaggctggacatgttgagaccattcctttggatttccagtagagaattttcctacacacacacacacacacacacacacacacacacactctcacatacattctcacacaacagacacatgtcagtgctcacagggccttgcccacagacagacacatacccgtagaaacacacatgccatgcactcagacatcacctcacttctcaacagttaatctcacttcacaggcgtgaagccatactcacccatggtttccaacctctgggctttggtcagtgtctgtttccttcctcagcccctcctttccttcttcccttccattgttcgggttggaaggatttggagaggcctatgtgttgagccaaggcaggaaaacacagaagacggtgtgccccagctagtgtggacatgggaggggacagctggtccctgccctcagttcaaaccaccagtcacctgtggggaagggcttggcggctaaacaggagctctttccctggggcttggagtccacctttcccacctctgcagctcagataccaattctatttttttttttttctacattaatgggttgggtttgagaaagtccgtggagcttatttgggagtaaaggatggggggcgggaggatccttctgattgttcgcatttcgagaagggtagttttagcccataactcaccatggagggcccttccaggagacgtcgggcagggctttcctacagcggaaccgggaggccgccccgtgagggcagaagctcycgccaggagccagcaccaccagcagagtgtggaacccccagaggtcctagcctcctccacrgggcctcccaggtgctaagtggggagatggggagagggttctgccctctacttggaaatgcctggccgtgttcgtggagcctgggaggtgcggaggagcggcgacgcggccatggcgctaggcgcgcaaaggccccgacacctyactagggcggcggcgggcccgtggcaccgctcccggcaccgaacagggcacagcactggggacacctctctgcagggacccaagacgcgcgtgcgtgtgcgccccacgccaggccctcgctctcttgcggagactccgccgcatcgctggctgcacctgcctctctcttctcggcattacttgggggaaaggggactcttcactggacctttgcagaggtggctgctaccctttggccacataaatcaagaaggcaagccagcctcaccttccaggaacctccagccttccggctgcgtccccgcccctcccgcctggccagctcctcccccgcttctcccagcgctcttgcgcgcctcgctgcgcctctgcgcgccgctcgctgtcctctgcctcgcctccccattctccttccgcatcttctccagtgctccgccgagggcgctgcctgcggggaagagggagactgagccgttagtgaggaagttcggtctgtggacaagtgtggtgccaggccgccgcgaggctcggctgcaacctgttcctcgcccgccggtgctcgccgcccgcccgctcgcactcccgccctctcggcggcgcagccgcggatcgctgttgcatgctgatccggggaggcggcggtggcgagcgctccgggcggatgctggcactcaggcttcgctgctctctggatgctgctcaacttctagcccaagcgcaggagctttgaagtcatttgtcccttttcgcttggatcgacttcttattttgagattttgggcattgcggtttacgcaggaacctcaatatcgctctccccacctccctccctctttctccaacctytggatgcgtctctgctggcagatataaagacccaagtcttcgcggtggaattycttagatggacttgcaggggctggcgttataaagcatgtcatcgtaaccccgtcctcgtctttrtttatttttttttaaagttcttttgttttcattttcccctccttcccaccccttcccccaaccaataaatcaccaaactgttacctagcgggccggtgcctgcctctctccctgaactaggtggtgcgtctgccagaagaggagctatgtttgaagagcagcctactccacccctctcctctctggtccctgaacaccaccacacactggcattttgaaaaaaatattttcctccagaaactgggcacccccaagccctaccacccgctttttttttcttttttcttttttttttttttccttcttgaggaatggagcttcgcagaggttgcatttagattcaacagttcacagcggcgggctgctgctgctgcctctccgaagagctcgcggagctccccagaggcggtggtccccgtgcttgtctggatgcggctctgagtctccgtgtgtctttctgcttgttgctgtgtgcgggtgttcggccgcgatcacctttgtgtgtcttctgtctgtttaaacctcaggatggctcgcttcggggaggcggtggtcgccaggccagggtccggcgatggagactcggaccagagcaggaaccggcaaggaacccccgtgccggcctcggggcaggcggccgcctacaagcagacgaaagcacagagggcgcggactatggctttgtacaaccccattcccgtccggcagaactgtttcaccgtcaacagatccctgttcatcttcggagaagataacattgtcaggaaatatgccaagaagctcatcgattggccatatcctttcttgcccaccataactccctctccccctttgcatttcttcgggtgaaggggggtacctagcatggaatgtatcccccaccccttcctggtgccaatttgcccctttgctgaagcacmctcttcggtgcatctaaggggcaagcttggtgccgtggagacccgtttgggcactagtgtttttcaaggtaagacttttggttttttatttttcctatgtggaaatctttagtgtccctgggtgcatccctttctgggctgggctttgtctgattcccagccccctccccacccctactcccttcacatgccgccctctacatagattgggttgccccaatgcttcctttcataatyaattctcattttcctttctttaagccagccactctgcccgtatccccaccarccaggagacaccgcactgtcttcctgtagggaagtcaaggctccatgaggggatttatcagttcagaagttcccagggccaaaaccctgtgtacagatagacaaatgaataaataaaacaggcttttgggtggggactcagctaactctagggacttaagtttaagttccactgaaagtggcatgagtgagtgtctgtcaggggaggtgatctctgttgccacagcccaaggagctcaaacttggagttctcctctcagccaagaaagagcagctcatcaggcccatcctgtccttggtccttggttgggtactcttgcttcttagtgcttgacccagctgattgctctcccagtatccaggatccaggtggatcggctgggcctgaattcatccgctgaggccagaggtgtgcatgcagtctctctctccctagctccaaaggaactgctctccccaaagcactggtgggggccatctctgatggtggtggtgtcagggtgaacaggcatggaaggagcttctttgcaggtttaatcaagtgcaccaaatgcagactgctgattaggcagctcactgccttgttcttcactaaggattggacgcctggcaaggccattgggaattgggggtggtgaggcagtgaaggggattagtaggaggcaagctagtggtctggcgttaaatatggggatggggttggagacatgggactttgggagggagatttgggagggatgcatctgcaatggaggccccttcttttctcccctattctccctctttcccacccccaccgtccaggtgtgcagcagtgaggcagctggagctgccttgggtctctagtattagccagacacgcggctcatttcccccagggcctgggcatctccctactcccccaaccccagtctctggccttccccttcttctctagttccctgcctcagcagctcggtgattggctggcgcgtggtgcttctaggcagcaccccctcattagaaacgaaggagcatctctaagcagatattcttcctgctgctgttcgcatcctcccacagcaaccccggctgggcttctccctckctcctctctgcatcccgctcccctgctccactctcacagagtgatcccaggccatccattgcctgagttgaacgtatctagctagggtggaggtttcgggcgggggaggggtcgggtccctgcagtcacgcctgccggtgcgctgcacaaagcggacagatctcattgtgttgtgtgctgcggctgcaaatattcctctaggcagtctacggatttcccagctgggccctcctttctcactcggcttctacggttctctaaatcttcccatccaccaggtgctgccttgctgtgcccctctcttaggggcgtgtttattcagacaggcgccctcccgtttctttgcggtagacaaagccgcccaaccgccccgcgggtggcaaagtgtgccagcagccatcgttggcacctcggacagcgccgctgaaactcccggcggcccggggctccccagttacccgggttcagcacctcgggtacttctggccgggcccagccttggagctgagaaaccaggcacgtttcctacaccacgtggtcaccttttttcacgttttctcttccgctgcaaagacaccgcctttccaccaggcgttgcgagcgcgcaaggtgcggctgtgagtcttactcctccctttccttgtctttggccaaaaatggaccaaagagagtcaaacgggagactctcgagggagttgatttcagcatcatgctcagtgccttggccccgagccctgtcccaatggtctcttttgtctgcatagttggaaatttcacagtggttctacagcatgtaggctgtggtaacagtgttcagggaacatctgctaaggtgtttagtggagccctgttggaaaatataaaatacaccatgtacaatgtaattgactaatatattccctctggtggtgaccacgtggaaacattgggcttccgtgggaaacgcacctaaattcctagtctcaccttcctttcctttctaaacaaataacttcccaagtatcttgctttgtcttattgggagtcagtctgggtagtggttgcccataaagctttggagctaggctgcctgggttgaaatcctagttccttcaccagctttctgaccttgaaaattacttcattactctgtgactcagtcttcttacctgttaaatgaggataataataataatactgggagaattaaatgacttaatatatatcacatgcctaaaacattatctaattacccagtaatcactagttgttattattaatggcatctttcagaaatttcagcgtgcctgaagtggggaggggtcttagttcaggtgaagtcctctagattcttgcctctcaaagagagcaaggagctgcatccacatcacctgggagcttgctaaaaattcagaatcctgggccccacttcaatcctgctgaatcagaatctgcattgtaatgagatccctgtgtgattaatatgctcattaaagtttaggaagtacttctttgctctttgtaagtgccagatttttttttttttttttaagaaaggaaggttgttcagttgttcagaaaacatgtcaagacctgctttcatattgacatttgcacatttagcatgcttgaggattttgtttgtgttacaacacgttttgagacttacactttcattggctgcagaaagtcactgtaggacgagggggataatgtacacttctatgtgccgcattagtggtctcatcatgctgtgcattactggtctttaatcatgtttgtctgaaaagattggttaagtaaaaggaatggtttaatttatgcttctaggatcaccccgacttggagggggagggtaatcttatccagttattaataggggaggtctagttcttatgggaagaaatgctcaagataacccagatttggcatgaaagatggtggcaagtcaacagcctactctgaatgtgtttcatttttcttggaagctacatctgcatagggagataattttattttcttatggcactttcctctgcartggataccatactctttttaaaaatgctaatgygatttaaaatgtgatgttacattctatacgattcctcgttttcattttcttttttgctcatctaatagatcttctctggcagttggctgttctgagtgccctcccatgttcaccgtgcctcatgcttaccagctctcactgtttcatgcccagggccagttaccctgtgggccatacagcatctctcatgtggtttgcaggatgccccacacttgtttgaacttttccaggtcacgggtgtgaaggcaagaagtagtgtgtctggcttggagactctatgccagagttgggcaataggatattccccccacacctccatcgccttggttgtctcagcaggggagmacatgcttcgtgtggaaatgaatatggcttacagtaggaaggtcaaatatgtttgcagccctgagataatgaagctcatcacaatgaacctgtggacattaatccatgatttcttattgtagagaatttcactgtatccccaaagcactctggctatggatcagaggttgtatgctttactactgtgaatctcccattgtaaaatgtccgtttattttggaggattttggtgagggttaccaaaagttttagttcttaaatctcccattttggtgtcttcttttcttctgcttttgttgcctataaatgtatagcacattgcaggatagtagactgaggtcccggtaagaatttcaggtttgatgtaactagtgaatcatgagtcaagatgccttgattagggaagatgatggcagctaacaaggatgaagtctgtaattatatcctatgatcagataatgcagaggggttcatatcttctgtgtacctgtgcgtggatgcagatggtgaaacagatagtgactgcagctggtactggagctgtaggagaaagttcttcattttctgagcatcccaggacaatctctgaattgcctgttggctttgcttttgatatgaagtgtgggtaatgtttcatgtggaaaccaggccatgacttgttgtggggaccatttataattgggatgaagcctgraaaatgagttggagtgaaggaatttgacagaaatgaaatgacttgaggatagagacaaaaatatcctcaatgtgatagttttgtctgttggtttgcatgtcattatttctccacttccctccacttgctttttctgcaataggcgcagtgcatgctatgaattaaaggaggaagaggaaagtaatgagaacaggcctgctttttttttcttctgaaacatccagactctgaaattattagctccatccaaaattacttatctctttatagcactgctgtacaaaatgtaggtgtttttccccctcaaattctgctgctttcccccttctttataggaacatctggtttctttcaatcttcatattcttagtgaaaataaaactgagtgaagctttgctaagctctcagaactcttgcaaacccttgactccatgtgtttgatgagcaggtcagccacctcccttacgtcatgcacagggctgcctggaaagctacagctcaccaaacaccaaagcccagatgtgcaatccagtccatcaatggtgactctgctgatcttattttgcttatcactgaccacaaagacataaaagaggaaacctaaatgcaactctaattaatatccatttattcagagagagagagagaccaggtctttactttctctttctgcccgtcttttcatctttctatatttctccctctctcatttttaggttcagcctttgtgaataattcattatatgtgtgggtttttcctaggattttcagaaaaggaaggttatttgtcttcctcttgggtaggattattaaggtctctcacagaggaccaacttcaggaatctactttttctctaagacctttgttttctgcagtgggactgtcacacaacagaaaggaagctggggagaaatcttgtaacctgctttttcttgtcatttttatgatgactgcctcctacccagccctgttacatttgagtgcccccaaaatatgcaactactagccttttctactcagagactgtggttaagtggaaggtacgtgtcactctgaatcctctcatcatcttgggttttcacactgataaatgctgaacgactaggctaaggaacagtcctctgtaaccatttcttttcaaattccagtgtgaatttttacaggaattacagggagcaggggtagttatggggaccaggcatggaaattagtgtctaacactccgccaccactaccaccaccacgatgtggcttctaaagcagtcccttccacagagggatagaaacatgaggggcttggatcaatgttacttttcccaagccttctaaacatgcacagagaggatgcacgtgtgggttcacccatcagtcatgtttccagcatcaatcttaattaaggacagaaggtatagcacaaagtttttagactcccccaacctcgtggtttcttagtgttaaggttattgcagagagatgtttatggtgtatctttgctcactgagcaccccaaatatgtttccttataaagcttgacgagccccagtgtcctcatctctggaaagcagggagcagctagaagatgtgttcttataaggtgaagatgggccagattaaggggaacagcaatgaatgactttaaaatgtgtcrgttatccaagagatcctccctgccacctcccagagcagtgggtacttcttaggagcttcctttattgtatcttgagctccaaatttgtaggactagatagttccacccttaatcctcttacttattaaaaaaaaaaaaaggagcctcaaatagacccatttgtaaagcagtagttaatcccagaagcaggtgggtggggcttgggaatgctatgcccagctaggctccagccacgctccagccacgtgaggcttcagagagaggccctgcctggcacctgtgccaagcatgttttttttttttttttttttgcctgtgggtggttgatttgaatcactgttgcaactctgcataatcttgaggctatatttttgtgtgtgtgctgcattttgtcttttgctgcatttttgctgcatttgggctgcatcggttctcttcatctctggagaatttggaaagcctccttcagatatatgcctgagctttccaaagacttgtgtcattaaaggggggtgtcatctttcttccctttgggggagggattaaaaaggatgtagctggatggtaggtagcaggctagaggggaaaggaagaagtgctctggtgtagatcatgggtggagccttgatgatactcagtctattatggcatcattgctgagatgcaggacatcgtgcgtggccttctggatccagagcggaggctctgaaaaccagcactaggaggaaaattaatactctcgagcctttctcagccttcagctttgctgtaggttggaagtttttcaaactttctgtgcctctttctcaatttccacaccattgtctcatgggactggtcagagccaaaaagcatgaaatggattttcaacagtcactcactaacgtcctggcaatttccagctgtgttctcctgggaactgttttgctgcttttctatcagcgaccattcctttcagcagatgatttccatcaacatcaaggctaattcctcatttagttcctttgtgttgatgtcagacataggcggtctgcccgtttcatctacactactggctgtcaacctgtgtctcagaatcacctggagggcttgttaaaatacagattactaccccccactcccagagtttctggttcagtaggtctgaagtagggctggagaatttttgttggtyacaatttcccaggtgatattcatgctgctggtcttggacatcatgctttgagaaccattgctgtacatggttttgttatctgcctggcaatgcctttctagaaggccagtcttacaaattgctgatgcatttcctcatcccaaatctctctcatttaccagctaaagccctgctgctaacaaaagcttatgctttgggtttggatagtgaggaggctttgagacttctctaacaaaatgctgatgaccttgagaccagggacatattaagcaaaatatatgtcattatcaactttgagttagtttatcttgttctttcaggacttatcactgagagcaggctcttctgagaagggacatgcacccatttaattccagcacctagcacatgctggcacatggtgagcattcagtaaacttttgttggatgatttatacccaaattggctactattgagttaacaagcatcaacaaagtgcctcatattgccctgaccaggacctgtaagaccaggtgtagccccagggaggggacaggaggttgccaggaggtggtgtgagggcagtggatggctgggaggggagtgaaggatcatcacatgggaattgggaggctgtaaaagacaagatttagctacttcataattttcctcaggattctttcagtttctgtattacttgatgcaggctttctcacggaaaacaaaacaaaacaaaacaaaacaaaaaccagggtatttgttatctggcattttgttacatggaactctttattaattggcatatagtataatgacaattgagatttgtaatggtgaccccctaggtaccacagaatgttggagtgctttctgaagagcattcattgtattatattcaacacagttccaatggtgtgtgcacttcattgtattttgagctttgtgtgatttataattcatattgattatataagtagctcattaccactttttttgttcaattaaccaaagtgttcttctccagctgtaccagatgacagaggaattggtatgttgttctagaaatcagaccttttagttctagaaatattataggagctggaggtgaatcctggtgcaattgtcatgtatcaggtgatatttagaacaaagtcattatttcaaaaatggactaatagctcagcaggctttagatttactgggcaagttccccagctggtaagctggtatcacatctaactgggtgtgtttgtttctgtaggctaacactgaaaatgaaccaccaagatttccaagagagctttcaataagcatctcagcaagaggttgtcagatgataccttccccaacctgactctgagttatccaacttttatgccttgggcttattttcctgctcttttttactcccacttccctccttcctgaaggtcaggagatgttgagctctaaaatgattctgttgtagggtgatggtctttaggttcttcagggtcagtttgaaactctatggaacttcagagtatgacctgaataaatgtctgagtagtgacctgagtaagtgtctagatgacctcagtaagtgtctagatggcatctagatgactctttttggagtgttgggaccattaagtccctctagtacagtgtttgttcatttgctttctatactgggatcacaaatcctactgacatctggttgatgctatagacctgtctctcctgaaaaatacacatacaattttgcattcaattttagaggtctatgaatcacaatttaaaaacatctatcatgttaaaaaattcccacaatttgggatgttgggatgctgggctatcaggagtagtgattctcaaccaaatatcaaagcctttatgagcaagtacgacaggaactttatatgaaggaactagagagatacggttgcactgggctgtcagccaggctgctatgaaagaacacaaacattctaaccaaagggcatgaattcaatacagaaactctttctacatcactgtgaaagacgactgtcaagctggaatacctccagtgacagggtgctcttctgttgttaaaaaacttaagatataggaagtggaaatattcctccttatagcttccatttgttctttcccttcctgttttctgttttgtaaaacaatatagactcagtctacttcctttcacttgacaatactatggcattgaacagcacagttggtggatttttggtgatgatagacatggctcttggcacatgtggcccttaaggacttgatatgtggctaatgcgactgagaactaaattttaaattttactgacttaattttagttaagtttaaatagccacatatggctagtggctactgtacaggatggcacargcagagggaatacatgatgagtcagaaagcttaagctcccctttggttctgtcatttgttagccttgtaactgggcagggtctccttggcttggtatgcagggcttctcatgagccactctgcacattgcgccagctttccttgaccactgtaatcactgtctctccagctgcttcagtggctgctgatscctgaaggcaccatcctcttccaggcctccgtgcctttgcacttgctgcttttccacctagaatgagtctggctttaagattgtactcagaggtcacttcctctgtgaagccttccttgatttctcttggccgaataagaccagcttcctcctttgggctctcatagggcactttatttattactttgttgtatcacataccacataattttagtattggtttaaaatccctgcaagggaggggggacgttatctaattaccagataataaggcaatgcttattaacatcagcatttaacacattagtttgaattaaaatactttttaaagtggtgtttttttttttttttaaagaagtggcattccgtttctgacttgagatagtcagctaaaatctctgaatctttttttttatatgaattgatgacagagttagttttctctcactctgttctcattcagtttaatttttgaatctagattcaggactctatgtttatatcaagtatattttatctccttgcttttgctccaatgtttatcctgcagagatccttttcaactgagaacaaagaactaacattcattgagcatctaccaaatttcaggctctacttcaaacaagtgtattatccacattttaaatatggggaagctgaagctaaagaagattaaatcacttgcccaaggtcaccacmggtgagcttgaacaagtggtccgaatccaaagtttaagtgatttctacaccgcactgtctatggactttgctgtttcatgagtgagctccccaccctaagtgctatgtcatctgcagatttataagcaaatacttaatgctttcatttgagtaattgataaaaaatatatttagaatcagggaccctctttctgcttatcatcagtgtattagtcagtgtgcgttgaccgttcagcttttctcaagtattctgaactgtgctttagcctactgacatttctgtattttgtctgtaaaaatattgtacgcgatattcttgtcacatgctttactgaaatcagtacacactttcatgactacttcatgtctattttaagcaggaggtagcatcttggtttctccaaagtccactttaggtatcattttcagagactcagacaatattttatttctttcttagacaataaaagtgttgtgtcctagatctcaggagttgaagggatattagatgtcatctagtccaatgcccagttgatgaaagcttcaccttagagttcaggatttaccagtctctgcatggaagctttagggtattagggggtcgttgttaaaaatgacctctggattcaaatctcagtatcacctctgtcactttatagctgtgtgcctcaggcaacctgcttacccttgcagtgccttggatttttcaaatgtaaaacagagatagtaatttgcttctggggtgtatcataggatttttgtgaaggtcagatgagataatacatgcaaagtgcttggaacaatgtttggcaaatagtaagctgtgaataaatcttggttattagtatatggttaatttcagatacataaacattaaacttctgcagctatgttttctctttccaacaatgctgtcctacttcctcctggctcttaccaagtttctaacctgagtgctgccagataatgtttacgtgaccttgcattggtttcatcacctccctgagcctcagtgtcttcagatgtgaggtggaggtcactttccctgctttgcctgccttataagactgttgtgaggttagcattggctaatgtgtatgaaagccctttgcaaacatattaggtattagtattagtgttaatgttgatagaatttataaatatataacacttattgaacatttactatgtgtcagaatactgtgctaagtgctgcccatgagttattgcattgattcttcatgacaatcctacagagataggcattcttgttttctgtctttcatagttagaaggattaaggtgtggagaggttaactcatttccctgagatcgcacagtaagagctggaggcctgratcagaactcgtgctcttaatcactgaagctaaatagtctttccataagactttttttcttccttctcaaagttattgggtttacacttttaaaaataaaatttaaaatatctacatcaaaacctgtttcctttatatgtttctaatgctgattttataccagtattgtacctaaggacayatttggatttacaatcagaaaaaatatcttcaggagcaataatgatgcagaattttcccagaaagcttttgataaaaacagataggatacttaaaatgatctataaccttaacagactcacttgattttgtctttgaacaaaaatggtagcaaaaaatttcagatggcttgatggatggcatgtagaaggatcccctttagatccttggcatctgggcagattttcttcctgggggttgccagcctcctggctaactacttcctatctgcttaggcttcttgggtatttagggcctctatgtttgttctatcagataagagagaaaagattggaattcattaactgtggaggaagcttctgaaagggttagggtgctgtggggggaaggggaaacctccattgcttgggactcttggaaatttgcctaatgagcttggtgaaggtcctctgctagggatattaggggcattttacctgtgggaaatgtttactggtgtggacgagaatggagaattaggatgcaccacttggcttcyggaaaccagacagagcactcaaaagaaattaaggagtgggcctaaaaagttaaaggaactgcctctcctttctgctaactttggattgtttttgcatggaaatttgtatttgtgaaataactgagccatatggatgcacaaggatgcatgtgttcttctagtctgttgatatgaggagcagttgaagggtgtgggcttgtctggaggtggggtgagtaggtggatgtggtaacatgaggagggagcaggtctgaggaatatgggcctatgtcaatccgaggatctgggcattttggcaagagcaccctcccttctcatagagaggtatttatttatttttgagatcaccatctgccccaccacctccccccacctgaagttctatggataaggatgttacatctctgggtaacctctttccctggcgatgattaaagagtaacaaatgcccactcagaaagactgtacaggctgagaaagactgagctcatttctgtcacaaacatcagtagacaggctcaggagagcaaagcaaaggaatagattctaggaaattagaacttctaacagctttctatacttccactgtgaaaaaggctgggtgcagaacaacctgcataatcatatgccttaccatttctctttttatcttaccttcrtgtctttttatcatataattttaccaccattctataaggacctccctccaggcctggagagctttctgttcctcaatatgcatccctgagaatggatggaggaaactaacctttaatgaatgcctattgtatgacaggcactctacagtgtgctctagaggagtgtatcatttaatccaaccccgggtgaagtggatattgttctcattttatagatgattagcttaaggtcacagatagatgtggtctgactggtgccactggctgctctctttccattgtttcatgctgccttgggttagaccagaagaccagcaggtactcttccctaacagagtatctttttaggatgacactgtgaactacttgcatgcatctgcagcatcactgggtatgaggctaactcatgaaggagtgaaggatcagtagatggaagaagagcaactatctctttcccatcattatggtcatcatgaaatggacctgagacatcctggcctgggtcactggaatgcgagcttgagtcggaatctgagatctttgctattttgtctttcccccgccaaaactccactgctgcagttcctttatctgtctgcagagcgcgtttggtttggaaatgccagttcccctttcaatattagcatggaaagtccattttcttttttccggttctcagagaagtctaccctcagtcctttctgttctggggtacccatagtgtgagtcatagtgtggaggtggcagctttcatgaccttctcttgaaattttacatactgaatgcagctttttaaggaaatgagggttgggttatagagagactgcagaaagactcttatatcctgataaagactatagaagaggcttatagtaggtttgtggaaaagggcagcttttccacaatggttcacttccaggccaccattgtgaagattctagcttttctttaactctgttagagaagctgctagcgaatccaactggtcatggagctcctatgcttgacaatttagaagtatttccatggactctagaccctttcaagatgtccctgggtgtgccaggatttccatttttgaatgctattgtgggatctcctcattagtaatttcaccaaaaatggcttctctcagttgtaatcatgtatgctctttctttctcctccatttcccttcccatcatgttcctcattagcataacagaatactagaatattagatttatagagaataaaaagaaacttgaatcaaactcacacttatccataagaaaactgaaggccatagaggttaaatgatttgcctcaataagtggcagagcagagcctagaacccagggccgcgaccaagtgccagcatccttttgtcacattttctcttctttcctctgtaccctttctgtgctcaaccatcttctctctagtcccttctttctcttctggggcttcctcatccttagcaagtatatgtttttggtgtttggggcataggaggctggatataaggatcatgactaataagaaaggacttacrtaagaaaaaataggaatggataagagaaagatattcatagaggtgaagccaaccagcagagatccagtgagaattggtaacagtgactcagaaaaatggttaatattcttctttcccaaatatgttgctggagaactttgtgaaatgataatataaaactcaataggcaatggacttctacccagtgtaaaaccaagagcagatctcagcagatgggagaatagatggatgcttaggcaagcactcatctcagaatggttgctgggctcttcagtagccctaagaaaggcaaactatccagactctgccctgagaggtagctctttgagaacaattgagtactcctgggaaggaggaagcagctcaaataaaaagatctttagatccctttcttttagaattctytattggagctaagagaccagggaattttatttgattattctgataatagttttcccaagcttttcagggtgtagggctgagagtacagagaggtttctagccctggttctagaaaaatctcattcctttcctggtctcagcatctacatctgtaaaatgagtgtgttggaatagttactaagactctaaggtgcctttcagttcccactgtagagactctgggattctagtttccatcattgttatttcagctgattggaggacacgattaactttcttggtctccagcattcgaagcctggctgcacattagaataagcctgggaacttctagaaatgctgatacctagactgcagccaagacaaattaaatccaaatttctggagataggacccctgtattcttaattttgaaaagctttccaggtgattctatggtccagccatggctgagatccactgatcttctagaccgaggggagccagttacctgacttccttctgtttcttttgagtgtactttgattacgtcttggctgctccctctcagttttcttgcaggctatggtgaaatagcaggagccgcctgggtgtcttgaaatttagcctgagagaatggggtgattaattcttatgtgtcactgcrttgacaaagccattcacctgtggctgcttccgacacacctccagctgcacaggtaacagccttctgtgatgagggggatggaccagacatcctgaatgcaggtctggctgaggaggccatttgaggctgaaggacagagtaaggctcacccaggaggcccttgagcaagtgactaagagttgttgaccttgcttcctacctggttggttcaccccttatgcatatgaaggttgatccagcatgactaccattgaatacagcagtcaccgccttaacatccttgacactcccctggggatgtggaactcacaataagtgctgtgctgaaactggcttgtcccagctcttgagtgtcctctctgtatgtctcttctagactccatgttcrgtgatatcaagatggtagcttgaaattggccatggagagagtatttataccccagaaatttgcaaatgctacacattggggcttttcccccgaagttaaacatctattagcacaacacttagttttctacttaacaaaatagtccattcacttgtggaacagtggaagttcttctctttattgctccagatctgtcttcggatgggtactctgcacattgggtcttagtctttgcctccataataacttagaaaacatctgagccccttattacaagctagcccttcagatatttgaaagcagctgtgatgtatttctcaagtcttccctttccaagctgagtatccctagttctttcaacattatctcacgtggtttgcaggctcagtaggtgtctttgaatgccagggcacagttgcagagttttcagaggaaaacaaacattctcccacaggtgatctatggactctttcacaaaaggcttttcatttttcttatgctgtctcagttccatgatgctggtgttgatatgaagtggggtgtagtcttgggtggggttgctgattgcacctcatagtcatcttccctgaaatgcacgttgctgccagaactcttgatgggctccaattcatcagagtgtcatcaaaacacaaattctcgtttctgaaacaggtaattttcccactgctgttttgttttcttccagaggcttttaatgctccccttttcttttttcccttttctgtagcgttcaatcatttgtctgctgttcaccaaaactgtgtgttgaatgacagcgttttgagtccaggatccagtcacacgcaaaacaaatgaatttgttaagacttatccagctgtctgtaactgcaaggggcatggcagtgggaggarggagggagacagtactgtcttattttctcagaaccagcacttcccatcctttgggaatcagggcccagatgagtctggaactgacctcagtgttggttcaccaaagtagcaatcatgtgcacttcctttcagccactttatccagagggcagggtcctgggagtcagatgggagttctttggtctaaagtaatgagaatttggacttgccttcacagccagcattaaatgggtaatgcttaggatcttttgctttgagtaactgagtccactgacctccatgagagagcagcaggattgtattggcaaacaaaaggccttttggggagttctctgcctctttgttatgttctcaatattgctttatttgtctttcattcattaggtttttaggagtaggtgtgatggcatttccatcttcttgacagcaggagtggggaagagagagagagagagggattaagaaggagagaggtgtgtgtctgttcaggactgcctgtcagatggtgaatttgaacagaggcagctgttgtcatggcgatggcaggttgcatcccaccaccatggaaaccaaagttaaaaaactgatgttaaggctggaagtcacatgatacatttttgttttgttttgttttaaaaaaagaaaaggggtttggttttttagtctttttttttaagatgaggttgggtggtgagaaaaattgcacaaggaaagcaatgagatgatgacatgggacagtatggagtaggcagagccttctttcatgtttttctgcttgttgacagtgcatgtctcctgccgtggttagagaggggatgggaggggtatgcagggtggacttccaggtttgcagccagagttgtacactgctaactgtcacatggagaaacacaggggtttagccctcttgccctttggaggtgatgtgtggttcaccttctgttgatcagcccagaacagacccaggaaacctaaaagtatggactacccaaataggaagatagtccatatattgataaatttggaaggttaacatttattttcagagaattgaaaagttcatctatagctcctcagaatctccaggaatagttctgtctgtttattcccttttctgggctggtctcttttgggctgccatgtcctgccagggcagccataggagtgagtgcaaagaagtccagaaggagccctgggccaagactccttgcaccatagcttatctcttaacctgggccctctcacctgggcagggtggagcggcttgctgagaggcattagaaagccctcttggctctccatctttttacctcatactgacttctactttatgccatgatctggagaaaatgtgaaacatccctccaggaagggagctggactggccagggctgtttttgcttgcttgttctttttttgttttgttttgttttttgagacagagtctcaccctgtcccccaggctggagtgcagtggtatgatctcggctcaccacaacctccatctcctgggttcaagctattctcctgcctcagcctcctaagtagctgggattacaggtgcccaccaccatgtctggctaatttttgtattaattgcagagacagtgtttcaccatgttggccaggctggtcttgaactcttgacctcaagtgattcactcgcctcggcctcccaaagtgctgggattgcaggcgtgagccactgtgcctggccaggccaggcctgtttgaacagggctggtttgaattttccttttgtgtagacaggttaggaagcagagatttctgtaagaatgtctgcttctaggaaggtgaggaagaccatgagggatgcagacacactgttgaagtgatggtcataactattgctatgtctgggttttaggcacaaggtcttatgtcttcggcattactcgtccctccaggacagatgtatctttctcagtcggctcagacgagggtcatatgatctcaccagcatgatctcactgcatttccatcagggtctgtgggaactggagccagacttctgtgatggttcaacccctcctgttcttagccctggcctggggtgtgattaatatcccttctaatcactgggagagattgcatcagagccatcagcttcataaatcctcctctggggactggtgtttggatgcgctttccatattctcaggaggttctgggccaaatgtctttgctcttttcctggaggcccattaccataattttcttttaaatcctttattggagttggtctcctctgtgtcagtccatggctacagccagccagcccactcctgagggctggaggctgtaaccaccaacagatgctttccccaaagtattgagccacagtagatgctgaaagattgagttagtaggatactgaaagtaactgtatttgtgcaacactttacagttttcagagggagttcagattccggtatcattttaggcttcagtccttttgtatttcttgtttggttctgtgggaatggatggtcataacccttcattgactcttgagtactgtgttgggacagcttttgcagtcggaggcctggctctggtttcctttaccaagctacattttytccattgcattccaggtcttgaagaagattctgaagttacacggaaggcttggatagctgtatttcattcctgttcatatgtaaaatgtctatttggtgtcatgctaatagggaatcacagactagttaaggctctttctctgttactgtctttgagtcaaagtccacttattaggatgatatttatgtgcacatgaagaagaggtggaaagacatgcatgaaggtgtccatgccatcctctgaggctgttacatctcttggatttagacatccaaaaacatgagactgaagggagaaaaggagayaggtcttcctgtagggtctggggtgaggggtggaaatgggtaaaggaggctgaggaatgcctcccctcagactgtggactcttctatacccccccaggagtttccaggaagtgcctgagtgcccaccgactgctccccacaaaagcatattctgcattaggctgaagttgggagagtgcacagcattctatctgcctgcctgtcagagcatggccttcttagtgttcggatgtcataggctctgggaggagacagctaagtacagaggtcttcaggatgagccccctggtggtgatagagatgcatgtttgcctggggacacccaatatttactgcctgaggcctaagtccttcccaagcatgtacctacagatctgtacctgagaggtgatgatgaggaggcttttcaggctcaggcagatgaagagctcagctccaggccaggcccccagggctccggtgacagcagaaccagcatcaccacccttgccccagctttctgtgcttcaagaaggaaatgaacaaatggcaggtgtgcaggccacgtcgtgctgctcaaattagccatgttgctaaggaaacaagtcaaccattcaaaggaaggagcattgrgtaaaggagataaatcaataagtgaacctatttttatcatttccctaatgattgtcttgaaactgctagactagaaagagagttggagcaacacaggtcctcattaatgggctcagagggaacgaggagtgaaggggtgtttgaggagattgccagtaaagtttatgaaatgaggcctctagtgagcagtgagctggtacaggagggaaggcaggaaggaagatgtcttttgcaagtttcaaagtggtttcatggtcatttcctcattttggccaggtcccttcattctcttgcatttaatcctctccgaagtctttttctgatttctctggccatygcrttcctcctcactctcaggttgggatgggtttttgtgttgatttgttcttttcaggatacatatagctttaattgattttgtagtgataaatgaacacatgctcatttgaacactcagaaaatggttagaggagtaaagaagaaagtgaaaataaccctgctaccgagagaagactcatcatccttccagyaagacagaattttttcttgttctctcccttctctttttttttgtttttgttttttttgagacggagtcttgctgtgttgcccaggctggaatgcagtcgcacgatctcagctcactgcaagctctgcctcccaggttcacgccattctcctgcctcagcctcctgagtagctgggactacaggtgcgtgccaccatgcctggctaacattttgtattttttttagtagagatggggtttcaccgtgttagccaggatgatcttgatctcctgacctcgtgatctgcccacctcggcttctgaaagtgctgggattacaggcgtgagccaccgcacctggccttctctttttttttttaaacatgaaagggatcttccatgtatgctggtttattttcttttttaaataggtcatgtgtgtctacagtggacagtataaaaagttcaaatgggtatacagtgtggagagtgtgggtaccttttgtaaggatacctctggctctagtttccctgtatgattcatttatcaattgaatattaatttattaataaaataacagttaccggggccccactgtgtgccaagtacagtggtgagtgaggcaggcaaggtcctgccctggggctcccagtccttactgccccatcatctccatttgttcaagatttcaaaacacaagcaatctggataccagggatagatattcttccctaaaatatgcacagtgtcaggcacagagtgtaatgagtgtcactgaattctagaacagagagtcagagtcctggacagacttccatcttgtccctgattgtggttgccatgaagggtgatggtctttgaggccgtggcgactcggagctccctttgacctttctaagtcatgtctttgtccagtctgccaggttgagggkcactagcttgactggtgggtgggtgttatttgccgtctaggctcttcactttggggatgtagcagagccattgctttggggtgtgaagttttgctgtcgggaagaaatgggagtggtgcctcggaggcagcctgcaagggtgggagtgagcaggagccatggctcaggccagagtgggtgagcaaagccctgtctttgtaatggctccttagtgaatgcctcatgttcattcttacctgcattgaacattgactaagctcctactatataccatgggctctgctaagcactgccagtagagacatgagcaaaactcctgctttcaagatatagtttcttgatttaaataggagaagaaataatacagtcacacaattcaaagagctgtggggcacggggagaaactttcactgacaaggtggcatttcagcttggtcttgatgtatgactggaaaggagaagaaacgccattgcatgtggtggcagaagcacctagatgtaaatgcctcttttttgtgctttcttcagaaagggaagtggaaaagagtttaaagaacagggctgtaagggagagtggctggggcctaggcagacttggatggtctcttctgctcacctcccctgagatttccctgccactatccattctttcacctagcccacagttacacagaatctccacattctcactgcaggttcttcattaccgcagccatgaattcatcctgaggtctagatgccctataaggctgaaagggacatccctctcaagggcatatatatctgaacaattttaaaaatgtaaagcaaaaaaaaaaatatttttaagccagaagattgctgctgtgaatgggcctcacatcagatagtgggaagaggatttggctggagaggaagtgagaatagggtcttcttagaacctgtgaattaccaaactcccacctttagattctagactttagggccttgggtagcaccagccatcaagacctcatgaattctcagccacccagatacctggccagtcactgggagtttgactcatcagcayctgggccaagagccattccgctgcctggagcatcttccggtggtgttggctacaccttcctgagctagcctgtgtccccacaaacctcacatatctgcccttggacattctggactagttgagcttaaaggtccttatagggagcaatatacttgggttaactggctaggaaaatgcaggtatgggtgtggaagcagggagctggggcagtggaggaactgccatggtccaaggggatattgtgagtggagagtcaggggcagtggaggagctgccatggtccaagtgggtattgtgagtggggaggcctcggaggcacatggctgccaggacctgtcttgcctgcaggctcagcactgagaacccatctactttgaagcctgtgcttatcactttcaggttttcaggggaagaagattcaaccccccaaaacaatcatagaccccacatagacccattagaatgcgagaggtctgcagcttgaacgagaaagtacttgtgcccagtcctaccttccagggcaggcactgggcttcttggatctgctgagcaggtgtctgaawttgcatgagacgtttccagctgtgaggagtgaccaggtgagccccacactgttgtgaacacttttgttaggaaccaggacaggggatgacatggaagaggccctggtttcactccagtcagatccatcatccctcctgccccagctcttggggactggcagacagacccccactttgtgtcaggctgcccaggtatgttcctgggaacaccgttcaaaagagatgctctgaaaaaaagagttacaaggtgaagcaagtttgggaaatgttgtgtgctgtcccaaacgccttgtgtgtgtgtgtgtgtgtgtgtgtgtgatggggtgtgtgcccactgtatgcaaaagtattaaaggccccaagaagtcctgctggggagaaacctgcttaactttgcccaacccaggctttctctcattggttgattgcaagttcctatagcaccagtatttcatggcctgcatcttaggaataccactctcaacgctctcaacttctgttgtcttttgtcagtgacttgtatgcgtgttgycagttctctttctggatccatcgcccaagcatgttttcaggaaagggtatggattccttggccaccattgctgctgggttcccatctttaatttgcaggatgagtctgggattccgggtgcctatgccaggcccagggcaacctaggctgttcagaaggcttatgggacactgggtccttgtgtggttcctggttgctctgcattttttcagaggtctgggttacagccatgatgggaggggaggagcactcctcctgcgatcagtgggcatgggtggcccttggcaggctgtatgttgggggccagtccttagaaggtggtcatgctagctgggtgggcgtctgtggtgtgtgtctgctggcatgtttggctctcaggggcttcacacccggagtgtttgaaggaagaggaatgcccatgggtgctgagggactttccatgtggggaggctcccctctgagtgggagggtttaagcaggcacagtggggtgtggaggcaatggacaggctctgaagtcccctgaggccaggtctgtttttagttccggtggctgaacctcagggcagcagaggcccgtggaatggtctctggggtctgtgtgctgtgtgagtgctagaggtgcgtgggaaggaacgatggtggtcagctgctggcgagtgagtgtgactctccagtgtgactcagagatgcatggtggtgggggaggagaaggcactgccaaatgaggattaagagaaggactaggggctcacacacagccagcatctcagccctgcagcccctgatgccagcaccaagaccagagcaactggtgagcagctcacatctcattgcacacactgccttgccctccccagagatgccctgggtgctaacttaacattgtgttattgccacaggtagcctggcaggatgggggcattgcagggatagctgtgatttgccctcctgaactccacgacagggttccaggccctgcaccctacacagcctgtctgggtatgtggggagataagaacagtccctttccttccctccactttgccagatctacggctcctctcttctgcctggattccagaatcttctggagcacaggttgctcagcaagaccagctgcagtagctaacttgtgtttgtcgtaacagtaatcacagaatgaaattccaacatgcagaatgacagcactgggagctggtgattccctctttctcttctgagagtccttcccacctccctcggagcatgtggcaaaaccttcctgcaggggtcatagtcctgtttttgaaaaggcacagggagcacctcacctgttttcaaaaacatctaacagaaaaaagcctgcattcattcattgtagtgtggttcttacaggactggactttgctgtccaggattccagactcgtgatcagtctctgtttcatatagatgcagacacttagaagaaaataaggtgggacaaagcaagcctctccttcccccagaagtacattgctgagtggaattttaaaatagaaggaagctcacatggagagaattgtttattttccagatgttcttctgttactcagtggtgcagagattctagaagagaggactccagttgtgagcccaggagagcaatggattgcagcagctggatctgtgcacaagcatcgttacccagttcagtggtttgaagactggggagaacaaggggtctgcgatggcattaattatgtttcttcctcctttcttcccccttctattttcagccttggttattggatttgttattgaattcactcagtagctggagtgtctgccatatgcccaactatattatgtattggctatatacgttccttttttggagaagatgctttgtgttcagagaccaggcacaaatgtttttggtttcacaaaaccaaaagtggatgctaaggaccatccactgtcttgcctgcctgcctrtttacaaataaaaatcatgcaaactgcacagacacaatgcgggttgatagagttgtgtgtttatgggcacggccatcttggaggctgtgtccctctctggtgaatttgttccttaactccgctttcccacgccatttgagtacatgatcctggccaccatcattgccaactgcatcgtcctggccctggagcagcatcttcctgaggatgacaagacccccatgtcccgaagactggtatgtgattcccctccttctcccctttgccccttttgtctttcttggtttcttctcctctgctttatcactctcccattcccttcctgcctgtgagttctgggaggagtttgctctttgctgggggacaagctaatgacagaccccatggggattcacacggaaaagaagagattacaaacactgtgtctgtgctgcgtggcagccagggaagaagraagggcaggcacaggcccattttcttccctcctctttcctaagggacttctgatacgagaggaagaggtggggagtagaggggagaggatgaaggatgctcagtgcttgtgtgtatttgtggttatgaacttcccaatgcttacgtccttattctccttaaagaaatgagtcacacatctaacgtattccccctaaaaagagcagacaaactgcctaaaattcacgtgtgtacttgagatgatgaccttcaagcttctaacttatgtgaagagcagcaaactccttcagggcaaagccagggccatcagggaccttcctgggaaggaagtctagcccctgggtgtgaccctcacattgtccatttctacagctggctcccctgggtctcccttgccctgtgcactcctgagtcacagacagcctgcaagggtcccttagcacccttgcttcccacctacacatgggcaggcccagcacagacatcyaggaagggccaggctgtgcttttgcctgtgtctcataaagcacagtcctcttctcactggtgcttctgctyctcatccccacaggagaagacagaaccttatttcattgggatcttttgctttgaagctgggatcaaaattgtggccctggggttcatcttccataagggctcttacctccgcaatggctggaatgtcatggacttcatcgtsgtcctcagtgggtaagtccattttctctctctgtctgtgtgtgtgtatgaagggggttggtatcatgaggtggctgggggcagggaacctggggtggaaagacagcaatctgtagagtaggggcagaagaaaaagttcaaggctaagattccccagggtgctggaccataggtcagccacctcaagaggaggatgagtactgtgtggagatgcgtgtggtgttaggcagaggccatgggactctcagccaggtctggaagctgccacttctggttttccattctgtgcttggctcagtggctaaacacccacttctctggggagggtgacatttcccaatgagccttttcaccaaagcaagcagcttacccccgcctgggaggcacctccaagacgggccaaaagatgtagtcaaatgcagcttcttttgggcgttggagaagacctcagccatattttctgaactgatcattgagacttgtgttctgacaacagaagtttttatcatttgcagatttgttaatagtataaaatcgaatcatattaaaatgttggataaatcattctgtggaaattaatatagccatacgacattggggctgacccagtgtcacagcagcatatatgatggcagtacatttagttaaatatttgataaatcattcttttggaartgaatatagtatgaggaagctgggttgacccagtgcccttggcagcaaatgtgttggccttgggaatggtgtgacgggcaggccttcctgggcttttgtggcttcctattggtctttgtgtcaggtggctcttggtacctgcaaagctgggcactgaggagtggtcctgtgtggatgtggcagcaagtgatgtggtctggaaattcccttacccaactgcttggcagacagggttcaaacccatgaagaaaagaagagagtgacttagaatggcagggaaggcgaaatattagctactactgtgattgaccaacaggaaaggagagaaaagaggaattgttttccagggaggagtcagaggaggggtgaaggtagataaagtcttagaaggaagggtaagggcttgggaatgattgcatctatttgttgtcatgtggaatagacaaaatactcttattttttaatctttacaccattgggattacatgaaagagaaaacactgaagatgtaatggactggaatatgtaaatggaagcacgtaagcagccagcccctcaatatgggaaatggataaatagactgggatgactattcatgtttaaaaatatctgttgccttacaaaaggattttctggaggttagttttctaaaagaaaattctactacattttaaatatgaattagtatatgaagatatagtttttacatagtattacagaastatattgggtaatgttgcaaatgtccctaaaataaataatatgtgctgtattagaagaggcctgtwtgagaatctgaatcatttagaaatgttatgattctatctagaagaaaagtgttgtataagtcactacagaagaacaacaaaaaaagaaaagtattgtratgtgtatataataagtttgtgtaaattcttggtcctgctcagctctatatgtggcagaatccatttgaaatttcttgtctagtccatttatttttgttttaaatgattatatgttcattaaagaaatatggaaaatacagaaaagtcaaaagaagaaaaaaaaattcactgattcagaaaaattcctgattgttttgtggtatttccttccaggccttcgatgctaagcaagctgtcttttaaatgcttgtaattttgctgctttcttcccaatatagtatgagcatattacatgttattgcatattttggtaaaaatctgtaatgactgatcagcagtttgttaagtagatgtacacatcttgcttctcatttttgcagttacttgacacttggattctttctgttttttggctctgataaataattattaaagatgctccaacgtacgtcttttggatatcacattttatgagacattttacaaggttgaagaagtacttctggaggagtatacggctgttctggtgtggggtctgggaactaatggctgagaggaggtrgagaaactggtctgtttgactgcatgagagaagacttccagtagatgttaatctctctgcaaataagggttgctacatggttgttgaagaagcagattcatagggacccatagggttcttttgtcagcgaagccaagaagggcccctgggtccttgcctgcatgtccagggggtgttcaagagtcagtgcaggtgctgagcttggctgagtcagttgtcctctctgtgctctctttcccatccctcacatcttcccttcttagtggcwcttcagatgtccctggctttgtgaattgccttcacaggcccctgatttccatatgaactcacaggactttgctcctgctcctcctccagacctgctgcttagccctcttctcagcatggaccgttccctttctcctcaattcatgggtgaatgtgctccaggcaaagagcttggtcctcttgagatccctgctgaggggctgagggttgcggttctatcccacaggaatgcatgatcatatttagtcttacagtcacatgatgctctcatctaccacattgtgtggctctaagatgcacgtttttcatgctggaacattgctgaaatcagcctgtgtcttacaataatggcatgatatagtttaattgacagcatgtttttctttcttagtgctacataaaattacggggcatcttacaattgttggggttgtagattcaatgacatgtgataccaaccagggaggcaggcaaagtggactttagagatgagtcatctggtactcaaagagggtaagttattcacccaagatcacacctgcctcttaatggcagatgcaggagtcagaattgtgccttttgatccagggctggtgttttgacccctgccctgtgcagcctccttaccaggccacctggtgtccccctttgtcttcctgacacctgcacccacagcagtccctgctgacagctcttccttcccacctcatctccaggtgtcacctcccattttcccctctgcacaggaggaatgacaggtrctggagcatgacacagtgcctcagggctgaggctgcacaacttctcagctctcggtgctgacaggagggaagtgggtgctgaggtgtcagtcagctggctcagtgtaagacctgctcttattgatctttgctgagagatgactagttgaggggcctgggctaccacattctgcctgtgacctctgacctcctaaactttagtgttctttggcctataagttgagggtgtgcatggtttagaaagcgcatttatgtacattgcttcatcttgtcctcawaatgccatagaaaasaccttgctagcctcattttacagatgaagaaaccgaggatcagagagggcacatgaattgctagcaggcactagatccaggacttgagaccacatctcctggctccaagttccttctttcactgacttttccccatactggcagttacttcacaaccccaagggccccatggttctaaggctctgtggttgcaggttcctttagtccccgtgaggcagtgtgggatgagctcagggaggtatgatcaggcaaatgttcactctcaaaggtggggcttcacatgtgagttgaaggggacaggggcccaatgtgtccatcctgagacttctctctgtgggcttgggatgagactccctgctctgtggtaaagaaggcatgtcactttaactgtcagcatagcatggtttgatgtgtagagagtggatcagagttccagctgatttcttccttaaatggcttgtttkttcactcattcactcaccaattcattaattcagtgaaactagtattgtgttggtgaaggcagaaggcaatgctgggaccgagaaatgtggacgttattatattttcccacctgctaaaagacagtggaatttgccattcttttaacacattcttatcttacagaacttgggatctctcttgcattgggaacaactcaggcaatttttaaacacttgtcaggccacctggagaattccaaattagttgaagtcactattacacattagtcaagagtgagttataaaaatatagtacctggagcagatggacagatgagatgggaggatgagagtcaagggtactcctaaatcatgggtaacaacagggaaatgaaggcgaggactgtgtcttagatgcccactcatctctatatgcccagtgcctggcatatagttggtactcagtaaatgctgattgaattgaattgcttgcctatccccagattctcttgtctataggatacaaaaatgagtgctgggggaaggctggggctggggtaaagagggattgtctgttcccagccttcccccttggcctggctgagccaggcagtgtctatgtctctctcatctctatctacctctgccaggctgctcatattctggtcattctattaggaaaatgaaagctgggagctcaatttctaggccattaagcaatattgggcttccagtcacctgtggttatttaccaggttgtcagtgttatctcctgagaattgcttcctgggtgataagggcagagtcagcactgcatattgaagacctaacctcattgaagtggctgtggatggggtgggggttggaggggtggataaggagaaagcaggggtatcacatcacctagcgtttaccatataataaaaatggtcatttattgaaccatgtgccaaagaccacacacacacacacacacacacacacacacacacacacaatttctaatcctaaaaatgtaccaggagttgagaatcattaggcttgactattacccagtcccattttacagatgaagaagccaaggcacagacaatttaacttgtccaaatccaaatggttggtataaggtaaagtcagaatttgaacccaggccagtttgcctttagcacctgggcaccttccctaggccaagtgatgtcactgcctcagactcagcgacagcaccagctgttcctgtgctgctggagcaatttagtctcctttccctatttcccttgtgtctctttgggttcaggccaaatggagaaaagtgtgttatccctttccatctaggaagtctttgttttccattgtatgttaaagtattggtgacattacagagctagtcttgagtgttggtaatattgtctattttcctaagaaaacccccaaatcagctcaaaatatgctctttcctgagttttgtcagccttgcgtgggaggtgacctgcgttggctcttccctttactgcggagcacatggtgtagactctggggaggggcaggtgtgtctgtgcctggctcttcctccttcctctgccaaggtcatcaccccagggcctaggaggcccctcaagagctattgctgaatacccactgtgtgccaggtactgtgtttggtgtgggtggaatggggcctagtgtcttccatggtggtgggggctggagccacgcaacatgagaacgtgaaagggtgtccagcctggccctggggcactggggaaagcttcttgaaagaagtcacatttaaacaagtggaaaggatggacagatggaacttagctgggcagggaaggagaagagcccttctgggagaaagaatgctatgtacaaatgccctgtgggggtggcacatggagagaggcacacagacagaccacaggacacttctggaagcctggcaggtggcatggggagagacctgcagaggtcagcaggggccagtctaggccattctgagtagtctgtactttaaccagagggcagtggggagccacggaaggctttgagcagggggttcactatttcactgtttcactctgagtctgctctggatgtggcacaactcttttttcttttttaccctggaatcaactctgaggaaagccatggaaaaaagttggagccatctccacatccttagctgcagtttgggagaatgtgcagagccaagcagaaagaggggaggcagaggaaaagggagcaggggagaggagagccagggagtgctgcagtaaagctgggagctgccgtcctcatccccagcttctcgccagtggcacatgcagaacgatttagcctgaagcctgttggtaggaggatgctatctagagctaaatatatattgataggtatttttagagggttttctgtaaagaggctgccctaatacaagagtttcctgagcagctaaagatcgaggaaagcagagttttcctcagcactgtctctctgaggctgagaatgtgggggaagagttgtgaatgcagtcctcaggcccccagcccaatttgaatccctgtggtaatagtatgatatcagtgggtatttatatagcatcaccaggccagtgagcctggcgggacctcagagacctgtcttttacttgtccttactgttctgggcaggtgaaggatgcagatggggagcaagggcagaatgggtagagggaggagacatgagaacttgttatttaggagatggggaaaccgaggctgagtggagcaaggcaagggactcagagatacttagctgagctgctagatgaacagatatttatttagtgccttaatgctaggcactaaacctggcatcagcattattaatgctgatgttggggaggtctgcaagcctgtaagccttaccacttttcagttcttcctctcagcatcgttgctggctgctcctctgacagatctccacctcctccctggctttttgtgcatttctagctccacactggggagcacagctgccacttgcagcatctccttttatcagaacattatttctgttccaattgcatttccccccagatgggcaaatgatggaaaagataaggttagaatataggatttcgattccagggagaggtgggcaaaagacaaaatgtgaagcttaaaggtctcttcttagctctgtgctgctgataaatccagttacttcagggagactcctagtgagagtgccagttagtagttgatgggcagctgagttgggattgtgccttgggtgggagggaattttttctcatgtatgcactctgtcttttttctatattgagatgcaccattggttcactcaacagatatatattgaatatacactgtgttccagatgtaagacattggtgttgggatggtttctgtttcctgaaaggcttcttcttgccacccccacccattgacagaagctccatatggacagaactgagtggggcctgaattggctttgatatcaccaaagaggaggaaaagccagagggagtgaagaaagcttcgaaatccctgggtggtttggtttgggactttatttgtctcctggcattgcattcactcagggtgatacagggaaagamattatggcaaggtgctttctaagtcagaccgttctcctgggcctggagctctcatttgaaggcagttaaackcgtgcattcttgtgcttgtgcatgagtgtatgtggaagagggaggtggggtgaaaatycccaggtatgttttcaaagcagaggtggatatggcataaatgcgaactctatagatttacaagaattgagaattaaaggaactgtttacatttccattctgtggttgaaatatgtctcctcctttgggtagagatttgtgcacttgtgtctatgttgtaaatgtagtccacagttaagtataaatgtgttggtgtgaaatgtgaaaatgcagcagcactatttaatgtatgtgtcactgaagtcaggaaatagcagatataatgagtgcagagtggttaccaaagggaaggggcaaggtggggcagagccgatgttgagaggaaaatgagggcatgctggtttaagaaagaacgtatgaagacaaggtaaggctaaggttactaaagctcaatcactgaattttagatctaggagaataataaatttgcctaactttcccttacttattatttttttcacagaagagaagactaaagtgcatgttgctaagtaacttgtccagggtcttttagatggggtgtggtgagctggggcttggatcctgtgtaattccaaatctaggactctgttgcagcgatgccttactacccctggcgatgagaatctgctgcttcttggttgtatttaggccatgaagctggaggtattaagaaataagattttctgttatttggctggaatatacatgtgcaacttacatggaaacagagtttaatctcatggactgaatgacctggcggctctgggttctggtcctgatcctgacatacattctctctgtcatactggtgatgatgtaacccatctcagcttggctttcctttatgaaacttcatttatgaagtgaaggtaaaacctgctgtagctacctccaccaggtttcatgacaagcaaakaggatagtgatgatgttgataatgacagctcccatttaaccaggagctcatgtcttattttaaatgcagaaggcttcatattctatattggcacttgcacatattattttaaatatagaaatgtaaggcaatagtgatattatctycattttacrgatgaggaaaccaaaacttaaagaggcaaagtcacttgctcaaggtcaaatagttactaaggggagagattggccctttaattctattatcaacaattctaaagcccttgctatatctagtgtacagcacagcctccactgccaaagtgttttgcaaaacaataaagcaaaataccaaatcagtgaacaataataccttccctccaggacagtgatattataaagataaatgttaaaatacacataaagcaccatgagtgccttgaaaaaaaccagcatataaaaattgaaagtactcaaaatactatggttctgtagacctcattaagaatggtcatttatctctataaaacttgcaaccacagaaacaaatttcactgaaacctattgcaaattttaaaactatggtaaatttaaaattttccattagttataattttgcctcaagagagaagtttactacatatcgcacataggatrtatcttatttcctatcagcagcatatctaattttatcaaaattagtcaaatcctgctacagtcattacccataagaacaacaaagaagttccaagagtaaaagttgaaacaaaggcctttattttaaatttttctaacaaggaaaatgttacattttctagatttccatttttttggtcttccctttctttgtcttctatcctccccacttctcayaaaacatacacaggccagaggggtcagcccctgtccgcccacatctggatgtgacccaggaaggctgacaatgccctctctcctccaggaagaatgtccaggcagagcccttgcacaaaggaggggctgaaaagaagcctgaggtctgacttcttccctcttgtctttcatttccttccttcttgactgccactcttctgtcagttgcctggaccttggtgacagaacatttaggaagggggatcagggccatggcttttctccctggcctccagcactggaacagtgactaggaggcagagtgacaagggtggctgcttcacatgtcagatgcattggaaacaatttacatcactgtgggggtccctgcatctcacctcctctccaccagccctctggggcccagctggccttggagagtccttacctagtccaggttggcatgactagccatgggagagctcaatctgaaatggaactgaaactgacctggtttggggtatctttgctgttgaatcttagtcaaaactctgggtgagggagagaaaaccagaaagaagcccactcagggctaagcatccctaatacccatatatgagctctgaactatggtgtgggggaaaatggacagagtcaggagaagacaggagggaaggaagtatagaggcagccggtattagttgagcacatcctgtgttcaaacattgtgctgactgctagggacgcagcactggatggagatatagcctctattcataccttgctgtccagcagagaagacagatatttactttaatttaatagtgtataacatgctgcataggagaagacttagggtgctaggataacttttcactgggaccctaacctaacttgagacctgaagactgagttatacttagctaggatgagacgagaagagggaaggggacaggatgaggagagttccaggcagagggtaggacagttgtgcagggctagaggtgggggaggccatggcaggtgtgagaaacaaaaagaaggctggaggggaccacagtgattgtaatctaagaggggttggaaagtaggcagggaccacatcattcacatcattcagggcctcgttggcatgtccaggcatgttcagtgggaggccattgaatggtttgaaacaggaaagtgaacagatttgcaggagaggcacgatgtttgcagagaagaagatagaacaagttgcccaaatgactccatgtctcctcagaattagggaaataggattaaagtcctcagtgtccctttcttccttcttgccccctccttccaacatcagccctcaactataattttgtttaacctattggagctgtaccaaaacccagtctacagaccttataatctagctgagcacatgttaaagatttgttaacctgcccagagtagagacatagtccctggccctctgagattatactctgagcatctcctactgattcaaataatgggtaagaattgatgagtgtgtgggcttttattttttatattcagcacagaaattattttaaaaatgctttgctgagaacattgctatatgattattatgatttttatttttctgatagaacaatggtcaaaagatcaagccaacccacatgcttgtttatgggatgtttctcttttccctgttcccaaagcccatgacacatcatgatgctgaatctggatcctaactgaactctggttaataaccactgtaaatataacattttgtgatttaggggcccttacatccttccagtggggagctcaaagtgctctgtgagttacattctacccactcatttggaagagggaaatagagaatcccagttccctttccaagtaagtgtcgtattctctgttctggagacaggtcacccagatggatccttcacatatggactctggtgatagagacgggaagggagtaaatgctcaccccggtcttttctcctgcccacttccatcccacatcccctcttcagatgagtgcagccagctctttaacgtgttagcttcttcctccctgctcttctgttgtccttttcttagtctccctaatccttccctgttttcattttacattctgttctgaaatacaagacttggggagtttgaggtagatgccacagagggtagtacgtggtgttgtggttgtggtgtgtatgagagactcattctgaccaagaccttcttagaactttgtctattagactctgacctccagtccttcttctccaataagcaaattcaagtttggggtgggatctccctactgggaatctgatcaggtcaaagtttgactagctagtactgcaaataaaggaggaggaacttccaatgatttccactccccccagctgtgactggtctgaactctaagcaacaagaagtcacctacaagcactggctgtttcctgaataaagtttccctcaaatatgtaacatagtatattttgtagtgtgtggatgctgttgtgatttataaaatataaatacatctaaaagtattgttgaatgagtagtattgttttcttttttaatttattcaatatagcatagtgattaagaatttgggcttcatagacaagcaaacctgaattcatatctttgctctactgttttctagtactgtggttgtgggcaagtgacccagcttctgttaagtctcaatgtctccatctgcatagaaaaaggaatggctctgggtaataacaattatttaaccatgttgttaaggggctatagtaattgaaataactcctccaagggatggggttggtcttgaatttgtgacattaaaaagagagcctcacacttgaaagaatgagaattgctagttcagtgtaactaacccattgatatgaaagaaggagatgaggcccagaactgcaatgtatgccccattttgcctgtggctaaagcctgattttagtcaagctggtcttcagtcttgtgtagaggtgatggggaaagtagaagtagaagttagatacaatgcttcactcgtgaacagaacagtctaattggagttcacgagatatatggcccgtgtttgatttttggtatttggtagtggaggtctgggagttgggagcaagcagctgtcatccttttgggaagccatgctgtccccagcaggtgacaccccaagtctctttgccagtgaggccccaccaccccacactagtatgagttaggttgctcatgcagagccatttctcaggcattattcctaactcttttccttttcataaagtgagagggcttatgctcatccctcaaccagactatgaaagagacactcacattcccaagtggtggttttatttttttatattttatgtttgtatgggaaattgtggataaagtgaaataattataaataaatggtatgtttccttttttaaaaaagagcaatctaattggaatagaatgtatgtgtggtcctaaggcagctgggaacaatgtgacccgtacagagcttgttccaggttggctggtccaggctataggagtctcatttttaaaatctaaaatacctctcttgcaagatttatgtactagattaagcagggctagatgctctaacaaataaccccccaaatttcaatgggttaacatagtaggttctctcttgctccttgaacaggccagtgtgtcctgaacagtgctcctggcttccctccacttggtgaggtagagacccaggctccttctatctggtagcyctgctgtcctctatgatctcgtggtttatgtcccttcaagagaagtggaaagagagagtaagaataaggcatactccttaaatgtattggtatagaactgatacacattacttctagtcacatcccattgacaaggaacagccatgtggctcagcctagttgcaggtgagactgggagatytaatccctaattgggcagctgccttctagcaacaaccttgccctgtgggaaggagagcatcaattttggaggacagtaatgatctcttcattrtctatgtgagtataaattgtcagatgcataggagatatataataaatgttttcttctaattattagtaacatccattgagtcaagaaatatttgctatgtgtgtacaaaacattttgctaagtattgaggctagaaagataaataataagatacctgcccccaaggaactttaagtctgatgtgtagatagtatatataggtagatgattttcatttgagcttgacaacatttgatcagaagaaaaaactgggaataaatgtgctctactctgtgcaatcagctttctatctgtccatctatcctcctttcattgartgggtcccatgtgtaaggcctagcggtgagcagtaggagggacagcagtagagttaaatagggaagagatggaagatcaytgggaatgtggtttcactttgccctaatgcagcagctgttgacacactacatgctggtgtaactagccattgaactgttgttgccacctstcttgatcaagctttgaagataagcatgagaaacaattagtgtatttcatattttttttatttttgttgtcatgcttatttttgtcctcttcaagatagcaaagcctaggggtagtcagccagctgaggctatttataaaatgtccatgttggcctggatatcactactggttaacatttgtcaaactctaaactctgtagtctagtaaarcagaggatcaggagccagtttcagagggaaaaccaacctttccatttactaatttcttttctatccttagcctgcacaaagaagrttgagaagtcagaattttagttatgaactgtgtrcaactacaacaaatagagtcagtagtaaataaatggttgtcacgagtctttggagaaggatttattattgtggccatagattggagtggtccttgaggatgttaattatgttgctgcttgttgcartttatgacatggcttctatgtggggtaattggatctaggggagctatccttttccatggaaaaaggccagtttggtctcaggtttatagccctaaggaaaggagtttcagaaagcagttgcccaaatttttcagcctccttgatatttccagtgcacaattctggaaaagggctccttaattcagaaattggcctttgttgcagggatgctaggtcaggaggcagggaggggaagaatggaaaggagagcagagattacctagttattcaggactgtggacctaattaatagctggtgttcagtgctaatcactgcattaaacatttcaaaggatttttaaaaaattcttggcaacatccctgtgaggtaggtactattataatcactactagatgaggaaaccagggcttaggtggttcagtaattcccccatatcatgctgctaatagttagttggtggggtcaggattccaatgaggaagcctgactccagagcttaggtttctgacygtgatgctacactgccttcctaatttatgtatctagtggctgcatggtctgaattttttttttttttttactcctgatgcatcttaattaacaaaagtgaaagggtgtatctgttggtctggatgtcaaaatccatccaagggaatataaaactcactacttggttttagttactggaaaaatggcttctattgaagggaattaagagaacaatagattattggtttttctatatcattttgatcttgaaatcaatttagaaatattgtccatttagcctgttaacaataggttagagttataayacaggacagcctggcaagatgcaaggaacaaaggctctggcatgacatagttctgtatttgaagtctgcttctggctttgtgacactgagcaagttatttaacctctcatcctcaatttccttactgggaaatgaaggatttagggtatttctgagtattttatgagactaaactggtatgatatatgttgagcatttgaaacagtgctctgcacatagtagattttcaacaatagtacctgctactattttatagtttattgatgaggaaagggaagcatataatgaacaaayatattctctgggttactctagcccccacaaaaaacttgccctagctgggatgaagttgttgtccttgtattttcaatctgttgctacttgtgctggattatgctagcttctagaacatactaaatcttgagttaatttcttagtccatttggacagctatatcaaaagtatcatagaccaggtggcttataaacaacagaaatttatttctcaacattctggagactgggaagtccatgatcaaagcagattcagtgcctggcaaaggcccctttcctggytgctggacagctgtctgtgtcctcacatggtagaaggggtgagggagctctctggtgtctcttttrtaaggacactaatcccatataagagcagagtcctcatgacctaataccttctaaaggctgaacctccaaatatcacattggggattaggtttcaacatatggattttggggatacacaaacattcagtctattacagtgggctttagagtcctggaatcacttcatctttgatctgtatttatagcttaatttatcttgatacaggtttcaaaatataattgaatagctacactcacttgataatattaaagtagggctatatctttaaggcacagtatcagctggctgtgaacaaaatgctggctgatatatatggtcttctttttctctctgtattcttttttgaattctcattccagttctggttttaaatgtaccttcagyaaatagatcctctttatttcccttctagttcattacttacttcccatgccttcctacttatataatcaaaatctcatgatagttctatgttgtttttgttgctttccaattacttatctgagtcttcctcttttgagagaatataacaccttaatatttattgtaataaatggtttgtttttattcttttcctttattttatttgctatttattagactttattactgtttcttcatttttcttcttacttctttctgtattgatcagcatcttttaaaccagttttttataattatctactggattatcaaactcttgtggtgaagaccattttttatctgtttcattttactccccatctttccacttctgatatggtttggttgtgtccctacccaaatctcaacttgttgtatctcccacaattcccacatgttgtgggagggrcccggggtggggggggcagtaattgaatcatgggggctggactttcccatgctattctcatgatagtgaataagtctcatgagatctgcygggtttatcaggggtttccacttttgcttcttcctcatttttctcttcctgctgccatgtaagaagtatgtttcacctcctgccattattctgaggcctccccagccaagtggaactggaagtctcattaaacctctttttgttcccagtttcaggtatgtttttatcagcagcatgaaaacaaactaatgcagtaaattggtaccaggagaggggtgttgctgaaaagatacctgaaaatgtggaagtgactttggaactggataacaggcagaggttggaacagtttggagggctcagaagaagaaaggaaaatgtgagaaagtttggaatctcttagagacttgttgaatggctttgacaaaaatgctgatagtgataggaacaataaggtcyaggctgtggttgtctcaggtggagatgaggaacttgttgggaactggagcagaggtggctcttgttatgttttygcaaagagactggtggcctattgcccctgccctagagatttgtggaactttgaacttgagagagatgatttagggtgtctggtggaggaaatttcttagcagcaaagcattcaaaaggtgagttgggtgcygttaaaagcattctattttaaaagggaaacagagcataaaagttcagaaaattggcaacctgacaatgcagtagagaagaaaaacccattttttgaggagaaattcatgctggctgcagaaatttgcataagtagcaaggagcctaatgttaatccccaagacgatggggaaaatatctccaggccatgtcagagaccttcatggcagcccctcccatcacaggcccagaggcccaggaggaaaaagtggttttgtgggctgggcccagggtccctgtgctgtatgcagtttagggacttggtgccctgtgtcccagctgttccagctgtggctgaaaggagccaatgtacagctcaggctgtggcttcagagggtggaagccccaagtcttggcagcttccacatggtgttgagtctgaggtgcacagaagtcaagaattgaggtttgggaacytccacctagatttcagaagttgtatggaaatgcctggattcccaggcagaagtttgctgcaggggcagggccctcatggagaacctctgctagggcagtgtggaagggaaatgtggggttggagcccccacatggagtccctacgggggcactgcctagtggaattttgagaagagggccactgtcctccagaccccagaatggtagatccattggcagcttgcactgtgcacctggaaaagcygcagacactcaacaccagcccatgaaagcagccaggaggaaggctgtacttcacaaagccacaggggtggggctgcccaagaccatgggaacctacctttggcattggcatgtcctggatgtgagatctggagtcaaaggagatcattttggagctttaaaatttgactgccccactggatttcggatttgcatgggccctgcaacacctttgttttggccaatttttcccatttggaatggctgtattcccccaatacctgtacctccattgtatctgggaagtaactagcttgattttgrttttacaggctcataggtggaagggacttgccttgcctcagataagactttggactgtggacttttgggttaatgctgaaatgaactaagactttgggggactgttgggaaggcatcattagttttgaaatgtgaggacatgagatttggaggggccaggggtggaatgatatggtttggctgtgtccccacccaaatctcaacttcagttgtatctcccataattcccacatgttgtgggagggacccagggggaggtaactgaatcacgagggctagtctttgctgtggtattctcatgatagtgaataaatctcacaagatctgatgggtttatcggggtttccacttttgcttcttccttatttttctcttgccgccgccatgttaagaagtgcctttcacctcccrtcatgattctgaggcctccccagccatgtggaactgtaagtctaattaaacctctttttgtttccagtttcaggtatgtctttatcagcagcatgaaaatgaactaatataacttttttgcaggcttataagcatccatatacatacagcactaaatttgatgctgagaatatagcagatttttaatacttatgtgtagctgacagtttgactgtgaaactcagttgattccagtgaaaaatggtgtgttgtagtggaaagcccacctagacccaaattagtagaatcctggtagtggtccttattggtggtatgactgcagcactagttgttttatcttcttgaatcttaatttaaaatgagatagcaatactagcttacagaaccatcgaagagactaaatggaatggcatatgtgaaaatgtctggtaactttattgttgctggtacctttacctgtctaccttcctcccatcccttctgctggccagtagcatgagtcatgaggggcaccatatgcagttatctatattcaggctatgggtgctgcagagaagagagcccattaaaatttgatggtgttcccaggagctgctgggctggagaggtaaaatggaagagaagagaaagaataagaaataagaatagtcagaaattttgcagcttttgaagaaggaaggcacaggcttatggtttatgatctgcttgtatgcatgcctgcctatgggttgtatttattcctgcctgagattacatcaaagtacatctacatctatatttcatattcatcctctataccatatattctcctaaggagaactcttgaatgtgaactgtgtggcagtggtgtttcctttgcagcttgcttgctttatgaatgattttgttgaaagaatttaaaagccttttccttcctttggagaaaccataacttatttggataaaytgctccagaatgggattcccctgtcttttctgtttgtatcttttctgccttttaccaatccatgccatgatgttctgttgtgtgggaaccagtctaagacctggcttcctagggggatagcccccttcctctgtgcccacttagcacttatctgcattttccctccatcagcaggcatttgtgtcccctctgtgttattctcgtggccctcttgtttcttcactgagattgagggcgggggtcatgttctcctttccctgttctctagggtgacttgtgtatatattcttagacccacaatagatgcccaacaaatgcaagatgagtgagaggtgaaaagcagggttctgtgcaaacctgtccatggagctgggcagggcgggaggtayggaaatcatgagcccagcttacgccttatcgtccatgttcactcatactttgcccagggtgtgtttactgctcctgagcccaggtagcaggtgtaaaaatctaagctataaccaaaccttaggcccaggagcagtaagagtgtgggttctaagctcatagtccagctgtgggactgaggctgaaggtagaaaaattgccaggcatggtggctcacgcctgcaatcccagcactttgggaggccaaggcgggtccatcacctgaggtcaggagtttgagaccagcctggccaacatggtgaaaccccgtctctaccaaaaatacaaaaaattaccccggtgtgatggcacgtacctgtaatcccagctactcaggaggctgaggcagtagaatcacttgaacctgtgagacagaggttgcagtgagccgccattgcaccgttgcactccagcctgggcaacagagtgaaacttcatctcaaaaaaaagaaaagaaaagaaaagaaaactgggtgacatggagtggggtcctttgatcaggactctgaggaggctggtgtgtttctcccttcctgtttcagaggcagcccacatcatttagccaattaagttggaggactctattttctgtttgagtgtttgttgttttttgtttaaaataaatgatgtgttaatacagtcagttgtttgcatgacacagatttcttttcaatcagtctcttttcccctctccccactcttcctggacaattagcaaagtgtttggtctttggtttggatgaataattgattcagaagctttgtgaatgattcatggcccatatgctggggcagcatgatgtggtgtatgggtgtgtggcagcagcacctcattacaaaggtcaagcttctcccragcttggtgcaggggctgtgcaggccacctccaggggcagagcacgttgcacstgatctttctctcatgttctctcaaagagagagtgttggagcttcttccagaaaagcaaggttctctatgggtgtatgacttccagaccagtgattctggtttgggttggatttgtcagtgaactgaagctttcccctttaagccaacacttcactctccccaagctgaatagctgatttgattttcaaagcatttgaggaaaggagatctcttgcctgtcttcctttacattacagtacttcaaaccttcccaagcaggggatacttttttctttggatcttctcctaaacactccctgctactacgctaattttatttccttgtctatctcctttactggagatggagaacacctggttaccattcgctttataggtctcccttgtctttgaagactattattacatacttgcttgcatgaggcaatgggactgttgcctarcttgtggaagagtggcattccctatctacaaaacctctcagtatttgagacttcttaatgtgtcctggtctttagaagctgagttaggaaaaataagttggttacattaagtcctgaaccaagttttttgtctcttaggcagtcagatcccacatttttaaatagggaatcgagacagagacaggatatgaataaaatccaagactctgatgaagatgtggcagtttggtgattgatcatttggggtttttttagtaagatcataaaaatattgcataaaaatttattttctagcataagttatgattatcatgtttaggtccctaatccatatggtgtttctttgcatctagtatgtgaggtatgactatacctatatgtttttccgtcacttcccaactccactgagtgaatactaacagtacaacttttgcccactgatttgtaatgtcacttctgtttgtataccaaattcccatatatatgtggtctgtttttaggctgtcttttctatcccattggcaatgattaatgactatatttttataaaactttttgataactgatagtgccaatcttcccctccatttgtctttaaaactggctaatcttagccattatartttcatatgaattagaactaayttgtcaaaatcttcaggttttgtttggaaatgcagtggatttattgactacttttggggaaaattaacattttcacaatgttgaatcttaccaatatttctccacttatttgggatatattttataccctattatagttttggagattttttccacttatgacttgcgcatctttgttataatttttcttctgtatcttgtaattttattactcttgtgaatgatttaatttttttatttctaatagaatgttgctaatgtataggaatgttagtttttattcgttgatgttatatccagcaatcgtgtaaaagtttrttagttaaaatcatgttggtagatttttttttagattatataggtagaaaactgtattaactacaaacaagtgttattgtatttgtttctttctaattcacctagtatatgtttctttttcttatcttattgccctaaacaggacttccaggaaaatgttgggtaatgacagtaatagaaggctgtcttattttgttccttatttaaagtttaacaatgaagacagatgttccttataatgttayggtgaatactctttataaaggaagtaaagaatgattgttaaactaatgtcaataatagctcaatattttcatctaattcataaactcaaaggttttggaagttcattctgtagaagattaaacattgacattattgtgggtgctattgraaactgagttaaaagtttagtactagcaataagcttatttttggagtgataatatacatacaattttgatgaaacatgatgttattgtataaacaaagtttttactaaattaagaaacctatggaacagaaacatataggatgaattgtatggacaaagaattcattatcacagccacacaaagtatggtattccgcattttgaaataaagactatgtattgggtacagtatacactgcttgggtgacggctacactaaaatctcagaaatccccactaaagaatttatccatgtaaccaaaactacctgtacccccaaaactattgaaataaaaataaaaaataagaaaagaagtagtaggcaaatagaatgagtaaaaaagaaaaagtaacaagaaaatttagcaagttcatcaaaaagcaagaaagcagagaaaggaagygattttaaagtgaggcaagcagaatgtgtgaaagtagaagtaagtcctgacttaatagcaattgaaacaaatgtaacagattaaacttattttttaaaagtcagaggccctgtgactttatttaattttttgatcttatgtttmaatgactaagctaagtaaaatgacactagaaaattgaaaatagaggaggtggcaaaaggtgttctagacaaatgccaaccaaaagtaagtgaacataacattaaaaaaattcaaggtgaaaatatcaaaggaaacaatagtgacyatttcactgtgataaaaagaaaataattgaaggacatttaaaacttatgcaccgtcagaataaatgtctgttaaaaacgtaaaggtaactattaggtaaggagatttccaactggttttgaacaaaaygcaacaaaaatttaggggtcttcataaaaaagttcagtatcattttgggcacttaggttgatttacaaagcaggtcctcagaggcttaaacatttataaaatgtttcccctcccccatttgtctttaaaattggctaatcttaggcattagaggtcctgaactaagttttgaacaaggtaatgggcagcaaagagaaaaaatgtatgctgcaattctgactttataaaaattcaccaccaacatcatcacaaaacttttgtagttcagttactctgtgtatttgaaatttttgataaaactataatgtgtgtatataaatatatttttatgtatatatgtataaatgtaaattacatttctgccatatatacacacacatacatacatatgtaatacacccatacccatgcacatatagatgattacctttaaatttttaaccactctattgttgtcttttatcctttgtggctgatagtgcttccaatatcaacatgattatttctttttttttttttttcgagacagattctctctctgttgcccaggctggagtgcaacagtgcaatctcagttcactgcaacctctgcctcccgggttccagcgattttcctgcctcagcctcccaagtagctgggattacaggcatgcactatcaccccggctaatttttgtatttttagtagagatggggtttcaccatgttggccaggctggtcttaaactcctgacctcaggtggtccaccgaccttggcctcccaaagtgctgggattacaggcatgagccaccatgcctggccaacatgattatttctttacagataacttttgtttcctctttcattggaagcattagcattttttccttacttttggtgctgtaaaatttcactaatatgtgtcttatatgatggtttctatttatttttatttttatggcattttaagatttctatttttattcaatgctgggaagtacttttgaattgattcttttactttcaaattctctgcttctccacttcttaattttgcttctctccattttatctattctttatttgtagcacttgttttaaatgatgttggaatttcttccctctatttttaatcttttctttatatttttcatctttttcttactcttgtgttgatttctgggaacactgctcagttcagtttttcacatctcaaattcacctgtctattttgccactcaatctacttaatcattttaaaagttttcagttatcgaaatgttcaattgcaccatctctaggtaattttgtaaaatgcttgcaatattctcacacttttctctaagctgataattatatgtcttcattctcattgagtataagttctttgattgttgagtttgttctctctctctccgtggtattgaaattcctcaagtttttggtgattcttgattgtaatattatcttctttctaccatgtctgtttgtgcaaacttcttggaaggagaatacctatgaagctaatagtctggcaagggtatagaagtggtgagacctgctgctggatgggtcactttgatgaccagtcccctgggagagagcacttcctgttcctctcaggcatggaaaggcatgagagcacttccccatctttctcacccaactttcatgcccattgcccctgcttgtgggcakattttcctttttgctgccyggtctgagggataaggtgggttaaggaggagggttaaagtgagtgcttgatcttcctgctactgtattcaaaccatcaccctgttggtcacctggatcccatcagatcccagtggccaccctctgtaggtgggagcacttgtggtgacatgcctacatttagagtggtcatattctcttctgagggctgggggccgtggtttcttttycttttctttttttttttttttttttttgagatggagttttgctcttgttgcccaggctggagtgcagtggcacgatctcggctcactgcaccctccacctccaagattcaagtgattctcctgcctcagcttcccaagtaactgggattacaggcatgaaccaccacacctggctaattttgtgtttttagtagagacagggtttcaccttgttggccaggctggtcttgaactcctaacctcaggcgatccacccaccttggcctcccaaagtgctgggattacaggtgtgagccaccacacctggcctgtgrtttctttttaaaaatcagattgtagctactttctgtccagaggggattcatcacaacatctagcctagtgagggtttgtttctcttttttctgtccagtgtggttactgtatgtatatagaaaatgatttctaggaatttggtggaaggggggagaggtcacagtgtgtgttcagtctacctgtctgagagagaagttgaggcaatattttcttctaacctctctgagtctcagttacttcacattcaaaatgaggtggtgatgatgatgaagcatgagggtggtagtggtgattctcagttaatatttgaaattggagtgtatgtcaggcactgttctaagtactttacctgtgcaaacacatctaatgcctcaacaaccctatgatgtctattctattactattgccattttatagatgaagaaacagaggtacagtgagattaaataatttacccagataaggggctacctactatgtaggattagtttgagaattattaagctaacacatgtaaagcacttagcatagtacctgaaatatattggaacaacaaaaatggcactaataaatatatactgagtgaatgaaaagtcaccaaatatttatattccatgcagtttgcagaagatcttgtagaagttagttggacagggtgccctgttctagtgttttctgtcttagtgtttttatgtaatataaaagctgtgtgtttctggccatttgattcttaccctaccagctcaatatttaaaatttttacatattgagttattggtgcttgaaaccattttaaatctttctgctttctcatatgatatgattgcaaataaattaggtaatgagttttaaaaaatcagttgtggttaatctttcaggttcagagaactgaaaaatatatctgctttaagggaacttacattctaatttccatacacatatatattacatgcatttttatacatgctgcatgagaaagatgtcctttatatggtggttctgtattgaataccagcatccagcacattgtctggcacagagcaggtgttcaataaagtactgctgattcaatggaatctttttcatgtgttatacgtaaatgtgcatgtatatgtaaattggaatgcaaatctgtgccttcctgggacccatagtctagtggaagagagtgacaagaagcaattgcaatacatcaccgcactaatgctctgttkaatgtattctgggagtatggaagaaggagaaggtgactgtgtttgggaaaaaaaaawcacagagaggtgatatttatttaagctggatgttgaaggtgggtaggagattgccaaggagaacatgggaaagggcattcagtcagggaaagtggaggaaagcaaactgactagcaaagtcctgagaatctacaaagtgaaaatctgttcagtgatatagtgttaatctgaaaaggcttctgttgaattttgaaaaagatcatgcagaagatgataagcatggtttcacaaaatgtaatataattctgcaattctttgcctaaaggctytcagtggtttgctgttttctgcagcagaatacaagatccctcctgacctgaccacatgcagcctgccctccagctatactggactacttgtggttccttgaattgtgtgctatttcatgcctccttccttttgaatgtgctcttttgcatgctgtaacaccaaccctgccatccctctggctggtatctattcagctaagtgactattccctgactgtgcttcctccccatttccttctattttcygttactcgttgactaggctcaccctaaacttcactcacccagttgacattagtatctcctccactacatagcttctcaccaagggcttgaaggcaggggttgtattgtattctatttgaactccttgtgtgcctggcacttagtagtcattcagcaaatattaccaaatgaacagataatgactgaacaagctaattaatgaattaatgaatgaatgaatggcagatatgaaagggggaagaattcaggaagacaggcaaaatatttcaaggatacctttaaggccaaatgaagaaatggaaggttgatccagccaatccttgtcacatgatcaccttcatgggaggaagaatatattattcccggtctgcttaccccttctctaatggtccttttaccactactaatgctctgtatgagcctctcaatccaggtgtcccgcaaggtctgagtcccactgaagcttttcttaagttgagtaaaagtaacctgaaaaaactgataagcatttttcttagtagaaatccttcctctgagcagtaacctctgaatattatgtataaaaccattacattacttaatggataagactcatgttaaaattcaccttgtctccacagaagatagacccagagtttagtctttgcttttagtggccacatgtaaaagtggtgtacagtggagctgtattacttattataggtcttgtgttaaaataggacaaaggtaaaattagaaaccaggatgccagatttcaggtccccagtcttacaacaaataaacatgcttcctatttaggtcctctttggtctctctcctccttatcatcaccatcagcagatgctcaatgaacacctcctatttgggtgtgacatcctgttgtgtgcttgtgatgcacagttagacccttcagattgtttataataagggagatggagaaccttcacaaaatcccccgatgtaaacgcatttcctagatcccttgtggaatttattgtaattctatacatgcacacaataaacatcagagggcttcgagtaggtgcctcatcatcaggaatgccctgtatcctcatctcccaaaccgtggcacagggctgattcccctgtgtttactaccctaatctctgtgctctatggcaacatggtgttttatatggcttttatatggtagtgtgtactccttgtgtgcctggcacttagtagttattcagcaatatttgataaatattgaacaaattaacaaatgaatgacacatatgaaagtgagagaattaggaaggcagatgatggggtttagaatatgctccccaaaatatgtcaccttggcgtactcaatgttttaagctaaaggaatttgaaaaacaacgtgtgcaggaaagactctctggycttcccctgaaagagctcatagaacgctcatgtgagaggtgccctcccatccctggaggaaaggagcatcgtgatccctgaagacagagggacactgacaggkatatgaacaaatggacctcgcaaagtctcccctagtttactgtacttagcccacaccattttgtcttattgtatttttccataattttccactcttcatcaaacctggtattaaaacagtcaggtataatcatttcttggagtcctcatttccttataaaggctcctgtgtcttataaaagttatacaggttaagcatccctaatccaaaaatccaaaatcaggaaatgctccaaaatctgtaacttcttgtaacgtggtattcaaatgctcattggagcatttcagattttggagttttggattagagatgctcaactggtgagtataacatgaatattcccaaatcaaagaaatccaaaacacctctgctcccatgcattttggataaaggatatttaacctgaattaaataaatctgtatgtttttcttttgttaatttgtcttttgttatagaaccacagctgagaacctggaagggtaaaaggaaaaggttttttcctccactacgcgggcaaaatattgcaaggatgttcttaaggtcctaaaaaatcttaagatttaacaggtttttaggcagaaatgttgtactttccatttagaaagaagttgaagctttatatccaacattatatatgtttaacataataacagttaaagatacacttaaaaaaagatggagagaattttcaaggaataggatttcaggagctagaggtactaggagttatgaatctccccattagataggtagacaatgaaaaaaaaaagggggaaggggatgatttgcagtttgatggtaacaggatcgttgagagcagcaaaacagaagtaaattgatgctcatctcccagattagttgagaacggcctaattagctaatgaacagttccagtcctatgttctgaaaggctctgyttctgggcaagccgcagtgcttagcagcagctgctaaaccatgtggacatgctaacaccaagcagaggagcacatgttatgttttgacctgcaaagactcgtctttttgagtcacacattcttcaaggagtattagagatcttgtttcttcgtataatagagaagtagcagtctcagtggcatgaactctggagccagactgcctgggttcaaatctcagctttgtcacttactaacacagtgatcactgctgcttggtctctatgtcctcatgtaggcccttgctccccaccattgtatcaggtttggtctgggtgaccaagagaacacggcagaagtgagggtgtggcttttgaggctaggtcctagcagacattgccatatcttccttgctctcttggatcacttgcttggtggggaagcaggttaccatatcatgaggacactcaaggagccctatggaaagtcacatgatcaggaactggagactcctgccaaagccatgagtaagccgtcctggaaacccagattagtcaagtgttcagataactgcaaaccccagctgacagcttgactccaactgtggttggtttcttgactgcaacctcatgagagatcttgagcaaaagatccccacaaaaacactctcagattccccacattgctaattactgttttaagccacgaagcttgcttttcagaagtgttaatagataattaaagcaaaaaactttgtaaagaactagtttaaaggatgttcttaacaacagacttgacttgatgaagaaatagtggctgatattgtttggctttgtgtctccacccaaatctcatcttgaattgtaatctccacagtccccacatgtcaagggggagatcaggtggaggtaattgaatcatgggggtggtttmccccatgctgttctcatgatagtgagtgagttctcacgagatctgatggttttataaggggctcttccccattggctcagcacttctccttcctgctgccttgtgaagaaagtgtcttacttcccctttgccatgattctaagtttcctgaggcctccccagccacgctgaactgtgagtcagttaaaactctttcccttataaattwcccagtcccgagcagttctttatagcagtatgaaatcggactaatacagtggcatgccttttaatttcttgatttatggaatacctttaaagtaatgttacctaaagtaacttttgtggaacagtagtcctgcaagatgctccatatataaggggtttgatgtgtttattagtttgggaaatgctgcatactagatctccttcttggaaatacacgttgctcataagcatattaaagaatataaacaagtcttaaggattttttgtttgtttgcgtagtccattgtttcctaaactcatataaccaaggaatttttaaagtcaaatgtcacatattaaaatattagagaatactctgtaagaaatgttgtcttataacactgattctcagacttatgcctacatcagaatygtctggaaagcttaaaacgagattgttgggccccactccctgtgtttctaattcagataacctggggtagggcttgaaaatttgcatttctaataagatccctgctgatgctgatgctgctgatgggtgcgtgtgtcgggaggggaccacaytttgggaaccactgttcactagggtttcagkttcctgagtaagagcttaaagaatgaacatgcaaatggccaataagcacaggaactgatgttcatctgctatggactgaatgttcctgtccacaaattcatatgttgaaaccccagtccccaatgtaatgatatttggaggtagggtttgggggagctaattagttcataagggtacagcctttatgatgggaatagtgctttcagaacagccgtaagagagcttgcttcatctctctctgtcatgtgagaacacagtaagaagatggttctctgcagactgagaagagggtcctcgccaggaatctaactggccagcaccttgatcttggacatcccagcctccaaaactttgagaaataaatttctgttgttgaggccacccagtgtatggtattttttaaagcagctggaactgagcaaggcaacatcattagccattagggaaatgcaaataaaaaccacgataagataccacctcacacccattagggtggttacaataaaagagacagacaataacaaatattgagcaggaatatggagaaatttggatcctcacacattgctgttgagaatgtgaaatggcacagcctcttttaagctccttaaaatgttaaacatggaccatatgacccagctatttcacctctagaaattttaagaggcataacatatacccatacaaaaagttgtgcattaatgtccatagcagcatcattcacaatagacaaaaagtatcccaagtgtacatcagctgatgaatgggtagacaaaatgtggcatgtcagacaatggaatactactcgacaatgaaaagcaacaaagtactgatacttgctataatgtgggtggacctggaaaacataaagaagttcctcacaacaggctacatattttatgactccatttatattaaaaagttcagaatgagcaaatccataaagggcgtacgatagttgttacgaaaggctggtagaagtgaggtggggagttgactggtaatgggtttggagtttttttggagcgttgaaaatgtcctaaaattagatagtggtgatggttgcacaatcctgaatatactaaaaaaaaaaaccccactgaattgtacgctttagaagggtaaattatgtggttgtaaattataactcaataaagctgctataaaaatgcatatagcttctaaattaggatggcaacaaaagtacaaatatccaattgcagtatacgttttaactttattgtaacctataaggtgccagaggcatactacaaatggtggcagtggtgggttggtgcaagctgaaaatttagatgtagctggcgttttagcacccttctccccctccttcattcccgtgcagataataaatgtttattgttgttctattgtggccccaagtgagctgtggacrtggtggggaagcagcaggctgaccccggagggtttgctaatcagagagagtgtaaaacctgtttcagaatctgtcatttacatggggcagcaaatgacagatagcaatttaaagggtcacctttcccagggtatggctgtttgttttggtcattgtggttggttgttttgcattttaagaatgtttggagccttaagctagcacagtggctctccaaacttcagcgtgcatcaaaatcttctgaggttcttgtttaaaatgaaaaatttggccctacccccagagggtaaggaatctgcctgtttagcaagcactcagatcattctgatgcaggtggctcatggaccacggtaaaaacatttcagctccaaaaaaaaaagtcttgctatgttgggggtgtacataaataagcatggggctgatctaaccaaccccaggacagtagttactcccagaaggaggggatgaaaacaggttgggtggagccttgcctgtgtctgaaatgtctaggttttttaaaacatgatttgaaagaaataacagaaaatattaacccctgttacatataataccatgtttgttgtatcttttgccttattttttgactatttgaaatgcagtatctcaaagtattttgtcatacttggcattttagatgttcgtccattccagggactcagygcactgaggcagggaagacagtggtccagttggtgggctccctgtgtcctgcagggctgtggggggatggcagtgctcccagcttggaatccccccacactgaggtgggagatttcctcctcccacgtgagggtgtggtcttgactactcctggctccacacaggctgtcccttagggcagggggcaggagctcaagaagctggaggayagaatttctcccctgagaacaggaaagagaggaggcacgaggaaaccacagtctgtctgctttaccctgatggacttctgttcagggagtttgggtgaattccacatttkgatcacaatagttgtcgcctgcctttcttttccctcatagctttcaagacccctttcawgtccctctgtctccaggaaagatgatttatttttttcttggcccaaggctcccccaggggccccaagtccaaacactttctttgctgttccttcaggagtgttctttctgtgatcccattatattgaaatatatgcagatggagcatcacgtgtgcctctagggggttggggaggagcctaaggaacctagagagccatcctgagatgtggggagagggttggggtgctgcaggagagcgggatgactggcctgtgttgacagacacgccgtggggaagcagaagctgccccgacagtcttgtaaatggagtgttcacctctagcagatgtaaggcatggtttggaaggggatgtgtgccaggtcgtcaagtttcacagcagtctcaggccagttgggaagcctggcagcgtgtgccatccctgagcaagagggaggctggaagagaggactgtggtctgaaagttaggagccctgggctcttgctagcttcttccttcttcgaacctctgccctgctgtgtgagagcaggtagtgcccttcctctgccttatggagtgatgagaaggaattagggcacttggaagatgctgatttctaatcctttagttgccaccaggcctcagcccccttgactttcttcctcaccccctcaattttcctgctgcccttgagctcttcataaaagtccctgctggggccctgccttctgttttctatctcaaattgtcccctttcccttcccagacctgttgtcctctatgttgaaagtttctaaagttatgtgagggactgtttggggctagggtggaagggggctcttagtagacaccaccactcacccattctgtgccaagcttggggccagctgctgcggtgataaacacaccctcttctctacacaaaaaagccgtgcagacagtgcacattcatcagctcctgttctgcctcttcatgacaactgtccacctctcaggacatgatgtgctctgaatatcagtgtcgggccatttcaaacccaggggatttggtgtctggtgttagcctggggtaagaagtagtgacccaggcactgggctcacccctttcctgcattctttatgcctgacagtttctcaagtcgtgcctgtccttttaaatcaagcgatctgttcttccctttgatgtcgtcctccyggccaccagcctacatcctcattacctgataacttagatgatttaaagcctcactggttggcttcttgccgtcattttctccccagcttcagtctgttaayggccatgaraatctcactaaagcccttctacagcaaggcacatgcctaaatgggaacccaaaacatctccctctttcccattgcmccctctgccctgttctctgtggcttttgaagccttcctcagcactgatgccacctgaactccagcagtgctcatgcctgcccccgactctggccaccgatgccaccttaactccagcagtgctgatgcttgcccctgactctggccaccgatgccaccctaactccagtggtgctcatgcctgtcgctttggatttctcacccctgttcatgatctgccctcctctggaatcctctatcctctcctctttcctgtgcatctttcaaagcctttcacgatgacacgggctggtgcatttgcattcagatcctctgttcactagaaatggaagggaccttggaggtccttgagtccagcttctttccagagtcccygcaaggggcagtaacttgccactgactacacactaggttattccaggaccagacctctcactcctagtccagcgctccttccaccacaccatgctgcccaaagatgtagaggaagcattctcgcccacagctgactgggatgttgtcatcaacagcggcggagatgcagtgggagtaaataacaatgtttgtggaggccttcttattcattgcatttgcgatgcaattagcactttattatagcttgttctcattcttattgtcagttccacacattgagccctttattttatcagaatataacactgcctcgtttgctaattacctcatacatagaagtaaaaactgtcttaaatatcttttgtagcccacagcatctcctgaagttctaggcatagaggagaacttactatctacttgttaattcactgggtttcaaggacaattccaggcaaggctcacatttgagccattagttgtgatgaagacctgtccactaacagcattgtcagctttgccttaattttctatctgaggcttcttagagcctcctggttagaggtaggtatactttcccctctgttcccataacactttttttttcttttttttctttttttttttttgagtcagggtctcattctgtcacccaggctggagtgcagtggtgcgatctcagctcaccgcaacctctgcctcccgggctcaagcgattctcctgcctcaacctcttgagtagctgggattacaggtgcgtgccactaccacccagctaatttttgtgtttttagtagatacggggtttcaccaggttggctaggctagtcttgaactcctgacctcaaatgatccacctgcgttggcctcccaaagtgctgggattacagatgtgagccaccgtgcccagcctccataacactttattagtatctttattgttgctcatgtcatatggrtaattatgaacagactcctgcctcctcctrtgtttctggggacaataagaagtctttctttgtatggcccgtaggctgctttgtccacacaatgtcttgcacatggttgtgctcatacatggttgttgaattgaatattatgaataatgacagagttaacagtagcttaccctcatgtggtttatctacacagcccagggctttcttccacagtgtggccaaaccccagactgggactaaggccaggctaggagggtttgggatggtttccagatgggcaaagatagttttgtgtctcagaatgtgtctctaaccacatctcaaaaccaaatatgataaatgactttcgtcttatccatcatgtttagttggctaagcctcttcctctatcagcccagataatgaagagatgggatttttattgttttctctgtggcacagagaataaagcaagttcccaggtaacaaggcacagcagcatctttcaagccccgaaactgagatggtctgagaagagcaggcacgtctaggagaaacagaaaggaaaagccagccggaaaggggaatcattcttaatcgatcccaagcctctgagagctggaaggtctgactgcattttacaaataaaaaagtcaaagccccataaaggaaagtagcctaaagccacagggatggtgaaggagtggcgtcaggatgggcagaaagagctctggactcttgggctgctgctacaaccacctggtgtgggttttcttaacaccacagctccatcaggttcttaggaaaaatgtcacacaaccaggttgtcaaaagggctttgagggcattaagaaagggacagaagtggatggattagaatggacaggtagggtaccaaggggccagagtgagaatgaggaagaagggctgaagagagagggatcagtcgtatttgcttctgtttctgaatagtttccctttttggaaagagaagtaagagaatagaaggctaaaatcatgccacagactggcaggggtggttgggtgtagacacaacagctcaccttcaggctgctttcacattcattcatctctttcccttataatgatgatgctgcctccagtttttagaactttctggaaacttctgagaagtgactgtctaaagggggatgatgggagaaggggagttgyccatgggttcccatcgtgcttgctggagcaatgggtgttggcagatttcttcagaaggagtttgtcagcagtggggtggggctgggaagaaagccacagtgaggcaacaggtgcaggcatggagaccagagcaagcacagtgtccgtggagaacggcatgcatgtcacggcaaccactggagtgagcgtggagtggagcatggcggagagtgggggtgaacaggcaggcaggagctctaggtctgtgtactgcggtgacacttctggattctactgtgaagacaatagagggccattaagaggcttaaagtgagggggtggtagaatcctggctacatagacctcccagcactcagagccttggaatcttgccatggtggtacatgtgtgtgttgggggtaattagggaggaaggggtgaggctgagctaggatgactagttaggacaccatctttactgtctagaatatactgagggctgtgacctgggctgtgtcagtgggaccagaggaggggacagatacaaaaaatacttaggggtctttaaacttgggggatgagagggaagaatccmagatgaatcccaagtgtaggggagggtggcttttttcaccctggatgaggagcagtctggtatggagaggggatgagggtggctctggctttggcggttgggtgtgtcttttggactgggtgtggtgccctatagaaaggctggagcttgggacaggtctgtgtgracacctcgattcatcactgcatggttggtagttgaaaccatagacatgggtcagattgtcccagtgaaatggcagagaagagggcaaggacagactccaagaggccctgaatcaaatgggtatggaaaatatggagggcctgggatggaggctgagagggagctggcaggaggggtgggggcagattggttgagaccattagcagggaaatgagggagaaagartttccagaagggaatggttaccaggttcaaatgtgagggaggaattcactgctggcatttgtttgagaagccctgacctttttctgttcccttgctagaaataaatgctttttttttttggtagcagacagtaatgtactggaatggaatcatgattgttccgtgtctcagaatccatatgtaaagtcccttgtcagatagcagggaaacagtcatctttgggcagtttgtactgagagggaggggaggccgagtgtaaaggatcggtgccttaattttagcaaggctctgagccccttggaaggcaarctttatttctacatagattgaaagtattattattattacatccttacgctgtatcagcgccaaacactggagtcctcaatactgtatttatttctctgggcttttggaggggtggggaagaaacggsacatttaggttgctaagtgattgtgcttgcttctaaaaataatgagattccccagtggctcgttctcctgtgttttgcttagagttagaggatgccaaggtcaagttatagatgacaggctgtgtctccaggtggtgtcagggcatcctgttggggaaggacaaggtaaactctccctctctggtcctcccacctgcatccccttagggcccactactttgggaaattgcaggaaaaactgggcctccccctgcttggattgaagagcctcgcctaggcagtcagmctcagtggttgccatggtgatggtgggtggttggtggggtggtgatgcagcgtttggcctgtgcagctgaggtcctcaatgcaggctgcttggagcccaggctgctgaagcttttgacagtttgtttaggattccagagggtcacttgctgcggtgttgaaatcttcagacagacccgccagctcagccagctgaaaccttcattgttgaatatgcatctcacaggccaaattttggcaggcgctcatgggattaggagctccacagcaaccttggtgggggaaggggtgtgcgaaaaagctctgtgcaggggagagtggctgggataatagactctgaggacaacagaaggccagaggcccttcagatcgtccagttcatcaacaccttcaacaacatccctgacagctggtcaccaagcttctgcttggactctccttgtgatggggagctcactaccgggcaaggcacaccactccattgttgaataggttttacattttctcctctctccctcacttctttcgttcctccctcattctctccatctttccttcccccctcctttccttgcatcctttcatttttttggcaaaattctggccccttctaatttgattcactgactcaagttatgccaagaaggaaagcagtgtaagctttcatcaaagtgacaaccacttgccacccaacaaaacattcatacttttctcagctacttctgacattatttcaagaccccttgttatttccccatcccctatatttctccatattgctcttaaaatataacacccagaatgaaccacagtactcgactggtctgaccaatgcagaggactttagggtgacacccatgtttgtgaacagtctgagatgattttgtagccccctcctcacacccttggctgatacgaaggctgtgattctctgtcgttcccagatcttttacatatgagcagctgatgctgggctctacatttgtacttttttgattttgtcatctaagctgttgagaaacacgttgaaatggacagaaatgatgatggaatgccgtggcaaaactctagaggcctccctgcaggtggaaattataatagtattcatagctttttttttctgtttttatatccaactatctacttgtctaaccaattaatcactgatctttttttttttccttagagtgttccattccattgtatggatgtgctacagtttgtttatttattcagcaatggaaggacatttgatgttttccagtttggggtgattatgaataaagctgctctaaacattttttaaaatcattatatatttattattttactttaagttctgggatacatgtgcagaacgtgcaggtttgttacataggtatacgtgtgccatggtggcttgctgcacctattgacccatcctctaaattccctcccctcgcccccaccccctaacaggcccctttgcagggacatggatattttggtgttatttctgaggtctctgttctgttccattggtctgtatatctgtttcgatacccagtaccatggtgtttcggttactgtagccttgtagtatagtttgaaatcaggtagcatgatgcctccagctttgttctttttgcttaggattgtcttggctatacagggtcttctttaattccatatgaaatttaaagtagtttttttctaattctgtgaagaatgtcaatggtatagcattgggaatagcattgaatctagaaattactttgggcagtatggccatttttacgatattgattcttcctatccatgaagatggaatgttttttccatttgttcgtgtactttcttatttccttgagcagtggtttgtagttctccttgaagaggtccttcacatcccttgttagctgtattcctaggtatcttattctttttgtagcgattgtgaattgggagttcattcatgattcggctctctgcttgtctattattggtgtataggaatgcttgtgatttttgcacattgattttgtattctgagactttactgaagttgcttatcagtttaaggagtttttgggctgcgatgatggggttttctaaatatacaattatgtcatctgcaaacagagacaacttggcttcctctcttcctatgtgaataccctttatttctttctcttgcctgattgccctggccagaacttccaatactatgttgaataggagtagtgagagagagcatccttgtctcgtgccagttttcaaagggaatgcttccagtttttgcccattcagtgtgatattggctatgggtttgacataaatagctcttattattttgagatgcgttccatcaatacctagtttattgagagtttttagcatgaagggatgtagaatttatcaaaggccttttctgcatctattgagataatcatgtggtttttgtcattggttctgtttttgtgatggattatgtttattcatttgcgtatgttgaaccagcctggcatcccagggataaagccgacttgatcgtggtggataagttttttgatatagtcactggtattttgaggtgattgctatcattatcatgatcttactaataagaaagcagagccacagagaggtaaaataagttgctcaaggtcacacaggctctaaatagcaaagtcagtatttgaatttagtgttttttgttgagctagggtttcactctgtcatgcaggctggagtgcagtggtgagatcacagcccactgcagccttgacctcctggactccagggatccaccccagcctccctagtagctgggaatacaggcacattccactatgcccagctaatttttttagttttatttcttgtatagatgaggttttgccatgttgcccaggctggtctcgaactcctgagctcaagtgatcctctcacctccgcttcccaaagtgcttgggattaaagatgtgagccactgcgcccagcctgaatttagttgttattcagtaatccatataatttgggaatgattgttcaaatggcacagactctsacaggggttcaatctaccattgtgtcagtgtagcagatgagatttttgtcaaggggcttgctgaaatccagggtaccatatctttagcattttcctagtctgtttgtccaataaccctgtttaaaaaaagaaacaagattagcttggatcggtttattccaagaaatctcatgctaattcctaataataagaaacaatgccaatagtgatactaatggtcctcacatttgctgagtcccagcctgtgccaggcactgagctaagcttgtcccatgcactgtttgatcatcctgctttctcgttgctcacacactgtgtactgacstacggctgaattctcctgggattgacaatgagcttactggttatcactgtagagtcttctgtttggaatcaagacatttgctcaggttttaaggcctctgtttttatccccagtttctcacaagctgcttgtttggatgtcttatcagtgctggatctaagtgagcatttaatttggagctgcaggctgggttcaagtctggctctatgacagctttttatcaatgagaccaacagcaaatcactcaaccttgagctttggtcttctcctcttccaaatggagattataatccctatgcagagtatttccacagatgctgagatgctcatacaggagaatgtttgtgtaaaagtgcttctcagacttcagttgcagacacacttgagccatttttgttatttaaaatggttaagtgttcctactagtattatctcctatccaagtttcacttttaacagaatttatcctcccccttttagatttttaaaaaatattcataagacactcagaggtatgactgaatgttggtcactagacccagaaaggggtatacctaccagctcttgcccactgagttgtgcttgaggtggaagaaacagaattgcagactccaggaggaaaaggtatgcttctagaggtctttcatctagagcgaatctttcccaccttctcctaatcagcagaaatcattacaggaacaagacatatcgatcctggtcagagggcaccatatacatagagttctgttttcttctttttctttccaccctcccccagcctcagaaggctaatccagtgccacctgcgatttcttctgatgttactgtggaagggagggttacataaagagaataaccaggttttctcctgtggcacctgcagccccattttctcattgggaaaaccaaggtatgaaggaataggttaggacttaatggtgcataaactcagagccagcagtcattcttccatccctggtcttggcatttggaagatgwgatccactatgttgtaagstctaaggggcaggaaatacaagatgatgtatttatgtaaatataatgtactatgttgtaatcatatgtgcatgcaggaatgaatgactgaataagtgaagggagaattcttttctacctgaactgtggctcctgctagtctgaaaggcatgcagcctttcttaagctttatgaagaggaaggctagaaagaagttcagaaaagcttcccccatctttattctttaaactctatataaaggcatgaaatgttctgagactgacgaaaacatgggcctagaccagcaaatgattttggaataacaaagatgagcctagttctctagctattgtcacctcctttgttgtgccagtggtggttaccatgtgtcctccttcactggaggatacagccaaagtgaaggatgctgcagtgtaaggatgcaggatgggttttctggcttcaaattcgttatagactagagtagcccagggcatcttcttactagatgtcttgcatcatggcagcaacacccctggtccctctggggtggatggggtgcagcacaccttggtgaggggtttacactaaatactgctgaccccaggacagcratttctcatacatttttattccaaagtattcctgaaaggtacttttgcttcctcatgtttccacaacaaccccctctagagcaaggatataaataagaaagcaaaatttcaggctccctttacaatcacagtagctgttaactgctgaaagggactcagagaggggcccctatgggagggggaggcagagggtggagcaggccagcctgtctccctgggtagcacatccccaaagaatcctctgagcattgatctttgattgtgccccttccgtgctacccagcaggaccttctcccctaaagargggtcactttgtattgaggatctccttcttatattgcatttgcttagagggtgcatggcctcagaccacattttggggctgatgggaagaagttggggcaggagggcactgtggtcataatgaggtcatggactgctaaagcttccagttctgaggggctcaggtttctcaacagagtgaagatcaaagtgtgttcagtgtggctgctgctgctgctacaaagaggtgtgaaatgtgggtttggaaagagaaccgaggataatttgctagtttatagcctttcctagagttcacacagaatttttagtactttctctccctcccttttttgtaactgtttcagagaaggtgtgagatcagcaggctgtgaacatcgtgcagtgtgggaaaggggagctgaggcatgggtctctgtctccttggccctgggagaagggattttggtgggagctgggggagtgtttgggtgtcatcttggggagcatgttggggagtgtgtgggatcaacattcccaccaccttcctccctgtcacctgggtgctggcttctggaaggctcagccctgcaggtccatagcaggactttcctggctgtgccrtacaaagtacctgacgatgagattgcttggaagggcatggggaggagccagtgacagatgtggtgggatccatagaaagggctgctgtggagcctctgcgtattactcaggagcacctactgagttttctgtacagcctttgttttgccctctggaaaatgccaccaggagctctaaccttactgtgatcaccctttgccattcagtgcctgcctccattccatctgacagctttagatatttgaacagtcctcttgctgacagctgtgtggagcaggagtgtcctgttcgcatgccaagtactcagactctgggaagacagagataatgaacttccttttcaccccagtgattgcctccgagttcagaactctgtgccctcgcatcaggctgtggctgagcctccaacttgctttgctcccttggcccagcatctctccccttcctgtctactttctcaaccactgctgggagaccttcctaaagcatagctttgctcatgttatccgctgggcagaaaccatccatgggtctcagtgctcatgagaggagggggcagagctggctcagcggcactctgtggggaaaggactcgggttatgttaagaaagtgagattgctgccaaaagggatcccaccctctgggcctgctgtgactgggattccaggccttgaataagattcagacagtcccatttttaaattcagctctggctagactgcctctgcagtgtttttgaaatgggtgctaccttagaagagcaaaaaggagtagtctcagatacaatygtccagaataactagggtttaatctaaagagtgagttaccaggaaatgagagaaggagtgaggacataggcctggagaagcgaataattccagaagcaagtgacatttgtcttggaacacttgaagggcagtcttgaagctacactaagagagggttactttgtgtagctccaagttcagggatgggctgtgctgccctcactgcaagagttcatatagatgctgggatgagcttcgcccaggaacactgtgttcctggagtttgggcttgattttctaagatcatatccaacttgaagtttatcagttcaccctttcctgccacatacatttatcgagtacctactacatgccaagcaccttagtttgtgttatactggaaaggcagcacaggctttgccctcagagaactcagtctagtagggaaaaacagataagaaaactgaattataagatagaagactgagggaaagggtggtttgggaaaccttcctgaagcaagtgcatgctgaacagtgttgaggaggagcagtttaaacctagccagggtgaggtgcatgcgagagccctgaaatgtgaaagctgggcacctgcaggaaaccaaaattagttcaggtgactggagggtggcaggcggaggcgtggcaagaggctggaagacaaggtggaagacagatcatgacattattctaaagtcagcatggaaggattggaggattttaaatgagaagctataagccagacttggattttagaaagatcactctagtaatggtctggagagaagaatacgggaggaaggggtagggaggcagagagaaaccagtaggtattcttgtgaaaaattatgaggacgttggcagtagggatagagaaatgaaactgttaatagagaaaaagctatggagttcctacaagacggtcttttgggaaagacagaagaggtgacatttaagttgagacctggaagatgagaataaaacagtcacgtgtagatgtgagaccaagagagctccaaattgaaggactagcgaagcccttgaaacagaattaagcctggagcattcaagaaacagagaaggctgttgtgcccagatcacagagatcagtggagacagcctgaatcttgcagggcctgggagaggtttgttcctgggaaaggtttgggctgttactgcaagtgtaatgagaagctagggagctataagcaaattggtctgacttacaccctagaaatttcactccactgtgtaaagaatggattrcacagaatatgtgcaggctggaggccttgtagggagctgttggagagtggaaatgcccagcagggtaccaggtatgcaaggagagaggtctgtcctggagataaagactgggagtcatttgcatccaagtgatagttgggcacttcrtttcagtaaggccttttagggagtgagtgtggattgaaaataaaagtggggaaaggcaagtatgaaactttaggaaatgtggcttttaaagggaagtggaggaagaggagtagccaaaggagaaaaggataactcagaaggaaagggaggaatttcaaggagagggtactaaacactacagagttattataaagtgctgcaatacaataccgacaagtacatcttgaatttggagacctgcgggcctctgatgccctgtaatgagtcattttcacggagtgaggaggacagcagccaggggcagcaggctgggtaggtagagggtacaaatgtgcaccagcttcagaagctggaccagggaagtgaggaggctaaggaggggccacagagatgcagggaagagctgtgtcagaagagagcacacaaaaagttgaggaaacaggagagggggtcatcacagagctgctgaaggcgtgggatgcagagcatcgacattcttctgcaatgtgagaaaaagggtcaccagcttttaggagacttcagtccacattggtattagaaagttttgattgtttaaaataaggatctctaatgattatggaagagctattttttttttctgtatttgttgacctttagtcatgtttgaagtttagcaatcagaacatgtactacagctcttaatttgaatgtaaactcaccatccaggcccacctagacagggtcacaaagagttgcttttgtgaagagctctcaatatttttgccaacttcagaaggttaggaagatactgcaaacaaccttgcttttttttttaagtttttttttttgtgtgtgattataaggaatatatttccattggaaaaaaaaatcaagaaaatacagataagcataaagataatacagataacttgtaattccactacctaaagacaatcactgttaccattttggtatatttccttctagtcttttttttccttttgaatgtattttacactgttgaattaatattttagataaaatattttccctttaaagttatactgcttttcctcttaagactatatgatgccttttccattgtattaaaagttctgtagaaataacatttaatagcatttaaaaggctgtgtaatattccattgagtgcaccatactttgctcaaccattcccctactgttaaaacactaaagactttctgtggaaaaccagtatggcagttcctcaaaaaattaaacataatatgattaaccatataaaccaaattgaaccataaaaattaaaccatatgattcagcaattccacttctgggtatgtacccaaaggaattgaaagcagggacttgaacagatttgtacacccatgttcacagcagcattattcacaataaccaaaaggtttcagaagcaacccaagtgttcactgatggaggaatggataaacaaaatgtggtctgaacatacaatggaacagtattcagccttagaaacgaaggtaggcctgacacatgctacagcatggatgaaccttggaaacatgatgccaagtgaaataagccaggcacaaaaggacaaatactatgtgattccactcatattaggtacttagagtggtcagattcacaggcagaaagcagaagatggttgccagggggctagcaggaggggagagttattgtttaatggtacagagtttcagttagggcagatgaaaaagttctggagatgagtggtagtgatggttgtacaacaataggaatgtacttaatgccgcagaactctacactaaaaatggtttaaaatggcaaatttcatgttatgtatagtttaccacaattaaaaatcttaatactgacatttttttgaagttgggtttattggggtataatttgcatttagcaaaatccattcttcttagatatacaactctgtgttttgacaaatgtatatagttggctaactactaccataatcaagatatagaatatttctatcaccccccaaattccttccagcctctttctagttaatcttttctcttcatcctcagcctctagtaactgctgattttttgttcttatagttttgccttttctagaatgtcataaatgggawgaggagtctacagcctttttggcttcttgcactttgcataatgcttttgagattcatccatgttgctgcatatatctgtagttcatttctctttatttctgcctagtattcagttgtatggatgatcacaatttgtttattcaccaatcgagggwcatttcagttgttttcagtttggggcaattatgaatgtagctgtgataaataactattcattgctgggtcaaatggtaagtatatgtataactctgtaaggagctgccaaactgttttccaaaatgggtgtattattttgcattcccgtcagcaatatatgagagttacagttgctccacgttctaagcagcatttaatattatcaggctttttattgttttggtttggtttgtttttagccttctaataagtgtgtagtaataactattgtggttttaatttgcatttctctaatgattaataatgtcccatcttttcatgtgcttatttattctccttatctctcattgctgaagtgacctgttcacttcttttggccattttttaattaggttgcttgttttattatttagttgtagatgatttttaaattttttgctattatagataatgcttcartgaacaacattgtatgtgaaaatattgccctcactttgggtctatacttataataatttcctaaagctactaaatcaaagagagtgaacatcttcaccatccttatatgcccatagtccaacagctcttcaaaaccattgcaccaattcactgtcctactggtggcagtttaataggcatgacaggccattgtgttgtcttaattggaatttgtttgattataatgctatggaactttttttcatatgattattaaacagtctgtgtttcttcttttgtgagtcatcatcccttgccttttttgatactggattgacatagaaatttgccatggctgtatctctacaggattagttctacagtatgtgatgctccatgccaggatcagcagtttacagtattttcataaaatcttaacttggtcttagcctcgtttctttcactttcggaggtcacgagttaatttgcgtagctggcaaggtaaaaataagagttgaagagaaagatttttgccctcaagttaaacttggacactgggtgtcagcacttctgtgagaggcagacatctctctgttgttcctaataaatagaaaaagtgttcttttaaattcctctctgagaaaatggccatgccacttagtttccctgttgtgagagtaacctcttgattcctctaacaactcagcattttatgtgttcacaatgaaagtacaattaaaatcacttacttcatgcttgcatagctctatcaaatagattcaggcagcaaacagttcctgtatataggcacaattcttttttaattattaaaattgcttatcttttattttattccaaatagatggtatgggatgtgatatgactcagaagtactagaatgaattttgacttaataactctaaaaataaaaagcattttgttttctctgacaaatagctctcgttcattttgatgctcgacagacagctgatattttataaaactttatgattgcctcttcatcaagcactgtaattgtaggtttgtcttctttgcaagtatggrgaactgggtattttcttttaaatacttgtcatcctaggaggcggattgcctatgcctgtcatgcaaatcaacttttcaggcatcataggcagaactaggaaagtagaacaatggaaaaatatatatttttgtctaaaatttatggatctgtgacttgcctgaaagagttatttgagaaggtttttataaactcaaacagatcctttaaactagatatttcccagactgcccaaaaaagggccsctgtcccccaataccacacaacactatgagaaagtagaattttattgcttgggtttttcttttcctcatactttgaaagatctctttggccagctttccattcagtgttaacccacactcgtcagtgtttgatgtcatgagaagaggactctggcttgctcaaggatcatgagtgagtaaatttttcagtcttccagaaggggaaaaggaagcatcattttggtatcttagggattaagacacttgctaacatgatatcaagaaaaaagcttgcacactctccaattggtatactggctccatgccagttacatagttttgggtttttccttgtttttcatgtacaaggatacctcagagaatggttgtttggctccagaccactgcagtgaaacaaatatctcaagaaagtcacataaattctttggttttccagtgcatataagagttatgtttacactatagtgtaacttatacatatagtgtagtctattaagtgtgcagtagcattatgtgaaaaacaatgtacatctcttaaaaatactttattgctaagaaatgctcatgattatctaagcattcagtgagttgtaatctttttgctcctggtagatcttacctggatgttaatagctgctgactgattagggtgctggttgctaaagggtggagtggctgtggaaatttcttaaaataagacaagaacaaactttgctgtatccgttgactcttcctttcatgaaatatttttctgttgcttgtgatactggtttatagcatttgtctcacagtagaatttctttcaaaattggagtcaattctctcaaactctgctgctgctttatcaactaatttcatgtaatattataaatcctttgttgtcattttaacaatgttcacagcatcttcatcaggagtagattttacctcaagaaactactttctttgcttattcataagaagcagttcttactgtgaaagttttatgagattgcagcaattcagtcacatcttcaggatccatttctgattctagttctcttgctattcttaccacatcttcagttacttcctccactgaagttttcaactcctcaaagtcatacataagagttggaatcaacttcttccaaattcttgtttatgttggtcttttgacctcttcctatgaatcatgaatgttcttaatggcatgtagaatggtgagtcctttccagaaggttccaattgactgtgaccagatccatcagaggaatcatgatctatggcagctgtagtcttctgagatgttatttcttaaatagtatgacttgaaagtcgaaattacttcttgatccatggactgcagagtggatgttgtgttagcaggtatgaaaaccacattaatctttgtttccatcagtgctcttggtacactgtcaatgagctgtaatattttgaaaggaatctttttttttttttctgagcaggtctcaacagtgggcttaaaatattcrggaaaccatgctgtaaagagatgtgctgtcacayaggctttgctgttccatttatagagcacaggcagagtagatttagcataatttttaagggccctaggatttttggaatggtcagtgagcattggtgtcaccttaagtcactaactgcatttacccataacaagagagtcagcctgtcttttgaggctcttataagtctggccacaccagttttaccatctttcactttggtttcttatctagatggtattatctatatggaataggcaagtgggttattgtgagtgacagaaacctaacttggactagtttgagcaaggaggtacttttcagggaaatgatgtttcacaaaactgccacrctgcaggcagaattagaaaataggccttgggaattrcagaaatagggctccaggtccaccagaattatttcctcttttcattccctcttggccctgtaagattggctttatttttctctctcactgtagccagttttcttctggaagagaaaacatggatagtgacagctcttgagccttttagcttatggcttcagctgcttcagaagagatcaaccaaactctattggtcctaactccaaacatccagggaaggaacttcctgcccctgatcctgttaactgtggccagtagtgccatgtaagagcactgaaatttttggaaagaccttagggatgaagtattgttgtcagaggaagaggagggactggtagtaaaaacaataggtgtacattctttgtgggcagtgctggattatatagctaatcatggggcttggatactggagttcattagtgcatcttgtaacaaggccacttttgggggtgtggctcccacatggataattagctggatcctggtcttcagctgtgtcctgctctatccctgactagccatctcacaactgcttgttcctggtcctgggggggtacctgcggagagaaagtgtgtgggtggtagatcaacagaaatccctcgccactgctagaaaaacaactcaaagaacatgtatttatgtagatgatttcttataatgtgggatttccctctccagcaattttcctttgccaactctctgaagcacagttttggtaacattcatatgatgctgcaatcataggataccataaagctctgcagagaggcaactctggttgtcctagagaatgcatttgtcaaatatatgtgcctttgggatatattactagctattagccattatctttcgtagcttttgaaagcactccaaatttggaatctaaatttctgggtttgagtctcagcttgatcacgtattatctcagtgacctggagctagctagtttctctctctgaaccttaattctcaaacttataaaattgggatagtggtacctgtatggaacagggctatataaactgtgaaacaacaataagaaatgtttctttttctttttgttatcacctgggcctgaatgacagagtttttctccatctcttggcatttctcctagctgtgtctgagtgaataatcagggactttctcagaaaagagaaggaaatgcaggaccattggtaggaacttgacctttgtttctatcatactgaggttaagcaaactctttatttctgtattcttcgtctggcatcctttggggaacctcttcttgaggttaaggtgagatgaaggcttcctttggagacacgttcaggccaagcttcaygctctgaggagttgtttcaggaagaaagagagaggagctatgtgtatgttctcccagtgtgaatagggactaatgtgaaacatatgccattgcctttaatcaggctattaagcatttctcagttttgatggaacctctatctgagaggttcacctatagcagtggttctcaactaggggtgatttttgcttcccagaggacatttgacaatgtctggagatgttgttggttgtcattgctgggtgaggtgggagggggttggcaggaggggttgccacaggtatctagtggttagaggccagagatgctgctaaatacactactaccatgcataaggcagctccccaccaccaattgtctgtccccaaacatcaatacaacatcttcttcttagtgtggtggttttgattgttgagctttcttttggtggagaaggagaaaggatttttaggccatgatttttattctcatcaaaaggcatatattgagaccacttcatacccgctaggatttttctgaaatttaattatgaatgccattttaaattccagaaggggttgccttacttttgttaaatacagtactctttattccctcctagaaatggcacagatctctcttggagagggcaaggtgactctactccccttctcatcctcttaagaaatatcatggcttcttatctgttatatattgtctgtggtcttagaagaaagtctgtgctccagtttggccataaattaactcagagccatatgtattgagcaatataccccaycaagctgtaaaacaaatgaacaaatggaaaacaacaaaagaaactccaaaccaaccaaccaatcagaaacaggtcactgccccatgacagttttgaagtgtgtgtgaaagaggagaaagagctttaagactgtccattctggagggcagcaagatgttgttgcttcrggtagcataagagggaacagattctcttctacaatgccatgtttgtggttcttggaaaagcacagcaaaacctttcaaggcaaactgtttcatcattctgggataacaccaagaagctgcatggtgctattaaagcagccattcatgttggtctgccttgtcttctgtagaggtgggttttttaaactgtggatcagctcctttggagggtcatgaaatgcatttagttgattaaaaccttaagtaaggaagaattgaagagaaaacatgagtacatcacacaaataaagagtactgttttatgaaacattatgtaattttatgtatgtgtgtatatatatatacacacatatatatacacacacacacatctggcttgtgatgtaaaatacattgcttaatgtaggctatgatcaaaaaggcttgaaaatcaccactttatatgcttttacctttgttctagaacataggtcaattgaagcccaaagtgtattttctgttctaactcaggggcctgagtttcattacctgcttacctgctcattcctaaaccagtcactacccaggacagtggatgatttgcttatacgaatctacattcacccacaggggagtctggagagctgcctggcctccccagcatgcatgttgtcagggaaggctgctgcagagaaggcagccagcacagccgccccaggaatggcctgtggggatagagaaagtagcattagtttaggtacagagaccaaggtaaacacccagttatggcaactggggctggggcttggggagaaggtaaaagaccaatagttaatcaggaaaattcttttgagcttagagtagcagtgtggttaacctggtgttccattgccaaatttaagcctggagttctttgaacactgccaggcttggtccaaaacattaatacagcctataaaattttccttctgtgacatttcccagtctctccagatctgttcattcattcattcattcatttatttttgagacagagtctttctctgctgcccagactggagtgcagtggcatgatcgtgattcactgcagcctctatctcctggggttrtgattctcccacctcagcctcccaagtagcagggactacagacacatgccaccatgcccagcttatttttatttattttcatagagattcgtagagataggttcttgtcatgttgtccacgctggccttgaagtcctgggcccaagcaattcctccaacttggcctccattaagtgctgggattacaggcgtgagccactgtgcctggccctcttcggactccttactgtctactctcccctgattcattaggtttcagccacaccagccttgtttcagtttttcagatatgctggtttcttttgtgcctcaagactttctgtgcaggcctttttctgcatctgggatgttcttcccacattgtttcctctgacctactccagcttcactttttagctcatctgccacttccacagtgaagcttccttccctgacctttcrcttatcataattgagacctatttaatgtatgtctctttcattaagtatcgcaaggacagccatgatcaccatcttctctactgtaatgccagggcctgctgcatggcatatggtcagaagtatctcgattgtagagtaagtcttgggctctgggatggagctaagcctgatggcatcaaggggccccggcagagtaggtggggaggaagaggcagcttgcagccatctgggctgggcttgacatcttttacacctttcccagcctcgtcctcttccctcagatatatttccttggtcaagttgattttctttggcttatctctatgtgaacagtttaatacacagggactttttaaaaaataaaatgaagtaaagtctccagaaattgattcccaaatcaaatcacacttcagtaatttaaaagaaatagagagcaaaacatcatgtgtaattcagtagatttttgatagatcataattacttacacatgtggctacaccccctttaatttggatatccaattattaggtgtcatgggcccagtcacagctccgtggatgcgtctgtggatgagtccaactaatctgcaattggaaatgtattaacacccacttctccttgagcgaagggcatttctagagcattactgttgcatattgttccagaaggagccatagtgtgtggaaatgggaaagatggtttctgccatcagggagctggttttgaactgagttacgaggatctaactcattaatgatcagacccatgttctaagatataagaactgtatgtaattgggagttaaacatagagcagctctctggatgttgagaggaagggagattggtgtgagctacagaagcatagcaccatcagggcaggtgttggctcacagagttagagccaggaggggtctgagaggtccgtttatctgatcatttcattttatagataaggaaactgatatattatttctcttcttcctctgtaacacctaattattttctatgagccaaactgtagtagactttttttttttttaaagttcttcctcattcagcttccccagtggcaccagttttcccttttgggaagatcttattgtgtgttcctcggggggagtcttgctcaccttggaagtggtaggggatttgggtgcagggggacttaaccttgaccacacgcttcttctgactttactcttaagctgatgatgcaacaacagcaagacagttgatgtttataatcataccaatagccacagtggcctaagaatcagatttcccagaatctctgacctttgccaagtgtattagtttcctatagcttctgtaacaaatgaccacaaatttggtggcttaaagcaacacgtgtattttcttacagttctggaagtcagaagtctaaaatcactttcactaggctaaaatccagggttgtgcttcccatctctcctccccagaggctttagttcrkttctttgcctctcccagcttctagagctacattcttgtgttctttggcccttgggcccttcctctatcttcagagtcagatgcagaataacttgcttctgtccttacattgccttctctctctctagtcaatcttctgcctttttcttgtaagggcacctgtgattgtgcctcgagtccacctggataatccaggttattctttccaccaccagatccttaatcccatctgcaaagtcccttttgccataacaggtaacgttcacagatttctcaattaggacctggatatccctgccccaacaaggtttctgctttcctcttttcccagcctggtcttccaatatcccctcaattctgtgagttcctggtatcttctcagtatacctttttggagggagggagctgatgggtctgcagtttaagacagttgaaatctgtttctgttgtttatgaccaggaacctccatggtaaatcagtgctatgtgcagaactttacaagcattatttttttttaatccttgttttaactttcttaggaaggcactatctcctttttccaggtaagaaaactgtagctcagagtggcaatttcaaaaagcctgacagctagtataggtgatggaactgggatttgaaactagccagtgtgactgaagagcgtgtgccttatccctttctcagaatcctagttcaactagcttttggtcttagaccttttccaaggaggaagtagaatgtcatctgggccctgaggtctgaatcaaattgtttaggcaggggagagaaggcaaaggagaagcattccaggtaggagagaggctggagactaagaagtgaatccaagagatttaaaggaagggacatgacaggtaaagtggaatgacagataaaggaaccaaccacgtatggaatgcttttgaatggacacagcaactcatttatgtcaactacccatgggaatgatattctgactcaactttgtgttggaaattcagcttgtattaggtcccttgctgcctcctcatggcctcctcatcacatgggctggttaaacatctaacatcctttgctagtgttagccttttctcacagatgctgatgaacagcctgtctttcaaaaacttaacaaggttctttgttggtatcgatatgggtaatttctggagcttgggagacatcctggacctaatggtgtaagatctctggcttgtgtctcctttcagaagagaaattggaaatttttttctagggctgggacaatgactaagaagggagctctttatctggtgttttctggttactacttaagtgtaactgatagatttagcaaatgaaaatataagacatccagttaaatttgaattttaggtttcagataaacaatgaatattccatgcattgtacaaayattgcactaaaaattatttatctgaaattcaaacttaactgggtgtcctgcattttggctggcaaccctgaacctatgaccactgtttcagggtattttcaggcatagacttgtacagtgaatgtgcctgtgaaaagatattatagacctggattgacaaggaggctaggaaagaaccccaagttcaaagggartgcaaggttggagaattctttgggcgactaacttggggagagatgatttggttctcattgcccagagcattgcctctgtcttctgttctgctgtgccactgtgctatggccacratgagaaagacttgtgctgcatcatcaggattgtatcaatctccattctcttcctatttgctgacacctaaaagtaaaaacattcaaggtagggttgagccatgatctctaacaggaaatagttattgaacttgactgtgtgcagaacatgatacctgtgctggtggtggtcagagggctgagtgtactctccaactgtcctctgttgtgggggcaaagtgggcattaagcacccccctgtatacagagctttccaccgggctgtgtgcctatagtgacaaaacaaatggaaaacacgcttgtgctcttgaggagcacagatatatgcctcttgggacagcagagagcttaggcttttattaactcaaaattggagttattctcagtggccccactctgattttgtggtgtgtgtgtctctccatgtgtgtatatagaaatattgcagcaatcatcacctgccattaagctacttttgtacatagtaattaggagaggtgcatggagtctggtcctgagagtgagatatggcaagtgatctgtggcgcttggtaatttgtggccttagaatgaagggaagaatgctcacttgcctgtttggggatgaaaactaaaaaatcttgatattttttagcaacacactggactaaggaacagtggaccctcccagcactgggcaaacattacacagcgtaatggcagggtggggaaaggactggatttgacatcagaagagaactgactttaactcctgatcttaccatttattagcaatttaattttttctgagctttggcttgctcttttatgagatggagacaatagcaatatgaggaaaattttgaagatttaatgacataccacttgaaaatgctaactgacagcaagcaccttgtatttgtcactgcggtgtttcccattctcatagcactttgtaactaactctgttataatgcttcatggtgtgttataattatttcttttatgtgtctgtctacttccactagactgagaatcaagggccattttcaactctttacttttccagtagcctcctgattaagccctggtacttacaaggcccatagttttgctgagctgtgtgtacttcaatacttaagctttgctaggaggcaagtctttaacttctgagtttccattctttcctctgtctctctagctctcttactgagaactgggaagatcccacgggacaggatctgtccagtcctcagtaagagtctttcaagaatattaccatctcaacaccagtcagaatggtgattattaaaaagtcaaggaaaaacagatggtagagaaataggaatgcttttacactgttggtgggaatgtaaattagttcaaccactgtggaagacaatgtggtgattcctcaaggacctagaaccagaaataccatttgacccagcaatcccattactgggcatatacccaaaggaatataaatcattctgttatcaagatacatacacatgtatgttcattgcagcactatttgcaaaagcaaagatgtggaatcaacccaaatgcccatcaatgatagactggataaagaagatgtggtacatatacaccatggaatactatgcaaccataaaaaggaatgagatcatgtcctttgtagggacatggatggaactggaagccattatcctcagcaaactaacacagaaacagaaaaccaaacactgcatgttctcactcataagtgggagctgaatgatgagaacacatggacacagggaggggaacaacacacactggggcctctcacgggtaagtgtggggagaggggaagggagagcatcaggagaaataactaatacgtgccgggcttaatacctaggtcacgggttgataggtgcagcaaaccaccatggcacacatttacctatgtaacaaacctgcacattctgcacatgtaactcagaatttaaaatttttaaaaaagaatattagaagatcctcattagactctaaatgcttgagtatagattcccagtattctcctgtgtactcaaacacatgtatgtttgaatagtatcccagcttgctaccctattctcagtaagttctaggatttccttgatgttctctccttttgacctctgcttcaacaaatttattaatttaatcagtgcaattcaagttcaattcatcaagcctttattgagtgcctcttacttgccagtcactgggctaggttttgggggtagagatgagtaaaatggtgcctccattagaagtgtttcagatttagtgggagagacagatgagaaaacagaatttctctaggatgtggttagggcagtgatggaggtggacacgttatgggagcacagaatagggctattttcctttattgtctttttcctctaagaattccattgttgrccaggtatggtggctcacacctgtaatcccagcactttgggaggccgaggcaggcggatcaygaggtcaggagttcgagaccagcctggacagcatggtgaaaccctgtctctactaaaaatacaaaaatcagccaggtttggtggcatatgcctgtaatcccagctactcgggaggctgaggcaagagaatcgcttgaactcaggaagcggaggttgcagtgagctgagatcgtgccattgcactccagcctggatgacagagcaagactctgtctcaaaaaaaaaaaaagaatcccattgtccctgcttactttctaacaggtgaayggggagccggctgtcattcctgcctcaaggagtattggaactgtgggagttaggaagctgccagtggccaatgtgcatcaattaaagacccagttggtagccctcctgcactggrggacagaaaagaacacttggaggcccaggacagcacaaggccacaggctgcatggccctggctgcagtgtggttgggagaatttggggagcaggtagtttcagccaaagactaacttggtgacatgcgcatacctcatggctggctctgtgagacccctgcaacaaatgccacctttttccttccctttttcaagttagctttgcttttgttctctttcccatttctctgacatttgcttctccccccagttcttatttatttcctttgttgtttatatccctacattttcttttactgctcactcttctatcatcttattcttctttccctctaccatttttcccctctacatttgagccttctttgccttttaattttatctttctgcctctatcaccatgttctgaaacataactgttaaactcagggttggagaggaaattttcatttccaacagggctttttatgatatgaaaagagtgtctcatgtgtatctgagtatcctaggaaacagaagtctaatttctaactcatattctgcatactgtgtttgaaagacatcatcatgaaaggagagtctcccacctgggcagcacaggagactgtgctgtgcaccttacctttattacaagaaccagccaaacaatgattccttcttttttgtggttctctatctccacacctatccttgaagtttctctttatctckctctttctctttttctatttctgtcatatttttcagttctattttctatgttgcttctcgttcttttttctctttagtccttccctrcttattagaaattatatgaccccctccttaatgtctttccttggccttggaagatagagtcaaaaggagtgtggaagactccactgccccaagtccccccgtttctgacgacggcatggaagtgtgactcaggagagatggggaagattcagaaaccttgtctagctcttgagattctttatgagtaggatttctttctgcttcttatttttaggtagtatgaacgtagactcagagaatcttaaagttgacaggaatctctattggttgtttarataacctttaccccatgtaggatccctctttacttcctaatgatgctctacaggtagctcccggatacttggagttttgggaagggtgccagcacatgaakccgtccgcttggctgttggcagcactaattgtgtcagttaccgcttgcgattctgttgtcctggtctgtatgatttgtacctaatgattgtatrtctgcttccgagggccatagggcatgcactttccatacagttctttttctgagattgaagacacgtcaaatagtgaaggaagttcaggtaccttctttaatacttgaactatttcagagaggttccatcagaaataaacaaaacaagccatttttgccaccctttgactatagaggaacccagttttctgaatgcctcatttcctgatggttctgagtagctgagattgttctggagggattatgggtgagaaacttcctttcattcttcacagaaagaagaataaaatgagcaagttttaaattaagattttattaatattagtaagctttgcattagccacaatgtctgtgtgtacattatagtttatagaacactcttaatattaaataccatgtcattttatttttataactagaccacgatacccccttattttagagatgacagaagtggggttcatagaggttgagagacttgtgttgagttaccccattctcaacagagtgagtcagacttaaactcagttcttctgctcttaatcttctgctatgtctttcataaatacatatatgtccttgtctctccaaagtccctgcaatgtcatgagattataggaaataagttgtctccttggtgtacacaatctaatagaattatggatttgtatgtgtgtgtatttctggatttggctgtggaacatggaaaaataggaagaaatccaattagggtcaaagagtggtttgtgcaattataaaaatactgatactatgtgaagaccattgaaattcttctccagttgcaagcatcagcataattgatttgtttggtaaaaattctgtcaaggtagagatgagtgagttacttttttactgcagttaatccagagaaatttcctgaaggagatagacaggggaacctaagaaaattttgaaataaaaaaatacaagggcctggtgggttggaaagaggggaaggagttgaaacagggcagagaggagaaaggggacaagtgttggggacaggaatgggacagatgttgtggcccttgtgttttgcttgggatttggaactagggttctggtatgatgataagttttccttctttgcaaagtaaaacccagatggctaaatttaattccacttggagccactggtgattcacccaagctcaggtgcacccacatacagctggcgtcagcgctgtgtgctttccaggctgagcttgcctcagccccgcttcctgcatggaacaagaggggaaaaccagactggtaaccttgacccttctgtgtctctgtctgcagcatcctggccactgcaggaacccacttcaatactcacgtggacctgaggaccctccgggctgtgcgtgtcctgcggcctttgaagctcgtgtcagggatacctagtgagcatctgccattctttctgctctgctaagaactttcttcatgtgtcctcagctggatccaggtctaagggaatttgggataaacaaacaatattcctcctgggaggaagcctcagtggtaataaatagtggagatggagcaatctggtgtaacattttactttacatttaactttttgcaaatataaaagataatagaaaatctttacagaaaatgtggaaagtaaacaacaaaaaagaaaagtgctctttatcttatcactcagaaatcacttttgttaaaatttcaatatttttcatttttcccctgtgcattttaatataattgaaatcgttatgtagattgtagttttatatcctgaaataagtattttattttcctaaccttaaaaattcttggctgagtgcagtggctcacacctgtaatcctagcacttgggaggctgaggtgggtggattgcttgagttcaggaagagtttgagaccagtctgggcaacatggtgaaaccccatctccacaaaaaatagaaaaaagtaaaaaaaatgtagctgagcatggcagctcactcctgtagtcccagctactcaggaagctgaggtgggaggatcacttgggcctgggaggccaaggctgcagtgagccaagatcacgccactgcactccagccttggcgacagaccgacactctgtctcaaaacaaaaaaattcttatatgtgttatgatttatttagccatttttatgttttatgttgctggatggcataaaaaataaaaataggctatttccagtttttctccaactataaatgtgctgcaacaaacacctttttacttaaatctttattcaaatctctgactgttttcttggctagaatcctagaaatgcaatgtgtgggtcaaaggatatggcattttctgaatagtgcttgtactaattgtgcttccccaacagagactgagaactgggtctgagatagagtgaatgggaagatgaactttatcccagctcttgaaggatttacagcctagcagagctgggcytaatttcctttaggaaaggagcacattctaataaatttaatctatcagaggcagacggcagcatggatgaaaccaatgagggaatgaaactaatcctcccctatcagatggtgctgagggacagctgcattggtcattctctgtccttccttctaggcctgcagattgtgttgaagtccatcatgaaggccatggtacctcttctgcagattggccttctgctcttctttgccatcctgatgtttgctatcattggtttggagttctacagtggcaagttacatcgagcrtgcttcatgaacaattcaggtagggtcgttcttttctgtcttctccttttcccttctcccctctgttaactggggtaatttcagggcacttggaggctcattggaaaagtatgtcctattctgaccctggaattagaatcagaagcttctagtcagcagccttttgaggcacagtcaaccaagactagatatcctcacttgacattaatattgcaaagcaaatatgtagttggaagatttcaaatagatggtcttggctcccctatcccatggtcaagggccatgggaatgaacttgaaaagccatctgtctgagccaggcatagtggcacccacctgtagttccagctactccctggaggcttaggcaagaggattgttgaagcccaggagtttgaggccagcctggacaactagtgtctctctgtccctatctctctgtctacaraaaaaaaaagtgcaacctctctgaatatctgaatcaatacccctttactctttgtacagcagcctctgactgaataaataagtactttttgtatagtggcctctctggcccacaggctggtgagatctaggagtccagagtcagagttgggtccctccggatctgtggagacattttcccttcatgatccttctcaccatcttctcgctctctgttttgacccacacgtggtatggaagaactgagggagctctgagcttggtttgcaagtgtgcttgggagattgttagggtacacaaccccaaattctcatatctttgtatttcatttgttcttttcaagttgagttgagtatcctaggaggaaaggagatgggaggcaggctgaagaattccaaataagtaccatgctttttatgaaaagaaccttaaaagaacactttccaccttggatttctattttttatttttatcttttattcaaaaccaggaatccacgctggaaaaacaaggagttaaacccccctaaaaggaccatagtttataactgtccccaagaaacccaggaagaactcagggctcatcctggagtctgaagccagaaaacctcactttgccttttcctcaaagtgtgccgtgtgattcagtcctcttaattcctgtggtacttcaggtgagggtagaggatgaagcttgcagagagcaggggactatgtggaggagaggctccatttttcaggagactgggaaacattggatkgaacacatgatatgtgagctgggaggtgcagagaggccagggaggagagggagcctgagacaaaaaagggcaggcctctttccgtgggggaatggaattgcttgcctatggcttcctggggtcatttccagctcatgcgaaacaccatgtgatttatctcctaccctccaaatgtgtctgcaggtattctagaaggatttgacccccctcacccatgtggtgtgcagggctgcccagctggttatgaatgcaaggactggatcggccccaatgatgggatcacccagtttgataacatcctttttgctgtgctgactgtcttccagtgcatcaccatggaagggtggaccactgtgctgtacaatgtgagtagagctggtggggacctggaaggaggagggaagaaccctggatggaggcttctgtggttgtttggcctggctagtccggggacagggagggctatggatataggtgtattgggatgggaggtgaagactcaactgggataagccttagcagttcataaccctcttttgtctggcctgttgctacgtacaagtacacagcttcttaatacgattaggaaattacatcctatgttggataggtgaacaaattagttaagtcagatcaacttaatagttacagaatatgttggttggacgtggcggtagggtatagtgaagggtactaatgtatgatactggctgcccagtagaattagctggaagccttaaaaaattttatcaccccctcaggatctgggagaatttactaaaaaagaacaaaaagaaaagaaaaaaaaattataccaactgagctccatcccacaccaattaagtaggaatatttaggggtgaaggtcattttagaaaagtcattgacttttctaaaaagcttcctatctgattctcgtatgtagccactgtcaagaactactgcattacacacacataaaaagcatgcttaattgtgagattcaccaggggtgcttgttgaaaattcagattcacagaccccttctctggagattctaattttgtgtagctttgtatagctagtgagctgtgcttttttcaagtgccctggtgattcacatgatcagacatgttgagaaggttctgagttggtctagctgcctgtcagggatgttggggattcctgcatggggacagaaggtagggtgatcatgaagtctcttccatcttccagagtctaattttaataagttakcaaaggcttggtgcagactctatgctcaaaaatgagagtgacttgaggtatgtggtttgatgtacatggatcctaggtgggtaaagcagtttgggcaggtgcttttgaaggactgtacccttacctgcattcagccagcccaccccaaaacagtaactttggaatgatcatgcctcttatgcacgctcccaccgtctgcctttaccttaaggtgccgtctgtttccttcagttcttctctagatctttttagcctgattctatctgtataaaacttattaggtggaacataaggtggcttatacaaagcaccctttagaaagagctttggatataatttacactggagggaaaggaaatgctgtgtctcagaagaaactcgacgagactataatgcccaaagagcaaggattgtgtaaggcctgtaaaaggaagtacttagtagaggtccattgctaacctggatccattcccacataggatgagcaaggcaggactgaagctttgcagaaaagagtcactggctattatgctaaagctctaaagggcagtgaagaagtcccaaggaccagcttacacccagcaagcccagggatgaagtgtgacccagaaagccctggaggacactctgcagttctcaccagctgtgggargcagcaggaaggaggggagggaggcaaggttgatgagtgcagtcactcctcatttgagatgtaaaggttgtcttgaggccatgccactcaaattagccaggcacctctaggaattgcagcactggccctgcagtggctggtgtcacatggagggctttgagagtgatgcatttcaattawatgtgtagactcacctaagtgatgtgataaatgcattgaaagcctgaaaggagaagtgttgcatttgaggatacaggcgtgattgttggtcctctttagccaagattcagatggtactgagaggagaaggagcacagctgaagaaccactcattttttctttattagtttctttgttcattccttcattctttctgtgtttattaactgagcatctattacatgccaagcactgtcctaggcactagggaaatagggagaaaaaagtgccatgattcctgctatcatagtgctctcttcaaatccctctctccccagttacctgtcaaccacaggtttagaagttacacacaggcagagattttgctcctctctctagttttgctcactaaggagggaaggagggaggggaggagatcaagttgcagatactttgaaaccttttattgcatgggtgtccagggcccacagactcacatactctgacttccagcctgtcagtcattgaacttgagtttactgaaggcctcctgctattctgatggctggatttagggctagggggactgttacccaaagactgtctacctgtttggactgtctgctacctgtttggactgttcctacacacacacacacacacacacacacacacacacacacacacttatacacactggttgcgtaccatgaagttaactatgaatgactagtcagcttagtattataaatacatgtatacatatatatgtgtgtgtttctgcatatagaaaaatgactcactaagcatcaccacaaccaccaccaataagatacaaatataaatataactgtattgattttcctttctaccactcctcattctgggaaggcccagttcacccagctgctggatttgttcatgaagagcactaagagagggggatcccctatttcccagccctatgcaccttctattcagtggtgcaacgaacatgtaagatttattgttgttagttacatccaaaccagtaggagaatcttcaggtttacccagtaggaagaagctctcaagcatgtgggctcagtttaacctttttatatgcaatgtaaatgcttccctcatgtttgcctcccttttctgtagcacagactcttcctagatgcctccctatgaccttgtgttgctctgccaatgattactattaacttcatttgcttgtggcttttctcattataatgaattgtaagggggagggttcccattgtcaaggcaacctggagtcacctgtgcttcatttagtctctatccaaatgtcaactgcttggtcaaactccaactatattcttggcttccctccctcctctggtggaaggaatgcaaaactgtcgacagttctggctattgctacctgtttgcactgtctgtcccaaaggtctcctcgacttgcaaactctcttctttacttatttctcgtaacctgataagtatgtcttccacagtacaatgtgttctccttctgatcaatgctcttcattcaacaaatgttactgtggctcgctaaccctcttcacctgggctggaggtggctgagagaagtgactttcttctgattctgatctgagtcttatttctctttgtcattatagttttatgttatctgctgattcagttagctcttttattgtatcaggactaattcccagattgcagaggttcccagtccctgtctgcagttactcacatctttgctcctgaagtctagtatgtttcatttgtatttctgtagttggagttatttctcktcttacttactgttgataaactcatgtagaggcagaaatttcttggaggtgtactgtttctgcagctttgcaggtatgctttccgcatctgttgtgactacttaagatgctccaagctgctatggtggaaggggttttatggacttcattggcttttggcaagaagaggcaactkaaagtctggatgctttctgagagtcttcccaactcctcagaaatcttttggtctataaacaatgactgtggctgtcttttaagttgccttttcacagctgcatatagtcaggatttattaaatggttaacagctattcactttctgtctcattgagattttgctttatgttcctctatgagcatggtgaggcataacatccatctcgcagttgatgaaaaacyaccattctctttatgaagttcctctcattttgtggtatctacagagaatgctttgggttctgagatccatgagactagggaatgtggcttccatctttgcttcagtcttttcctaccacctcctccacattatagtagaactactcaaaactaatttgacaaataggtggcaggagtctatgattatcttatggtgctagagtgataagatgaaccaactgacctaggatcaggtgtatagttcctaaaatttgtagacactgtaattgtgactggtattgtagatactgtaagtgttactgtaattgtaattggtatccaggatcactcatgctctggaataaactggtccccccccygcctcaaacaaccccatctggactgccctgttcttatgtccttgcatgagtctgggatcctgtaatataggtgatgcttggaattggatactagtatctgttcatctgttacttatccatagagggattggtaagtggatcttggaagttactttctttttcccatgacggctgggaggtgaggtgtatgtgcttagtgaggagctatgataacttctttttaattggcagaacaccttgcttgtcaggcttttcatggagaggagagagtagagggagagggaaactatttcctgaactcayagtaaaggcttttcccctctgtttacattcatacataagtatagattcattcactaactcattcattcaccaaataatttttaagtggctactatgtgccaaatactgttctagatgttggtgatacagtagagagtaaaacataggaaagtcccggccctcatggaacttatattctagtgggaaaatgcatatagaacataaggaaaacatatggtatatcagatagtgatagatgctgtggagaaaaaaaatgtggggaaaaagagaacttggttgcaattttaaatggagatgtcaggaggaccacattgagaagatggcattcgaacaaagacttgaagtgggtgggtgagggagtgggccatgtggttatctgggggaagagtctcctgagtcccagatagctgggccagcaagtgcagagatcctgagatggggacgggctgggtgtatttgaagaacagcaaagagcacagtgggttgaactgcagtgagtgaggcggaaagtaggagatggaatagtcagtcagatcatgtggagccctgaaggccattatacagactctggtttttactctgagtgagatgggaaagcaatggagggttttgaggaaaggagtgacatgacctgacttgtgtttgaaaaaggatcactccacctcctttggtagagcaaaagtagaaacagggattcaaatcaaggttatagcaaggatataaaaaaaatgatagaggcttgggccagggaggtagcagcggaggaggtgaaaagtggttggattctgcatatatttttaagtagagctcatgggattcttcgatggattgaatatgagtttgggagaaagcagcaagaagagyggagttgccattaactaagctggggaagaacacaggtaaagtatgttgggaggaagaggagaattgagtttggatgtgttaaatttgccatgctcatttgatacagtagtatagggaagggggtgaataaatgagttcatggtagaaggcttggctggagaaataaatttgggagttttcagtgtatagatggtaaagtattgagactggccaaaaccaccaaggaagtgaatatagacagggaagagaggagattccaggactgagttctgatgttaaggtgaagaggaaaacggttatcagcaaagaagactgagaaggagcagtagggaggtgagaggaaaattagaaacctggtgtcctggggccaagtgaagagcgcgctgcagagggataaagtagaggatgatcaagtcagttctctgaagaagtgtttttcctatcatatgattattcagttaaaaaaggttattactagagtatcttgcaaataatttcttggtcatttgtataaattcatccacagattctcttgaattcacattcatatttactctttcaaaaactcttatctatatgctttgctcatttgaatcaaatgcttcagatgggtcaaggaaggtgagggctaagaaccactgaatgccaggagcagtttgagtggagtaggaaggatttcagagagcaatggaaacagcgtggaagaaataccacttacatgctgatgggaatgatccatttgagataaaaattattgttgatgaaggagagggaggagaattggtggagtgatttccttgaacaggtgtgtgtgtgtggtgtggggaggtctagaccacagatgtagggattggcttagataggagctctaatcatccattcatagtactaggagtagaggaagaacaagtggctgcaaaggctggtacgtgggtagatgtggtgttggaatcttgtagaaattctcttcctattgcttctattttctcaatgaaagaggaagtaaggtcatcagcagagggtggaaggaggaaaatgttgaaagtttgagaaggtataacatagttttccagaagactgagggagtaagtggagtaggaaatgcattgggttgctgggcagctttatggactcacttggagttagttgtgatgaagttcaagtgagaccagtgagcctggtgtgttttcctctggtcacattcagccactgaatatgggaagtaggtggagatttggcttttatgagaatagttttgccagttgagcacaataaaatgagagaagatcaagagagtgactataacatagccatggaatttgagctggataaagagcaaagaggtggcggagaaaccgtgaaaagggaggagagaacgtggattatagaccgtttttraaatgtgactcttagggccgggcgcggtggctcactcctgtaatcccagcactttgggaggccgaggcgggcggatcactaggtcaggagatcgagaccatcctggctaacacggtgaaaccccgtctctactaaaaatataaaaaaatagccgggcgcagtggcgggcgcctgtagtcccagctactcaggaggctgaggcaggrgaatggtgtgaacccgggaggtggagcttgcagtgagccgagatagcgccactgcagtccggcctgggtgaaagagcgagactccgtctcaagraaaaaagaaagaaagaaagaaagaaatgtactcttgaatctgctggacaaattcagtctgtggagtaagttgagaaacctgtctcactgcatagaagtagggagtgggttttgaaaccaaatgttctgatttctaatttgatgctcgcactgcccccagtggaaggagagtgagtgtgtgcatgtgccgcacatgtgcagagtaagctgtgactctgggcgccggcgcaccgctgggccctctgtggcaccactcccagggtgtctggtcctgtttcagctcaattcagaatgtgaacttggggaacatttggggactgaaacccaccaggcccgcccacctacctcactagcattgtactctgtcatcttggtttcctcctcagagtgtctgtctctttttttaaacacacttaacgttgcagcttatgatgctgactttggcagcctgttctgttaatacttgtcctctctaaaccctacagtgccttcttcttggcccctgtctgctgggctgggagcctgtggtccacagccttctccccaccgctccctccctgggaagaaaccggcgttttctttctttctcacacttaactattttcccatccatagcagtctccaccctgaagttattcctactcattgcatttctgtcttggtttgtcaaaccaggatgccatcatgtttgggatttattccaaatgtgctaagtgtgcctcctgatctggtgcctgaatttcacaccacgaaccaggccagtctcctagtcttttgtctgtgcatagccattaggctggctcagggctcctttcctttttgtttcatttactctaatatgcggtttaatttctaatccatggccaaaggcctcaggtgcctgatgtgtcargcagctttgggctatgatcttcctgttctcaggcaacaccaggccttaggactgaggggcagaaattagctggaggtggtgcgttggtgactcaatggctgtttcaggtacttttcactctggaatccaaatgctgacagaatctcagccaggtggggatggcacagtgccagtatatggcacactaggaaagccaagaagtctttattcactgttcctcaattcattattcactcgaagacttatgagcaatttttttcatgcccttcagagtgtggtccatcttggaatcatccaggggtaattattgtaattgcagattcccgggccctgccccagatctggtgggccagcatctctagaggtaggaggaaggaatctgtattttcagcaagctcccatgtgattctgaggccacgctgaagtttgagaaccactgttctacatcaatgtaattgccaggcagtaagagggtgacatggcacataaatgggagagtactgaagaaaaaggcacacttctgccttcaggctgcaagcctactatgtgaatttccatgaggtcatgcgttattcaatgtttgcctaacataaagtgattgacacacagtgggctctcaggaagtagttaatttatggacttaggtcaagaaggggcaataagtcaggtgcatgggtacatacatatacttgtaacaatagggcaaactaaatatagcgaataattgggagatatacaagcagagatctctgggaggattgaggagagagtggataatttaaagtgaactgctgagcctggcttggtggctcacacctgtagtcccagctacctggaaggctgaggcaggaggatctcttgagtccaggagttcaaggctgcagtgtgctatgattgacctatgaatcataggtcagcctgggcaacatagtgagactccatctctaaaaagaaaataaaataaagtgagcttctggacagcccatgtagaaatgtgaaagctggtgaactcaaggggagcccatgatactggattgtagcctgttggacaaagatgtcagagctcttgataacacatcaaaggcatcatttacccactgggtgcttagatgctactttatatttttaccttcctttagggacaaggctcagaaactgacttgaaagttagtttgcccaacccttttggtgggagggaagggttggatgtactaactttcccttaaccatcctctccttagctggtcctcattccatgcctgttgaaaacaatatgcgtagatttacagacctttgcctgcctccagttccctatgttgcagttagatgtcagctgtttggccacagcgaagcttcagctgcagctttccctgttgattgacatgtgtgccctcaattacacctcagttccctcccaaagagagggaaggattgaacaggatcttttctcctttaaggtgccaggtactaggggccccatttacacttctggagagctcttttaaaagggattcctgagaacctccactcttcactgccttccaccttgagccccattgtctgtccacaagaggaaacaggattttgtgcactgatgaggcagcagagtagtggagtcaattacaaaaaaaaaaaaaaaatatatatatatatatatattgtatttgactgatgagtacagctttggtttatcatctgcactggaatatctttgatgttttgggaaatcacaacactcaaatcagataaagaagccacagtgacaggaccaatgccagaggacctgggatatcttctgacttttgtcccctcagcttctcctagtgccccttttcttgagaagcagtgacccaaggcggggcccttccttgcagtgtgcagtcttcctcaccccaggagctggtgggtgggtcacagcacctgtgatagtcagagaggaccacttgaatttctgttctcctgagggtgccttgcaggtgctcccacccctccctcccactctccccactcaccatccccaagccatggccttcactccgaacccaggacttgtcagctggtatctgtggatgggctttgatggcatccataaattttgttgcaagttttgtttttaaaatatatcttttaactaccacattttcttgaatctaagatgccattgattatatactctatcaaaaattgaataattctgttattaaatttaagcattattaaatgttgggggaaaagcyactgctttctatgcattatgtattcatatattctgagttacaaaaccttccactgtaaagaaaggtatattgtagaattgaggaaatagaaaatgaaggaataaaactgattttaaaagccacatgtaatccatgtgttatacaaattttcacacttgaagaccacccacagtcacactggcttaattcttttctttgtggagaccttggagtcaatctccctttgctatctctgcatttatttgagctttgtgtaaatgtggtattgattagaaagcttctagttctgtgttagtctttttaaaagaatcaggccccagcttgtttgcttttataaagtgatgtaagtgatcacactattacctttctgtatgattcaagattttctcaatactgtgaaactaaaataaaatacaaaaataagctggatgccaaagctgattcaagactgcaatagtcatctataaccctggtttcaaatttttatcttccagaaaacaacctcatgttttgagtgatattgaataaatgttctttattatgaatatatttatattaaatatatacaatatatttatgccagaagatgtctcatttttgtaagttttatgcatggatgttctgataaaagttttatttgaaaaaagtgatttctgatgccaaaggtactataacatagtggttaggaatcctggtcttactttactatctatgtgactttggcaacttacttaatctctgtgcctttatttttctatcagtaatgtgaggataattatggtacccacctcactgagttgtagtaagaagtaaggtaacatggataaagcctttgacacatgtctggcacatagcactcatgtgagaaattattagttaaaaagttttgaaaaccatctaggatagacaaagcatcttcttccattggcccactgtataaacctgctcctctcagactggtccttcctgtctctcagtctagccactttacactttccatttgcatcattgccaaccttgagtgtacactcttggaattacctccaaaactctgatgtcgccttctccacagagccttctctgactatccctgagaaattcaaaagagaggagatgcttccctgagccttctcccccagacctaaatgttattagcactccttcccagattctcctgtatcattcatcgtcttctaggtgtttacatcccttttccttattaaatgttctgtctcctggcatcaaccccagtcccctagacatggctaagtattcggtaaatatccactgatggattgatttcacagagtggctgtcggaacccaccaaagatgccatggcttccagactgccaggctgtcgggagatgcagcacaggttctgctctcagagtgagctgctgtccgcagggactatggctgctgcagcctctgcttgtcctgcctcactacagctcagctccctcctccagtgaccggtggggggtggggggtggggaaacaatgaaaagtaggggaaaggtaatttatttcagtgtttacagagggtttgcgtgtaattagcagtttatttctgtgacacagctggcctcctcagcttggaacytgactttgaaatgctcttaaagagaccyatacctaggcaatctgaggggtgctggggacttgggaagagagtgaagaaaaatgtcatgccctgtctttggtgatgatgcttgaccaaggacagccactaaagtgaagactcccttgttccttctttccccaactctcccatgcatgcacacacacacacacaaacacacttttgtttcttgagtcatattctgttagtgaatccaccttcgacttagaccttttacaaggtacattttttttaaccttttgttcacatcaaagcttgggctttgatatcttcactggggataggggaacagtcacttgatcccctcctgccataagccccatgattgcaggcaaaacactgttctcctctttgtaagtattgaatagatgaataaataaatgtgcatcagtcttttcatcagtaatatgggggtaatgctgcctgctgtttctaccttgaaagttttatagcaattacatgagaaaaagtatacgaaagtgctttgaaaaagacgttcagccctcactatatgagtgtactatttttatgactttttgctgctgtgagctgtggacttacaaactcaattttgctaagttagcagtttttttgtgcttatgcagagtgggtgtctggttgcttcgggagcatgtaagacaaattatcctaacatattttctgtctcttagcatcagtttgctgtgtttgttctgtgttgtgagcgtgctcaggtcctgtgatcttggttagaaatacagtatttatattttgtacatattgaaaaacatacctatatttggtgcaaaagtggcactttaatagttcttgctaacttgcataaactgtgaataactggtgaaacctatgttgcagttgcttccaaattcaaacatgtttcagaactttttttctttttgaggtggagtcttgctctgtcgcccaggctggagtgcagtggcatgatctcggttcactgcaacctcctccgctcgggttcaagcgattcttctgcctcagccttctgagtagctgggactacaggcacccaccaccacacccagctaatttttgtatttttagtagagacggggtttcaccatattggccaggctggtttcgaactcctgacctcgtgatccccccgcctcagcctcccaaagtgctgggattacaggtgtgagctaccatgcctggccaaggacatcttaacctttgcaagtgttagggtagacctgacattcatctgtggcagtgttcctgaatgagctggggctgagcccatgagagagtctataccagaatagcataatggaaaaataatggcaatgtagtttttcatgaaactaaatttgttcaacttgaaactggatttaaacattgaaaatgttagtgtcctttcctggcaaaataaaaagttaagaacatcattgcgagcatagatatttttgtctttgttttgtgaaaattttgtgatctgtgaaggctaaaaatctatgctgatatatattttatctatgtaatagatataataggtaaatatattaatataattatataatttacttgcaaatgcataatattgctattagcaggttgagttttcttttccattctagtgatactgagatttttatattaattttaagagaaactggtagtcatttatgtaacctgtcattgaagaatgagtattttagaaaaccacataggctggtatagtgaatgccatttctaagaataaagtagtatcaggcattgggttatattcagaagacctgtatttgggccaagtgtttcacctaggctggagtgcagtggcgtgatcttggcttactgcaacctccacctcccaggttcaagtgattcttgtgccttagcctcctgagtagctaggatcacaggcccctgctaccatgccagactaatttttgtattttaatagagacggggtttcgccatgttggccagactggtcttgaactcctgactgcaagtgatccacctgccatggcctcccaaagtgctgggattacagacatgagccaccgcacctggctgcaagttttgtttcttatccattcttcctgactctgccatggtattaggcaagtcacgtgacctcagtgagactcattttcaacttctattaattaggaacaccaattcagtacttagtgcatacaatggctgtaagaattaaagaaaaatgtatgtgtgagagtgctttgtgcatcaagatgtgccttacgaatttaaggtattataaaaatcctttaaagttatgaacattcatgttaggaagatttctattaytgagatttacaatacaggtttttcacgtatcatttttaaacatgttttgacagatacagtcaatggtatccctcagaagaaaggtagaacgtatattcaaaatattgttaggatatttctctttcctttgtgctcaaagcatcctgatatcatgaccttttcaagtgttttcttgatatgaaacaaagctgccactgcctgagtagtttgtataaaaacatcagatttctaggtgaagcagaaaagaaagggagtgtggagcttgattccttccccaggggtctctatgatgccatccttgaatgaatgatcaaggcgtgtcccccactgcctctgaaggtacttctcgtggctgccaccagctgccttaacaatttggaaggaaaggcaggcccaaagggcagcaggcacatgcacacccaggtgatcacacctccctcgtcccctgcacacatttaagctcttggcagcacatgttccccaggcacaggcggggctggcgtagtcagcaaggctgccacatctctgtcacaagcttccctttctcctagtgttttcagcaggcctgtatctctccaccatcctccccttcccgggtctcccactctcctctctctgtgacaggttctttttccttggcagattgcactggaatggtgtgacagtccctcagggatcatgccacctgcccaagctggggaggaatagcagagaggcatccgtggctggccaggtcaccaagataacactccccacaggcgagggtatccagggctcctgggactgcagattccattgcctcattgagccaggagccttggtctacgctgtaggacctcagtccacccaggaacactaaacttgcctgcctgccacttggcgctactataggcagctgtacctatcagcacaccatgcctgggaaggtgaccacagagagtaattgccagtgtttagtctgtgtgtgcatgtgggtgacagagcgaaaaggaaggtatggacctctcttttatatccaggttatttattgcatttgtcttacgacttccatttagagctaaataaactgcaaagtaggttatttaaactggatcttgggtgctttagcaagtggagaagtgggcggtgaggagggagaaagatgggagattgggccggggagattgagagaaagaggccaaaagaaacacaacgtggcttattttcctccccttggtagtggaaggcatggtgtgctgtggctcacagacagagatcccctttgctgggggatcttgaagagctttctgtctcaggcttttgggaagcagcctcctgtggacatatcttgcttttacaatttataaataaaaaactaaggcacagcctaggagtgcagattgcacaaagcctacagttacctaccgcacctggaagggtagctccccacttctttgcctgcttgtcacggtcacgtgccccctccacctgcgtcggacttgtgcagcctaatagagggcaggtgtacaaggaagaacgtcgttggggcattttatcgtcaccctgtccaaatgaggtttcagggagtctcatctccagagagtagtcttccacccaccatgtacgtgtgtgtgtgtgtgtgtgtgtgtgtgtgtgtgtgtgtgtacacacacatatttaagctcagatgccctgcaggcccagggagctctttgccaagagactcttggtccatccagatcactcgtgaattctcttttgtacagacttgataaagggtgtttcttgagtaccagaagtactgtagtactgtacataattcataacacgaagcaagataaagtagaaagaacaagaaaagataataactggggaattaaaagtttccaacattgttagaagctgggagagtgagtcagcagtacatatgtccttagggagagctttgcacagggctggttttggggtaggggcctaggtgtccaaaaaaggaggaaggagatgctcaggaggagcagaaatagggatgtggaggagaaggggctgagggcagggagaatgggtgcagattgcaagtgggggtgaattctagctctgccctgcctcctcccctccctttgaaggaaagagatatcatggggccttaatcatctccttatctctcattcctttcctggtttaattaaatttctgttctaatttggaagagcttgcatgttctcgactgctgtggcaaccaatctcttttatgagacccaccctggcactcagaggagtttatcacctccatgggacttggaccctctgtagcttttgccatcatggtcagttctgtagtgagcagaggtggatttgagaggagaaaggggctcccttattattgtcaaagtcatcttgtttacaatggcttcagtctgccccttcctcttcttcaccagggagtgaagcctcttctatccatgtatattttttgtgtttcgcattgtgttacctctcctctcccaggacaaaacacacttcgttgggatctctttgaatgttaaataataccgaaaatacagatgaaagacaggaaacgtggataaacgtaccatcagcattcctcttacacctactgtgtgcccaggcacagtgctgggcactctacacgtgtgactgcctcgaaggtgatggatcggtcctcatttgataaatgaggcactgtattagtccgttttcatgctgctataaagacatacctgagactgggcaatttacaaatggaagaggtttaatttgacttacagttccacatggctggggaggcctcacaatcatggcggaaggcatggaggagcaagtcacattttatgcagatggcagcaggcaaaataagagcttgtacagaaaaactcccattttttaagtaatcagatcttgtgagactcattcactgtcacgagaacagcccaggaaagacctgcccccataattcaatcacctcccaccggcttcctcccacgacacgtgggaactgtgggagttacaattcaagatgagatttgggtggggacacagccaaactatatcaggcgcttaaggcttacagaggttaaaggatcctcccaaggtcatacagctgttaaggtagaaagcccaactggaaccttgtcttgtgagctagaaaagcccaggctgtccccactactccctgttagaggaggacgtgagaggagatggatgaatgatttcggcaattcacttcaacttaacggacataccaaacattggagtgccgaccgattaccagggcccgtgttaggcattggatggtggaagagcttttgctcctgccctcagggagacaagacatgcttgtgttcagtggatgccttgaggaagtgttatggtccctttgagcattatggacccattgctgtgkggtataaaggcagtggcggtgttctctctgaggtagccaagaaaggcttcatagagaaaccttgtagacatagaatttcaccagggggagaaggagatcaggacctgggcagaagcgtggtggaggtatgacatttgtgtgccgtgttgaggaagtggccacaataaaggagttggggtggaaaatgcctggagatgagactggggaagagattgggggtgagtgataaaggactgagtgtccattaatgactacagagttccttctatcagggaaatcatctcattacttgaaattatcaatgacttatctgtacatctttttgtctgacactgtccttgttcagtgcccccagggctcaaatgtgggaattagtctaatgaactagagttcatccctttcatgcctcctttggtcttttactgtggcccacatagccctgataatctgtccctggactgctcttctgtcttacttcacgcccttgcctcctccattgactgtgttcccttcaccatgactgctagccgtctaggctctttcctgcttcctggctgtggccacactgtttctgccatttttttttttttaaatttctaaattttgttttaagttcaggggtatatgtgcaggatgtgcatgcaggtttgttacataggtaaacgtatgccatggtgatttgctacacagttcatcccatcacccagataccaagcccagcatccactagctattcttcctgagcctctcccccctccccactcttgccctccgataggccccagtgtgtgttgttcccccctcccatgtgtccatgtgttctcatcatttagctcccacttataagtgagaacatggggcatttggttttccgttcttgtgttagtttgctaaggataacagcctccagctccatccatgtctctgcaaaggacatgatctcattcctttttatggctgcagagtattccatggtgtatatgtaccacatttgctttatccagtctatcattgacgggcatttaggttgattccatgtctttgtattcttcatctggccaatgcctactgatccctcaagcttcatcttaattgttacttccttagagagcactctcctaatcctaatataaattgagtgcttttggtataattttttaaatcacaatcttatttccttcatagcacttatcacctcttgtgtgtgtatttgtgtgaccatttattaagtttctgctctgttaactacactgtaaactctgtaggtgcagggatgtctattatttcatgactattgccagaaccttgcatatcgtgtggcatgtagtaggtgcttagtaaaaaatctggtgatttactggatggatggagtaataaattagtgaatgatataggatcaagctatcagcagggaatattcttatgctcagtgaaaacacaaagcctatgttaaatgaggcaaatttgttggtatttccaattgcatttttttaattcaacaaatatttgttgagcaccgattatagctaggcattgtgctaggagtcagggatatagtgaagaacaagcaaaatcagtccacctggaattcgtattatagtgtgatgatatctattaaacaatttaaaaaataagtgtatactgtcaggtagtgatgagtcatatgaagacaaagcaaaggaaggggcagagagtgttgcagggaggcagtatgcttcagatgaggtggtctgggaaggaggtggtatctgagcagaaatctgcagaagtgggagggaaagccctgggatatctgtggaagagcattccagatggagagccagcaagtgcagggacccaaagtggttgcttggcaggttcagggagtgtccaacaggccagggaggcttgagcactctgaggggcaagaggtcagagagagggtcagggccagatcaggttgggcctcgttgactgtgattaggagtttggattttactccgagtgtgatgggaagtctttgaggtgctttgaacagatgaggtagaagatctgatatatgctgaaagatcactctacctgctgtatggagaactggccatggcagggcaagagtggaggcgggcagctggcagtggtggtgcagcctggaatggctctgctggtggggctgagcagtgattagattgggatgtgttttgaaggtggagctggcaggacttgttaatgggttgaatgtggggtaggagagatgggaagatcaaggagggctcttcagctacattaatctgttaatagcrgtgccatctaccaagataggggagccgagagaaggggcaggatggttgagcaaggtcaagagttgagctggaggcatgttaaattggagtggcctaattgatgtctatgagatagcccagttmgagatgtcataagaagtaagtagctggacatctgagtctggagctgggtcagagcaagagatatacacttgagaaacattaatttattaatggtgttttgaatcatgagatggactgatgtcccttagtcttgaagaaggcatagmcagagaagaggaccaacgacttagctctgagaaactacaacttaatgtctattagcactgcagtaggtctattactaaggccctgagaacttgatcatcttctcttggggctatttcttctggaattgagcccaaatttagtgttgttgctccttttaggaagttattatgacaggggctactttgccataggggatgaaaataggaattcccactaccaccccatgggctagctgaaggtgcagggcaggtagagattcgggtgtggagggagctcttcagtctgagtctgttctgttttggttcattttccttttgtctgctgttcttctcctgtgaaaattgttttccctcaagctgatgtttttaaagcttaatttttatttctgtaactgtactccttttcattctacaaacctttattgagggcctgccatgtgctagacactgctcagaactgctaagtgctgggatgctccctttccaaacacacggctcctccccgtgattcttttcctgctcaaagccatctgctctctcccacctggtcctcattttattgatggctattacatcatctacctgtccatcatttttcatacctcttatatcattattagatgttctagctaccaagtcttggaaccagtcttcccattttgtcttacaccccacatttaactcatcagtagctcctttggctctatattcaacatttatccagaatctgcctaccaatcctgacctccagcgctgcaccctggtctaagccaccaccatctcttgcctgagttagtgcagtctctccctgattgcatcattaccccacttcagaacatccttatgatcctggcagtgtaaatcagaccatgtccccgctctgcacagaaccctccagtagctcctcttcccttgctgagtaaaagccagagcccttgcaagggtctacagggccctccatgatctgctcttccactcccttctgcttcttgccttaatctgctccagcacagtagccctcttgctgcagatgacatgttgggcatgcttctgccttggatggaaccttgctaacatgggtcttgctggaacattcttcccagttatcagggtgggctcactctttcccgtcctctggtctttactcggtgagttctttcctgaccatcgtatttaaaatcaaacctcctccttcccagtactctcttaactccctttcagatgtatttctctccagagagcttatcactagcgaccacagtatatactttgcctgtttattttgtctattggctaagtgatcccactagagtacaagcttcatgagggcaggacttttgtctcacacactgctgcaaacagttgatgctcaggttagtacctggcagaaggtaagtacagattgagttacttttcattggaaatgcttgggacaagaagtgtttcagatttaggattttttcagattttggaatatttgtattatattggttgagcatcccaaatccaaaaatgtgaaatctgaaatgctccaatgagcatttcttgggccatcatgttggttctcaaaaagttttggattttgaaagatttcagatttcagatttttggatttgggatgctcaacctgtatttaataaatatttgctgaatgaataaatgacagaacatgagttcatgggatgggagggtggtcaatgcactgtatttgttctagttactgttactctcatagtctttgcactaggccctttggtgacaagtgggctgcatttgtgagatggttggatgccattagggacctaagctgtgttctcagaatagcattgccacactagaagccagttggccttagcaagttgaaccatttgctgggatgtccttagtattattaggcaaactgatcatccaaggtttagggttagatgaatccacaaaagagctcattgaggttgtattaataaaaacaaccattcattgagtccacaagatccatacttacgcatgaaaattactctaggatctcttgctgggggataggtgggggatcagaattgccaagggtgtcctcatgaggaggcctccatccagcctcaacaagccttaaacacctcattcaggtgccgtarsaagccttaaacacctctgggtagggtttgaatctgtaaatgaatcagaggtaaatgaatcttaaaacctactggccttaagaattggaaggccccttgcttatatccttggggatatttactgtggtgaaaggatgagggtaaggaatgatagcaaacattcacagagcacatattatatgccaggcgctgttctaagagcgctctgtggatataaacccagttaattttcccaatagccctttgaggtagaaagattatattcccattttacagttgagaaaaccaaggctgcctgtctgcagggtctttgctcttgttgattatgttacaaccatctcaaaagaagtgttgttctagggccatttaggatgatacactgatgtttaatacacttatgtgttacattttgatgtgtggtattgttgtggggagtagctagctgtgtgtggaaacggacttttcatgaggcatgcatgtgtgaacactgtaattagtatttccaagagagaaaagcaaccccctcccccgcccccgccaacaccccaacactgyacctacccggagactttgctcgtgacacatttttttttccccataggagagaatgttaaagtagggccatctcttagatgaaagtcctagaggctttgggacatatgaagactggtcagatgctattgagcatttctcacctttgatcctctgttctgaggaattcttgatagcctaggactaatctatagttctcagaggggccagttgtcttgttgcctcctgttctcgcctcygcctgcctgtctccctggctctgagtctctggtgatatgtactggctcaccgtcaggtgttgggggatggggaggcggctgtgcagctgccgccgagctgctcacttggtaggagaagtgtgccactaagtgaaaatgaggcttggcgactgccctgtgacccactgccctctgtaccttgcccttccctgtgggtggcagagctagacagccattctcatcctggaaacgctggttttaagggagaggccagtcttcttgtgtttgctgcacccatcctgacttggaaggaaggtctttgktgactccatgaatggcacccaggggtccagtcttcaagttccattgctttctctggcctgtggctcatgactaattccaccccaaccttgtctcagactggggtcccactcaccaccagggcgtgagcttttggggaaccctccctgcttgtcagcccttcttttggaggagtaaccaggacccccagaccccacttttagatatccgggttcaatataacacatagaactttcccctcttcttctgggcaagcttgagatggtgtttttcatgaaaagggccagctgagggatcgtttcagagaagcccaggttggctacactttccttaggatgagactgggacatggaaagtgggaggagaaggagcagttgggtttggcccttgcaggcagtattttcctctggactaggagatcctctgcacagtgccaggcctcacactgcatgtaattaggcttctaatgccattttctattgacaagggcaagctgctgccaagtcacttgagatgaaattgggtcacctgtcacaattcctgtgggactgaggtagaactgtgcttactacacactttgccctattttaacctctgactggatctgatcccatatcttagctggaggaggagatgagggaggagcgggggcctctcagagccactctgatcctcatagggtgggaacttggcccggggatgccttgcttaacctagcggggagtttcttaacagaggtcagagtgaatcttttatccctttctaagtccaatttgtaggacatggggaagacagtgaccccaaattcccagtgtgggagacatgagagaggcctcatttgtcactctgagtcaggaggaggaacgggcagttatttgtcttctctcagaaagccacgctgtctagttgatagctcttctctgagaatggaaataaggagagctgtccagagattgagtgagggaggagagggagagaaaagaaagtgcttttgagtgtgtgcatgcatgctcatacattcacgtgcttaacttaggaggcaatttcggaggaaacagagagaaagaaattagaacaagcaggaagagttccaagatgggggagaaaggggcataacatggacaaaagcctgcctaaagaagcagtgaatggaccacatgcaattggggagacagaagcagaagaaaaaggggagggtggggtgggggagaaagcaggtgggggctgggaagttctgcctatgtgcattgtcttccaggtgcttttgtaagcctgagccatgcccaaggcagcactggcagctcaagctcaggccaaacacacacgagaagagtatcgtattgtgtttccttttcttcgtgtttttgaaacaggaataaaaactaccaaaagagaaacacaggaaaaaaaaatagaaagggaaaaaaatctattcaaggaggcatgaagatttaatcaacacccagtgttcttagcaggtcgggagcaagcacaaatcgtattgtctatgcagctatttctgacaccccccagcagccctcagagcaacctctgccactgcccagagtctgggaggcagttcctgggttccagtgtcctgggctattttgggtgggaagaattgctgagccagtcaagggaatggggtacagggtgtgtcatcttcttgaggagcttctcagcatatagagatttccggctttacatggtaggtatttgtccagatggagattttggcattgacatttatcctaatgtgctggatataaacttgggggtaattcgggaatttaaaactcagccatgttaccttcagtacagtatatggatcaatctcttctgctttatctctcagtggcattcaacacggttgctttctctctctttaaaattcatgactttggtgccattacaccgtcctgtttccatccgtctttctggttgcttcttctcctttggggctctcatttattctcactccctctccttctaggagatctttttgaagtctcttgactatacaccaatgagttgaatttctatttccagcccagaactctcttctgagctccagactcatatctaatcagctactgttagcaccgttctaaatacctgagactaccaagccttcaactgagggcttgatccctctgttgttctctttcccacctgcctgtcctagtaaaacagctctaccacctacggagttgcccaagccaaaaacctcacattgtccttctttttccctactccttcaccctcttgttttctgtctgccatcaaacagcaggtcgtatggatgctacctccaaaatatatccccggctgcgcccagtcctccctccccattacatctaccctgacctggccaccatcttctttgcccctgatgactgcagcagcctcttgactgtctttccagctttcttccttatttctcttcaatccattctctactccatggccagaaggatttttaaacaatgcaaatgtcctatgtcacttccctttttataaaaccctttactggattcatttgaaatacagacccaaagctaacatgatccataagacgagtggcctctgccagcctttccagccttgcccttgttttacccatgctggcttgtgtcagaatcagcccccaacccgactccatcaacctcagaacctttggacatgctgtcctgcatgcatgagggtttcttccttcggcggcccctcccatttgggctaattcctacttattgtttccatctcagtgtaaaggacatatcctctggaaaatccactctgatcattgaccctaaacaaagtcagtccctctcagaaatcacactcatgaccctttcaatttttctttggaatacttaccaccattgtaacactccagttgtttttggaatgtttaataccattctacctactaaacctaagctccatgagagcagggccatgtctgtcctgttcactgtggtgtctccaggatatggcaccctggatggtccatcgtagaggttgaataaatgagtgaatctatctcgaacacttttgtgcctagggctttgattcaagcacaaggtgagagtggagcagggtgggatgttctaaaagacagaataaagaattcttgtccttaaggcccctcctacctagtcctgttctgttttgtgttatgattatcagctatgtgtatataaactttcaccaaataaagattgttgctttttgaggattacgtcttaaattttgttgtcacactcactaggtttcatttccttggatgttttatagacatgtatgtacctttcagtccctgtctaggtggatgcaccttcctccccttcccactggtctgtatccttgcgatcccagcgtgtgcggtagcctgaactgcttgagttatgacagcctaagagctgggcgttcctggccatggctcttattctctagaagcttcagcctttctgcaaaatgcgaatgagattattaatggtaataataccttgtctatctttcagggttgttgtgaggaaaagatgagttcatttatgtcaaatactttgaaaactacaaagctccatgagagtgttggaattaagtaaggatgctggggagtgacgagagatgagcaattgctcttaactacagagaagaaagtttcctgcaggaggtggagattaggaatgaggctggaaagatggtgtttcaggcagcatcctggcaggaaatggaaggcaacttcagctgggttttgaagagggtttagtaatggtaccatttcagggatgtggacaggaatatgggactgagaagccatacttagaccctggggattagctattgtgggatgtcatttctagtcctgggcctgaaggagcaaggtgaggaaatgaggttgttagagcctggtgaggaaggaagaggggctgcctgaccgtgaccacagagggacctcaacctgcctgaattgccacactgatgcttctggtgccacctcttagaaactagagggctagggagctgggtgatgcagtttgtagggcctcacatctcagggmacagagaagggtggaaagtaggtgagggaggggcaggtaagtggagaataaccagtgtggatgggtattatttgggaagacagggaggagcgaggaacgatgaggatatccaggtaaggatagtgatgggagaaaaagcagaaaggctggagaatacctatggagcagttgaagaaattagtgggaaataggatttaagaagttggcaggaatgaccaaaccatgattgtcaggcttggaagactgggctttatcctgcagacaaggggggctacagcagttgtttccacagaggagatccattatgaaaastgtctggagaaatggtttgggcagaggtatgtgagtagagggaggcaaggaatgaccagaacactgttgtgaccaccggtgagaatggagagcgctgggtgaacacaagaaccattgggaatggatgagactgaatgcaagggcatgtctacaggagaccccagggcacagagaagccccaagcctggcatttctgagcaggattgctttgctcgatgccaccttctccctctcctctattctagtcatgtgccagggctttgtgacccgtgcttttctgttcttttccttgggacatctctgctactgtcactgctgcctcttcccttatttctgaaggtttcttccacatttctccttattgattgtatattattactgcaactcatgaatgaccgtcagaggtttctgagcctacagggctggggcaggggtgtctcctgaccatttcaatcttctgccacagcctggrccwcacagacagctttagcatcagaagagatggccacacccagagctgggcccccagtatccacaaaggaaagttcagcttaggaagaagaaatggggagagaacatttttcttccttagcacctgaatgaatgctttgcccagcagggctacctcccgccagtctctacctttgttgtaatgccaattcttatttaatgtctgccaaacacaaaaggtccatcaggatcacgtggaaagaaagtgaaatgctggcggtgccccctgggtgtaggcctgaaataagatgaacaggaaataaaacataactgcagggaaggcgggccctagacaaagaatggcagtgggcttgcttgttcctcctctttgctcccttcctttcaagcctcttgctttgagagggagaggcttgtgtgtgttttgtatgggttggtagtgtgagaaggaagtcaagatgtttgggaaggatgaattttgagggaggatgttaaacagaagaacagccaagtatggggaaggattgggaataatggccctaaatgtggcagagtagaaagagaaggaaaagaacagagtgaaaaggcacaccggtttcagtgtggcagaaggagctcaaacacagggtggggagttgatgagggctttgcttggctatttgtgtgcaagttatgagaaaattgctaataaaccaatgcaaatcatcatttattcatgtcattaagcactatgtttagctccttcgtgcattatcttattctcacagcagttgtgtgagctagaactctattttctatgatttgcctagatttgtagatgactaaactaaggctgaacatgagtaacttgcccatacagctgacaagcagtacgctggatctgaaactcaagtgggcaaaaccaggatggtcaagggagtgttccttctggacatagctcctaggcattaactcccagcatattggctggagttagagaagtattgccaggacagagcacatctccatcttcctctgtctccccatcccatgtcttgttatccagttttgtggcccctggacaccaacacagtattcattggatggtgaagaacggtgggaaaagcctggtccatttggtgtgcacaaarcatcttcctgacctcttactgtaaaagccatgacagtttgctccctatgttgtacaagagaaaggataaaagccttttgcctccagtgttacagagagagtctgtagactgggcatacttcctgaaggcaagtcttttcacagtccctgcacataagtaccaattagataatttttccagccatttcctcattcccatcccaataataaaccaataatctaaacatactaaggttgagaacgctcctcccaaatatcttgggtaattggatgatctacagaacgtatatgaggacttgttgggtgatgcccaagtgctatgtctttgtctgcagcactttctactttgcgtggtctrtaaaagacagctacagaatacagtgtggtctgtctttggctttgaagttggacatgctgaatattattaattattccttgcaatacagcaaaaagttctgatccaaacattgtttcttatgcttaagtttgttgaaaaatttgaaatcaggccttgtgaatttgatcatctaaggtcttatttgcagagacatgtacttactcaggtagtaatgtcaatagagatgtcctgaggctcaagaaatccctgtttgcattgtggtgagctcctcagccacattggagcatcttgggtggttccaatgaggacttttgaggaccagctcagccccatgcacaacagcatgcagttttgctctaatataaataaaaacaatggaagtagctatttttattggacttttactattataatatgtgctaggcactatgtagagggcttaagttcattatttccaactcttacaactttgcaatctaacattactacaatttttttttcttaagatggggaaacagaagagttaataactcaccaaagtcacagctcagtccatgatcttagcctctaccagttctgaaagacatgcctcctgctgtgtagtagttccaacagggcatggttctgatactaatccatttccatgattatgaacaagcaaggccttggcaaaattgtgagatagtaaggcatgccttctagctgccagcccttttgtcctttcccttagaacctttcgtaaaattctccacccccatcaccaccatcaacacacttctacctctcactgtctccactagcaaattcttttccccattgattccttcattcatttcgtcaactgatctttattgcatgctgactatgtgctaggtaccatggtgggcactgctctaaggaaagattctaatttcagttacttccatttttgcttgatttttaagtcagtgtttttttttttttctcagaagcaattcattctgagtgcttacctctaatcagagaatgaaaaaccttgtcaattatcaaaagaatgtgagacattagcaggcagatggtgggttttgggcaggtgcacctctactgtcaagacagttgccattcttcctcaaggataagatagacctgaggtacacagaagtgagttcatgcatgatgtggatctacctccagaggccctatcccactagataatttgtagattcaataggggaagggtgcttcctgacttagaaagcagatctcagcctctgaccctatccttgcactgtggctgagttatgtttactgccatagttactatagtgtatttaaagctataatattgaaagaccctatggttggcagatttcttcttgggcaacaggcttatgttacagttcttagataaagaccacttgtatatgatcattctagtatgcaaccaactctctgtgatcatctctgatgaaattctagttgagaataaacttttcccttgatacatacagaaggcaaaaaagatattctctaaaaaaacacgcaagagaagatttccatctgaaggccaatgcaccaatgcacctaagagcagagactgtcaagtcaccctacagagtcttcctgtcccaggagaaaacacgacacttgagattaccatacccaaaaaaggatgaccctctcatggcctggccacctatggaagcaagggaaagagcaccagaggaaagaataggtaggacccatcccaacatctgtagggaagagggagctccgtccaagggctggactttcaggtctctctggaggggagcaggctgaaccatgctactgcagcctaatgccactgactatctcagtcacgtgatgcactctccttgctctgatccatcttccaatcacaaattgacttcccaggaggcttgcctgtgagagggtgatgggtttacctgagctcatgtgggccctggtctttgcaaggttttatttttcattggaatgctcaggtgtagtgagttcgacctgagaaacaatcaactgtcagggctgatcaatcaggtttgtgagcaactgacattgagggctggactctggagtagatagagtttactcaggaaagcctctcactagaggcttccygggagaatgctgtctggcctgtaggcaatagtccttgatgccattccttttccagtttggtgatacttgactctgagttttctttaaggcagctgggacagttccatggagggtagactcatgcacagagatatcatattcataacggctctttgctatacagctactgcaatctacaatcccacacaagataccccctccttcagtttttgagtacacatataactgtcaggttgactgaataagtttgcctatcctgaggtcataaagacagtctcctgttttattttctagaagttttattggtttatttttcacatttagtttccaatccacctggaattgatttttatgtgtgttgtgagcaggagttaagatttatttttttatgtggacatccaattgacctagcactatttattacaagtttttattttctctgttactgtctgtcacctttatcataaccatatcctgaccacgtgtgtatgagtttgcttccggactctgttctattccattgtatctctttgtatcaaataccacacagtttcttaataactgtagctttataataaaagtcatgtggtgatgtaatttttctaaatttgttctctattttcaggtttgtcttggttattttkttttcttctcagcatttatgtatacatttagcctttaaaaaacatgagggctaggagtgctgaccacctcctgggcaaaaatccacatataacttttgagaccccccaaacttaactactaatagcctactatgggctggaagcgttactgataacgtaagctgtccattaatacatattttatataatatatgtgttatatactgtattcttaagatagctagagaaaagaaaatcataaggaagagaacatatttactatgattaagcctaagtggatcatcataaaagtcttcattctcttcattttcacattgagtaggctgaggaggaggaggttcttgttgtccaggccttcttattgtacaaccaaaagactggcagctggtgtttatcttttcccttcaaggcttgggggttagcaactttatgggtactttatcaggaaggtcctgatcataaacctaactgcatttgcacaaaacagtagagttagcctattccttccagccttaaatcctggtgctcacttctctcccttactaataaatgtcctttgtggcatatttttttcccaaaatagggcactttgtctgcattaaaaccacttaaggtagacatctttcctcctcgatgatgttttttcactggtgcctgggaactcctctgctgcctcttggttggtagcagctgcttctcctgttagcttgacatttttttaagccaaatatctttctaaaattatcaaaccatcctttgctggcattaaagtctccagctttagataattcacattccttttcctttgtcatataatgacttcaatttttttcaaatcaaattagtctataggtatgccttgcttatagcaatcctgcacccatgtaaaagctgcatttttaatatgagataaaaagatatttcacaaaaagtataatgtttttgtacctgctgacgtagctgctacaactacttcgcaattttcttttcttttcttttttttcttttttacaatgatccacatgttggattcatttgtcttgaaatagcaggtagccacagctgtaggcctcaatttatggcaaatatcaagcaatttaactttttcttatactgtcatgacctttctctacttcttgggaacacttccagcatcactagtagtgacatttcttatgggccccatgatgttattcaaggtttacagtattgctctaaacacagtgaaaactatgcaagaaccatgagagatcactttttactacagcatgcaatttactggagacaattgctcactcagagatgattattgtcacatggtgtttgaagcagatacttgcaacacttgagctcattgcaatagcaacaggaggtggctacaaaaatataggcagtagtacagttacacatgcagttaattttatgcagttatgctttatactgcatctctacatttgtttacatttctcttaactaaatggtatcatgtacagtctgtaaatgtgtggataagttttgatacattttaactttttataatctgtatattttatggtagtaaatgatatagattaatatctacatatattttgtgcattcatgacatacctaactttgatatttctaggttacacagttctgtaagttttttcaaattgttgcaaaygtccaaattttttttccaatatatttattgaaaataatctgcatataagtggacccatgcagttcaaacatgtgttgttcaaggatcagttgtatgtactttagaattatcctgtcaatttttactaaaaaaactcttgctagggttttgattgggactgcattgaatctatagaatattggggagaattgacatctttataataatattgagttttctcattcatgcaggtaatatagtcatccattcattatatactttttctcattaaagttttatactattttgtgtagaggtctgatatatcttttattttattctattttttgagatggagtctcactctgtcacccaggctggagtgcagtggtgcgatctcggctcactgcaacctctgcctcccgggttcgagcaattctctgtctcagcctctggagtagctgggattacaggcacctgccaccacgcctggctaatttttgtatttttagtcgagatgtggtttcaccatcttggccaggctggtcttgaactcctgagctcatgatctgctcgcctcggcctcctaaagtgctgggattacaggtgtgagccaccatgcctggctgatatatcttttattaaactcattttgatgctatcataattggcattatttttaaagttctgttttctagtttttgttgccagtatataaatatacacattaatttagccatattcagctatcttgataaattcacttaccaattttagtagtgtatctgaagattcttttggattttctatatatataatcctgtcatctgtgaataatggtagtttaatttttcattttcaattcttattccctttttatttctcttatcttattatactggctaggaccttgttataaattaaatagaagtggcaataatggaattcttatctcattcacagtctcaatggaaaagtttcactgttttctcattaaacatgatctttgctgtaggttttttatagacaccctttttaggactaagaaagtttccttctattcctaatttgttaggtgtttttaataaacacaagttgaactttactaaattttttttctgcagctattgcactgatcatgattttcctcctatattcttttaatatagtgaatcacattgatttttcattgcaaccttggagtgacatcacctttgttgtgatatgttttttctatatcattgggtttgattttttacgattgcattatctgttttcacaatagaaactggcctataatttgcttttcttgcaatgctcttgtgaagttttgatattaaggttaggtttccttaatgaaacaagctagatatgctgtctttttctactctttggaagattttgtaagattgaagtattttcttccttagagttcacccatggagatatctgggcttggaggttttttgtttgtttgtttgttttgttttgttttttttgttttttattgtggtttctaccaagttgtaatttaacacagtggagaatcaatctgttatttaccatgttgaaagaataggctggggacagtggctcactcctataatcccagcactttgggagcccaaggtgggtggatcatgaggtcgagattgagaccatcctggccaacatggtgaaaccccatctctactaaaaaaattacgaaaattagctgggtgtggtggtgcacacccgtagtcccagctactcgggaggctgaggcaggagaattgcctgaacyggggaggcagaggttgcagtgagctgagatcgcaccactgctctccagcctggtgacagagcaagactccatctcaaaaaaacaaaacaaaacaaacaaacaaaaaaaaaggaggtggggggaatcatggaatcaatgcagaaaaaaatttaatgaggttcaaactttctttgttttgtcttttttatgtctcttataagttacagatttaatttctttgaaagagaaccattaagcttttctacttcttgtgtcaattactgtaagttattttttgaagtaatttatccattgcattcttattttcaaatttagttgcataaagctcataatgtctccttattatcttttaaaacattcataggatctgtagtgatgtccttttttcattcctgatggtgataatctctgctttctccctcttatttatttatatctattagtcttgctagaagtttatcaaattcattagtcttctcaaagaaccaatttttggttttgttgatttttctggattgtaaatttatttttgtttttatttatgttctttatttccttctaaatttgaggggtttaatatgctgttctgtttcaaacttttccatgcatatctttatatttaaggtgtatttcttatgagcagcattttttttttttcctagtgggagttgttagtgtgtgttttgctcatcatggtattttgtacctggaatagtagctggaacatcctaagtcttccgccagaaaatattgaatgaacgagagaatgagcactgaggtctttgtcaagggtggaaggtgggacagagatcatcaggaatctgagtttgtcctgcaacaagtgaatcggtgcaactcccttgaggacttttgttctctgtgtattccctatctgacgatgatttagccagtcttcatgcttatctgtttcatgccaatccccctatcaagaacttctgctttccttcttcccacctccatcactcacaattatagcagtgaggggtgccacaagcttaagtatatagcatgttctttgccaacattcccaacaacccctccttttcaatgttctctcacagaaagattgcctcccacacctctcttcattacaaaagagcccaaatgactcctggtattttaaggggcgcaaagttatgacagtgacagagcgatgtggtattagcaaaatgactccgttggatgtgccattagggctttgcatgtcatctgggtgactgctgttttgtccacatttagctgggtgagccccagagctgaaggagtttattttcggtgtaggaagaaaagctttttggatttgcctgtcrgttccttttatttttttcaaagactccaaagttgatatggctttttccccctgccttgcttcagaggcccaaagatgtagacaatgagtctctgcatgacatttaattcgcctacggtgctgttttgaatgttacagatgaaccaactatgaattggctgtatgtctgtatttrtatgaatatgtgagacaaggggactagatgaactagagagaagcattcttgggaagaataagaagacaccagcgaagagatggtggtgggcatggcagatgagagtcacagtggtagaggggacttcaagagatcatctgggctgggcgtggtgactcatgcctataatcccagcactttgggaggccaaggcaggtggatcacttgaggtcaggagtgtgagaccagcctggccaacatggtgaaagcttgtctctactaaaaaatacaaaattagctgggcatggtggtgcatgcctgtaatcctggtcactcgggaggctgaggcaggagaattgcttgaacctggraggtggaggtttcagtgagccaagatcgtgccactgcactccagcctgggtgacagagcaagactccatctcaaaaagaaagaaaaaagaaaccatctggttgagtcctttgtccttcagtagaygaagtgtcctcatccatattttatagacaatacaattgaaatccagagatgtttcattatttgaagaagaagttggaatctgattctgctagcctgtgaatttcaaaggtcaaagactatattgacgttgatcactgttgtattcccagcacctaattcagtgagtagtacagggtaggtgctcaataaatatttgctgagtaaacaccaaatatatacctacagctgctgaaaattcatttatgttacactttaagttgttctccagagcatctggttaatctggcyctaaagtactacaaaaattatcagtttttaaattcatagatacatgataacaagtaaaataaatggatttcagtttattagatgagggttcattcatataacaaatttttgttgagtatcaatattatatacaaagcactggtctaaatactggggatacatcagggaacaaaacaatccaaatccctgccctcatggaacttacattgtttacagtgtaaaaataaaayagataaatcatatacatagtgcattagatggtgatacagtacaaggggacggggtcggttttggtaggagggcctgatggtgtacttttatatggggtagttaggaaaggcctcacagagaagttgacttttgaataaagacctgaagaaagctagggattaagccatatggacatctggggaacaagcattttgagaaagaacagcaagtgtgaaggccctgaggaaggagggtgtctagagaggtcagggaggagctaggagaaccatatggatggagcttatcaactaggggagccaggtcaggtagaatcctgtaggtcatgatgagactttgactttaacttggggtgagttaggaagcctttggagagcttcaaagaggtcagtgacatgattcagcttacatttgaatagggtcaccctagctgctttgttgggaatggactgaaagggggcaaagatggaagtaaggagaccagttaggaggcaattgcaataatatgagtgagagatgatggtggcttagcccagagggtagcagtatgaatggtgaggaggagtgaaattctggataggttttgaaggaaggaaaggctgatggatttattgatgaacctgacatgggatatgcgagacaaagggggagggtcatgattatttgaaggcttttggcttgagcagctggtaggatggcattgtaattaactaagctgtggagaatggtgagaagagcaggtctgtgttttattrgggaggggggaaggatcaggaactcaggtttaaacgtgaagttggaggtggctactagacatccatagaggatcttttgtaggcaggtagaaaaatgacttgaattcagagaagtttgtggtgaaaaaatacatatatatctgcattattgtagtatatagtttttaagaccatgagaattaggtgtgaataaagctgatgtcatgagttttattagtatatggccaagatagggttttctattatattctgggggtcaactgattagcttcagggctactaatccaagatagccatgtagagcaagtatgtgttaactctacaggtgagctggtgagggaagggggtggatcagcttaagccagcctcactgccaggaaagcagccttgggtgttgagtcagctctgctatcatcctttctgtgaaggggaagacatcctgattgctattatagatatgaagataaactcacctggataatgtcatttcaccatgtaggcactcctcatccacatgttgagacatgggcatacacgtgcaattgaattcatttcttgtttttcttgtgatacattcacctcaaggtgagacttaggtagagttgaccaatgggctggagatcatgtgctgaggaaaccctgagaacacagctgctctcaacttgtcataaggtgtttctttccaaggagccccaaatggattgtgctatactcatggcattatggttggtaatggaggtgcaaagaagtagaagacttggagagttcccttaaggaacttatctggtggacttacatgaaaattcaaatagtaatgcaagatggaaggtgccagacaacagaggcatgaaatagttcatatgagtcatgagaaattctgagtgaaatcctaggtgccataaagtcaggaaaggctcattcacataggagattgggcttgagctgacctttgaggagtgggaagacttaaataagtaaagaggaagagggcttcctagtgtggttgtgcaggttgtacataaacaactctaaacagcaccataaatgtcayamtccatgtgtatggccccaagatggaaagacactccaggagggaaaaaaagcatggaaaaaaacaaggagatagagttacataatacatggaaagtttatttggctgatgctagtcaaatatccatctasttatttaggaaatatttatcgtctggcatcattgagatcacactgaacagagtggaagattcatttaggaaagcagtgacaaaaatgtgtgggctgttgctattcaatgtgaggccttgaatgtcaaaccaaggacttaggactttgccccatgggcaatcaggaggtatagaaggttttggatgagaggttgatgttttaaaaatagtgttctagaaggatatcttggcaacaatgtgccagatggcttgggttatggggtgacttgtggtggggaagtgaaggaaaaccataaaccaggaaaagagtggagagtgttaaaggtaattcagtatgggttaacagaaagacatggagtcattttcaaacatacagagtcgactgtacattcaccaattaggtgcttggtaaatgcttactatgtccgtggttctctaatacatgtaaaagggagacagaaaaaaattcaacagtaataatcccaggtatatctgtgaatataaaacacatatccacattgcaagtcagcctgtcaataagggaggacagaacatagataagcagaatgagatatagtgaataaatttaataactgccaactagttagcatttatggagctccttaatggcttaaagcatgactgtatcacaygagttttttttactacaaccctatgaaattagtgttatcagccatctttcaatttcaatgaggaaaccaagatgccgagagactgagtgacctattgtgctacctagccttgcactgtgccaagctcagtatctctacaatacataggtaggggaacctctagttactgagccagctttgtcagctgtggcgagggtcatacctgatgcagccatgagtgcatcccttcctcaaggggcatacaagaccctgccgagctaagacatccagtatggggtctttgtcactgccaagaatgcccctggccataataactgtccttgagtagcaagaatagcagagtccctactccctgctcctggatgagttaggtcaacagggactccaccaactctccatggcactggtccatcagagctgcctcatgcctatttccatgcctaggttatgctgtaggaagcattggcatatccaaggctagatctttcatttccttcccctgcgagtcttctgtaattgcttggaactctgggaagtccagcttttggcttagtagagggctgttctttcactgagtcagggccctttcatgatggaacctcttctgattatgaaggtaatgttagagtagttggtgggtatatttgctagggctgccataacaaaacaccacagactactggcttaaacagaaatttactttctcatagttctggaggctgggagtcctagagccaaggtgttggcaggtttgttttgtcctgagcctctctccttggcttgcagatggcccccttcttgctgtgtcctcccatgttctttttctgtgtgcatgcatcttttgtgtacaagtttacttttcttgtaataataccagtaaggttggattagggcccaccctattgacctgatttttaaaccacatcacctctttaaaaggccctgtctccaaatatagtgggagttatggccttggggtgaattttggtgggagacacaattccgatcataatcctggggaagctcttcccactccacatttcattgtcctgttgtccttgctctcctaattctacttcccttccctcaccttttctggaagtctatttgagcctggatccagaagatgcaagggagagatctgaagtgttgcttaaaaaaaccgcgacagcccacttatgcttaggagctttttctgggcacctttcagcagcaacacaccctcacagttggacttcctgtggtgaaggaaattttctaatttcttttattaggctaattaggaaaagaaaaacaatcattttttctcaaatcagatactataactgggacacaatgattattaatcatcatcagctgcaattgaagtccatttggtcattcaacaaacattccccaaccccattcccacctttccaattatgcaacccctcagttaaaatcgccatctccagaaggctctccctaactaatttggcccacaatggtaaaccccttttcaaaatttgtgtaacatttgacatctgtattacttatttggtatgtattatagtgtaccttaaaatctttaatgtacacatatacataacaaaataagttccttaaggacaaaagaccacactttatataatttttgtttgctggaatttaacagagagtaggcacagaaaaagttctcaaatgtttgctgaatgattaaatgattaaataatttgaggatgggtattttttgggcccataaatttagaaattactgttaaataacattatatagatttcgtagattacaaattttgaaaaaattgaacagcaataaaatacattttaaattcaaacaayatatggrcataccttggagatattgcaggtttgatttcagaccactgcaataaagtgaatgacaataaagtaaatcacacaaatttttgtttcccagtgcatataaaagttatgtttacactatattgtagtctattaagtgtgcaataacatcgtgtcaaaaaaacatatctacataccttaaataagaaatatattgctaacaatcatctgagccttcagaaagtcttaatctttagctagtggagggtcttgcctcaatgttgatggctgttgactgatctgagtagtggttgctgaaggttgggatgactgtggcagtgtcttaaaacgtcttagtgtgtttttcttgctataaaagaatacctgaggctggatattttataaagaaaagctttttatttgccatacagttctgcaatctatacaagaagcatggcattggcgtctgcctctggtgagggcgtcaagctgctcccactcatggtggaaggcgaaggggagcctgccacatggtgagagcaggaagcaagagagtggggagggaggtaccaggctcttaaaaattctagacagaactaatagagcaagaatggagaactcrtcatcattaggatggcaccaggcatcaagctattcatgggagatccactcccatgacccagacacctcccattaggccccaccttcaaccctagagatccaatttcaacatgagatttggagggtcaaatttccaaactatagcaataagagaagaatgatgcttgctgcagccattgactctttcgtgaaagatttctctatagcatgtaatgctgtttggtagcattttaccaacagtagaactttttttgaaactgaagtcaatcctctcaaaccctgctgctcttctatcaactaagtttatgtaattttctaaattttttgttgtcatttcaacaacattcacagcatctttacaggagtagatttcatctcaaaaagtaaaaagcaactcctcatcaatgaaaattttatcatgagattgcagcaattcagtcacatcttcaggctttatttctatttttagttctcttgctgttttcaccccatctgcagttacttcctccactgaagtcttgaaccccctcaaagtcattcatgagggttggagtcaactttgttcaaatgtctgttaatattgatatttttaccacttcccatgaatcatgaatgttcttaatggcatctagaatggtgaatcctattcagaaagttttctgtttactttgcctagatccattagaggaatcactatggcagctatagccttatgaagtacatttcttaagtaataagacttgaaagttgaaattgctccttaatccatgggctacagaatggatgytgtgttatcaggcatgaaaacaacattaatttccttgtgcatgttcatgagagctcttggatgaccaagtgcattatcagtattttgaaaggaatctttttttttttttttttttgagaagcagatctcaacagtgggcttaaaatattaaggaaaccatgctgtaaacagatgttctgtcatccaggctttgttgtttcatttatagagcacaagcagagtagatttarcataactcctaagggccctaggatttttggaatggccaatgaacattggctttaacttaaagtcaccagttgcattaacctcctaacaagagagttagcctgttctttgagtctttgaagccaaacgtcgtcttctctacttacrattttctcgtctctagttatgaaagtcctagatggcagcttcttgcaatatgaagctgtttcatctacattgaaaatctgttgtttagtgtacccgtctttatcaattatcttaatcttctggaaaccttgctgtaacttctgtatctgcacttgctacttcaccttgcactttcatgtatggaaacggcttctttccttcaacctcgtggaccaagctctgctagtttccaacttctgcagctttctcacctttattagccttcacagaattgaggagacttaggttcttgctctggattaggctttggcttaaagggatgttgtgactggtttgatcttccatccagaccactcagacgttctctgtatcagcaaaaggttatttagctttcttattcatgtgttcactggagttgcacttttaatttccttcgacaactttttcttgcactcacaatttggccatttggtgtaagaggcttagtttttagtctatctcagccttcgccatgccttcctcactaagcttaatcatttctagcttttgatttaaagtcagagaagtgtgactcttcctttcacttgaacacttagaggccattttagggttattaactggcccaatttcaatattgttgtgtctcaggggatagggaggccaaaaaagagggacagaaatgggggaatgaatggcaggtcaatggtgcagtcataacacacaacatttatcaattaagcataccaacttacataaacatgacttatggtaccccacaacaattataatagtaacgtcaaagattgctgatcacaaatcaccatgacagatataataataatgaaaaattttgaaatattgcaagaattatcaaaatgtgacacagaaacacgaagcgagcatgtgctgttggaaaaatagcatccatagtcttattagactcagggttgtaaaaaatgcaacatttgtgaagtgcagtaaagtacaataaaacgaagtgcagtaaagtacagtaaaatgaggtatgcctgtagaactaatctcgtgtcttagatgtgtgaaaaaaagaaaagaacactaaagccaggttagaganttctgctttctgctgtgcctttcatggacttttgaaccttgggaagttactcagcctctctcagggcctttcaccatttacaaggtgaggccatggactctcagatgacaactagatttaccttgcatgcagttttcagtgtatggacatggtttactggagaaagattctgagaccatgtccaaacccatctatgaaaagtacctggaattgttagtcatgtcagcaaatgcagaggaggaagtataggtagtgtaagtatagacgttctctgaggtccctccgagcagtaaagctctatgaatttatgattcactttctctttcatgaagagaaagcacttcagaaacttatggggctctgtagtcatcaccaagaacatttgctttcattgtactgttaagtaggagtgctcatyagcagagattctggtcaaccaaatgctgggttagtgtagagtatgctacttgatctaaattcaggaaaacatgcccagggcgtaggacttccatactacacaaattttcttaattgcattggtgtaaaatgtgcaattaaaagggtaatgagagtggttatctctaggtaatgattgtgggtaatttttgttttcccgtttatgcttttctgtacttctaaatgttcatatataacttttatagttagaagaaacaaatcctataaaaaagaatgatagatactctagcaagatgaaagaacaaggaagaatttcaaaattcagttcatttcagtgaacatttatccatttcattcaataaatatttatttaccacttacaatgttacaggtactgcaggggttaccagtaactgattcaagaaggagagctgttcacagagcaagatgtttcacagaagrgaaagctattgaactaggtcttayaggaagagttatcaattgacagaatatgaaaatggggcatcttgggaagaggaaatggtacctgtatctggaaaatgtaatgcattatcaaaggaccgtgaatgtttctgagagggatcctccttaggagtggggggagataaggctcggtaaatggatgaggcccagactgttgtgtcatggtgtctaactagtgggcaaagtagagccactgcagggttctaagcagaggaaggccaccatgagaacagtgtgttgggaacactgatgttggcttcaggagggtcagagggaattcactgggcagcacagtggttcagggtaagggaatgctgtataagcaccaggcttcttcccaggtgttcttaattattacaaattaggaagattaaggtttaaattgtgtcactaacatgcttattcagtgggtgaggctacaggttgctaaacttgttagaattgtgatacaataatctcattgttttagtgtcatgtcttttccacccacctctgctttctctttctaaccgtctcccaccccatgttattggcatttagttcatattcattttagtattaaagkgaagtaattatttctgtattgtgaaattggcatttgagatcattggaaatattctttaatgctgtaagctagagttttaaaaaataggattagttaagtcatattttttaaaagcgaaaaaaatyacccagaagctattgaagatgatgagataaygagatgaagaagttgagatggactgtgtgtctcttgagtcaatgtcgataacctttggaacctgtcctaagtgagaacctcgattgccctactgcaaatgcacgtgttcagctgctgattcaggactgatcactgggggtgcctcagaactttccattttcttagattcgtcagcaaactcacactcagggaccttatgagaccaagtcagagtaaatgtccagggtttacagagtggatacagtggctctgtttctcaagaaggactctgtataattaaattatcattcttctattaaaaaattgaaattctttctcccaggagctcattgccagtgccttctctgtagtcttatagtcaattcaaaaatatatcacttctggaagatgtgagcttgaagtgtgaatgctatcacatgaatcttctttttatcatagaaaaggcttttaggtggggtgttgatgtcaagattaactcagagaaaattggctgcagttagggctgaatgatagtgatcattccaaaactcattaggagtctaaaaagtgaatatttagactttgaccaaaacccatttgtcctagagtgaaatatggtagcgagagaaagacagccctgcaaccccgaagtgtaggcgggcctttctttaggaaccaggcatgttcttgaaatcttgtgtgtcaatcagctttttgtaaatggaatccttttttctccttcattaactttccctgtaatttcagcagtgtttaacattcattactgattgatcttgagttggcagttaactgctaacattcagatttggattttagtgcttctttcttgattttcttgcctttttttctttgctcactttctttcagcaactacttaaggagtaaatactatgtctcaggcccagtgatagggactgggaatataagtaagaatgacaggtaaacaattaccgtaggaaatggtaaatgcaaatcctaggagtacagagaagctgtggtagcacggagtccctstgtctggggagggcttcccagggcaggggttactgaaggatctgaagatgtgaggaggtgcttgcttgggtgatgcccatccaaggaagaccaggatcagaggcaggtttgggattaactaactggaaggactttggtgttgaggagtttcagtctcaggacaagcagtgaagcagctgatgmtctttgcttagccttctacatggagtgagttgtggggaaaagttgtttgcaacatgtatttytctaatggccagggaggggttatttcactattatttctctccarcttttctatcaaatacacttgtggagtttctgtagtgtgaattgtcttacttcaatctgtaagttcaatctatattcatgaagtaggagggcacccctaaataagattgagagggaaaaaacatgaatattttcagttttagtgggaactctcatatttgacttagtaacattaaaaatgattatatataaattacaaattttttatggtaaaggacaccataagtaatgtcaacaaatgattaatacactgagaaaaatgacacgtraaaaaaattctaatataagtatatataaagagcctctatamatttataagaaaaagacaacatatagaaatatggacaaaggaagagagtaagcgattcaaaggaaaggcaaaccatatggccaataaacacctgaaatgatgctaaaactcagaaaaatgcaaattaaagcaataaatyggaccaattctttatccatcagattggctaacatgagtaggaagattagtggaatgttgcctacctgtggttctgtgcrtctgtgtgggtctactttaatgagtttagatctaggtgcttgtcctggaggcacattcacagtgtgttttttaaataagaaaagcaagttacagagtaatgtgtatagtatgatcccattcaaaaaaatagcaaaatgctatgtgtaagtttgaatgtgcatgaagataggtgggaagaaaacacatcgggccataagcacttaccacagcaggatgggaatgggggragggtgggggcaagtaactttttctatatacatctttgtatgcagttgtatacatattgcctttgtaatttaatgtacaaagacaaaataagtacctagaaattaagaacagattagtacactttttctgctactgtcttgccatagtgttgttcaaaccagctagaaaacaattctgtggtgccaggtgagatgaactctccacctcttcctgagggctttgtcttcatgcatgggacaaagcagtgtaattaacatgcccccccmccccgccttaaaacctaatattcattcatctcttactttggttattatttaaaaagaaaacatttgtcaattacttcacactgacaagcaccatcccactgagggggcaggcaggaggtccatctcaccacccagctgtattgcaacaacgccctctccatctgggaatacggcccaggcactcctctggaatcctraacacactccaggcacctctcttcttactgaacaccacctatgcttggagcaccatgtgagaggacacctctggtatcaggcagcttcagatgtattcagagagattgaaaactgcaaggattcaaggcataacaaatgatacacagacaagaaaaaaagacatttagagtgggggatagggcctgaaggcttgaatggtcctacaagactttctcaaaagtcgtcaccctgggacctgaaacattagagctctttccagagtaagtctattctcrgccagaggtctccaacagaggctgtccatgtgtactggtttcaagttctgcttacctcccaagtgttgttttttctgaccctgacctaattcctcccaggccaggctggccagcaccttctkaaattgctctcaggcagctggaaggcctggctggcaggagccctgggtttttcaccctcagccccagggctctttgaaggcctactctccaagaacaaacaaacctggcctgacgctgcatagctgcagaataggggagctttctcggcctggtgcccagggtggccgagctgccagccaggtgcatgatcctcagttaattaggtaactataggtagtcctgcagcccaggctgtgtgctgattagtctgggctgttgttggagacctctgagaatagacttactctggaaagagctctgatgtttcaggtccagggtgatgacttttgagaaagtcttgtaggaccattcaaaccttcaggctctatccccctctctaaatgtcttttttcttgcctgtatacatctgctatgccttgaatccttgcagttttcagtctctctgaatatatcttaagttgcctgataccagaggtgtcctctcacagtgtgctcccccagcatcgtgctctgagcataggtggtgttcagyaagaagaraggtgcctggagtgtgttyaggattccagaggagtgcctgggccgtattcccagaaggagagggrgttgttgcagtatggctgggtggtgagataggcctcctgcctgccccctcagtgggatggtgcttgtcagtgtgaagtaaaccctggagcacctgagggaggaagaggaggagatagatcttcagcttccagggattagactgaaagctcaactggcaaaatgcccattttattccctcattgcaagctgaaagtagagagctgaggaaccccgggcttgaccacttttttgcattgacagatcctttgtgggagacacatgatccacatgggcattcctagatccctttgaagactccataagcccagggagatcagatttacctcaggtttcaagtagatctcaagatcccactggaactcagattttcaggggagttcagaattagggcacgaagtgcaggagatggtatcaacagcaacaaatctgtctgatattctaaaagagttcatcccagtgtagccccaaagacttcagactgaaccagattcaccttgaattgaataagctgatgcaatattggcagctacacattcttcatatgacacctcttttctcaacttctcttcaccctgtagtctccacagagatattcctgagggatagcaagagtggggagctaacctgtttctttgcactgaatgagcaatgcttgtgcctttcctcttttcttgtatcygtacatttccagaggagccagtttatagagggtatagagtaacccaagaatacaggtttgggagtaagggagctggcttttattccaagtgctgccactggctctctgtgtcatcctggtcaaggcatggggtgggagcaggtgttgaaaggagcctgctgctggggattggctggcccccaaggagcttatgcccctcttgctaggatgctggggatcaggtcagtaacacctgtatttacagatgtgggctttgttacatatttaatatttaatttaaaaagaattaatgacagtcatagcccatatataacccacttcctgatgtgatttgtttggcccagttttacaaagttgtcctgtcagaggaatttcatttataaagttccttattgctgagcctctgtgtgttccagttatgagtcacatgtgtcaacaccgtggaaatgaaatttgtaccccctggacccatgcagattgatttgattctgggctaaatggaaatagaacctgtacaagtcaaatgtttctggagcatctgccatctacagggcacttggaggaaacataaagacattcaagacacaatccrtgtattcaaagaatgcacagtccagccaacaatgttttaaagcttccagtagtttcctaaaaaataccatagtctttttgagtttggagaatattattactgttgtcaattactttttattagcaccctgtatgatataggtactatcttaggtkggtttccctggaagtcagctctgcaaaagagaattgcaagcagaacgtctttcgaagtgtgctttgggaagatacacctgaggatgcaaaaaagccaaagttcaacagaggaaaggctgactcgcaccaccagaactggatgtcccttcagaggtgtctctaatcgaggcaaggggcagtttccaaggaagggtgcagcagctggggaataagagtgtctgccctgaaagcagaacctgagtataatatcatggtatccactccaggcattcaaattcattcttatcaccatagctaatacttaccgaatgctttctgcttgccatagcttgagcgagtgttttagctgcactgtttccgattcatgcaatgtagagatgaggcagttaaggggcagagaagtgaactgcacaatgaataccatggtaggcagagaggtggagaggggaattattaataactgtcagactacacttttttatttttttgagatggaatcttgctctgtcacccaggctggagtgcagtgccaccatctcagctcactgcaacctccacctcccaggttgaagcgattctcatgctttagcctcctgagtagctgggaatataggcgcctgccaccacgcccggctcagttttgtatttttggtagagacagggtttcaccaagttggccatactggttttgaaatcctgacctcaagtaatctgcctgccttggcctcccaaagtgttgggattacaggcatgagtcattgtgcctggcctcaaactgtacttcacatgtaattttcaaagcgctatcccatgataggaattatcattcccattgtacaaattgagaaactaaagcatggagaggttaagggatttacccgatgtcacagaacaaagaagaaagaggtaaggccagggttttcctattagcctatgatgtctcacagagataacctgtccagktagatacccagttttggctggagaaggcatcacagaccttgggtaattgatggcccaccagtttgcacccctttccattaatgtggaccgatcatgccctttgttgtgggtcagtgagcgtggtctttgaagttaggcagatgtgggtttgaattctagctctcattttatgacttacgtgtcagttcacacctctaagctcactttgctcttctttaaaatgggggtgataatgatgacttcattgggtcattatgaggattaaaagaaatcaggtatgagaaatctctcagcacattctcccctccctggcaaaagggttcaaggctgcacaaagattatctaagggcagatactctgaacatagccatagtttattgattcagcgttttgtcatttgcttccctctctcaagaggcaagagagaaagcgagactgtcttccatgcagtttgctcagaattctaacactagcctgttagtctaatcataacacatttcttcttggaaacaaacatagcaacagcaattatatcttacttttaatgtctaattggctgtaaacttgcttttactaagttatttccatcgaacatgtagagcattgtgcagtttgcttatcttgatgtcctcctcttgcagtccccatcttggctttattcgggaggccaattatgtgtatgctagccttgtgggtgccctagaaactccagcaaaggccagtgacagtgttgtgagccttctgcycctcattatccacagaggcaggagcctatcagagcctccaaccttgaatttttgtgtgagttctgcttctgttctcctactccaggtatgtcccctcacctggcttctggagtaacccatccctgctctctgaacccccacttcgctgtgccttcctctgcttctaaccctgcctctacgatgggctctctctccttttcctcataagccgatcattcttttcctgcaagaagtcccacagggaagccatgccatcctagccagacttggttatggtatgacctggcgttcagaggacacaccccagcacctctacactggctttcagccagatatgtcttcaccgcttgttgagacagaacagctttcttctacctttatgctatgaagcagcctttccaggagccctactggggccagagcccaagtgggaagatcctcccttaagctttcccctctgtttttccaactcctgaaacttacatccttctgcaggcttcaggactcagtgtaggtgtgtctgatgcccrgtcatcctagagaaggggttgtgggaggggctgtacctgttgctatggcagcaaccagttgagatcatgaacccatttgattcagaggcaattgcaaggtgaatcaatctccttgtcacccactcctcttctcctccctctccatctctccccacagccttctgtcatctttcctcctccccactcaacctcaagctttctccttccccagttctctctctctctctttttttactcctagttatgatacatcaatgtagcagctaaagctactcatggtagacttcttatttatattatactttagcaagcatcacctaaagggcttattaaaacacagattgctgagcttcctctagagttctgatctggactctgcaccaggacccaagaaagtgcatttctgacaaggtcccaaatgatgctgacactgcaggtccaggggccacactctgagaacaactgcgctagactatgtttacccagtttgatttggttgtggctggaatattcctctgcattttgattctaaagtatttgattagctcattcatccattcatagaacagatgtttattgagcatctattcagtgtgaaacactgtactaggtactagctacctagagaaacataaaaccttgccctctaagagttcacagatctgtacaaaagacacagtaaataagtaattattatatggggtgataagtattgtaataacctgcaaataataagagatttaaaagtatacaaccaactccttgctcrtggcaagtaaaatatttagatgataggaatataaataataatgacctattcatttatttttctttctttgccaagaattgcctgaagggaactgagcttaacctatttaaataataatattaacatctaatgtttgtggagcatttactatgtttcagatactgtaccacatacaaggcatattggttaagagtgctgcggtcagactgctagggatatagtcctgacttgtcattatctgtgcaacctcaggcaagttacttaaccactctgtgcctcagtttcctcatcagaggaaaaggttatagtactagtttctgcttcagcagattactgagaagatgaaatgtgataatgtagtcaaaacatatatagtaattactccaaaacacgttgactcttattaccaacatattttgacctgaggctgaatatcacagaattggcctagagaaattgatatcttccagactaaataaatctccaggattttgtcaagagaatggatgggggctggacctcaatgtggggattagagaattccaaaacaggcctgaaaactccttggagcaccagtcagaggaagcagccctacttggctgtcggagaatcagtgcaccccaatggaatataagaaaggccctgatggatggccaggatttggaccatgaaacttgttttggaggagggagggggattgtcaggactgaggctttacagtctctggttgacacagctgaggaaggcagaaccctcaggctggggtgtgagagtttcaagcttagccttgaccagtcttkccatctagagaaccagggtcactttcaggcccaaatgccacggggctggtgctgtcagcattatcagagcgtttcctagcaatgcccatcagcaaagaggctgtgttttctgaaccttctccaaagaggctgccctctcccctcttcratatgcacccccatccctgagagaagtgatttcctcttgttatttggaaatcagggagagagtttcccaatctttgtctggggctctacagggaccacagtccacattcatgttgagtcaggtctctcttttctgtctcttagacccagcttcacagctgagactgtagctatatgagaaagcagaatctaccagttttgttttaatcctttcctgagctcatcagagataagagtgatagaaactttcttcttacagagaggattagaagttctttgtggcaagatatacctgggaaggggttattaagtgatcatccctgataaagcccctctaatcatctactagttttgctattttagtggtgggaaaaaaaacacaaaaccctaggcacttaactcactcttggggaaatctttctaatcccttcctccctccctccctccttccctccttccctccctccctccctccctcccttcctcctttccttcctgccttccttccttcctttctgtgtgtctttgtgtctttctgtctttcatcctttctgcttgtctcagatttaatcggagccatacattccgcttattcacttatttgtttgttcattcaacaaacacttgctgagcacctactgagagctaagttgggttctgggccagaaacagacaaagcaaacctgcttcttgttcttgagggtgtcaaatattgtagaagtgaacaacataccagcccacaatgattatgttgcagttaagtggtatggtggaattcagtgyagggcataagggagtgactgactctgggaaggttttttagtgaaggtaacattcagtcagggattgagtggaggcttttcaggtggaaaaggtaggaaaggcattataggcagtggggacaacatgagcaatagtgtagacataggaaagaatgtggcatagaattgcaagaagctggatgtggctgtgtgacttggtatacaggtaggcagatgctgtgagagacagatgagctagagaggstaggttgggtcagtcatggtaggggattggcatgggcaaattcccatttcaaggtattaagcaggggagagacagggcaagatgtgttggttagaaatgacaactcttccctgctctgaagaatgaaaccagctgtgcctgggaatcacttgcccsactttacaagatctccctggcaacagaatggctgttgtacaactagccagggaatttgctgtgacagtcttccaaccttatctgacatccagagcagggaaggaattgccaagttagggtatagatatcaaaggaattgaagcaacacaacattggaatagtattacaatatgaaattagaaactattttctctgctggcattgttgtaaataccagcatccatcactcccttctcaaatatattgtaagttaaaacattgctatttttatctctaacccccttgccctctaacccaggcaatacaatatagcttcttgaggagaggcccaagctgggtgtggattccgaatcttcacccagcttcacatgcttattgtgggagcttgggcacatcccctgtgccttctgagcctgggttgtgttgttattgttgcttgttggtttgtgatatggtttggctgtgtccccgcccaaaatctcatcttgagttgtaatccctataatcctcacaatctccatgtgtcaagggagagaccacgtagaggtgattgactcatgggggcagtttcccccatgctgttctcatgatagtgagtgaattctcacaagatctggtggttttataagtgtttggtagttcctcctgcattcattctccatcctccctccttgtgaagaaggtgccttgcttccccttctaccatgattgtaagtttcctgaggcttccccagccatgctgaactgtgagtcagttaaacctctttccttataaattgcctagccttgggcagttctttatagcagtgtgaaaacaaaccaatacagtttgttacatgtacaattgcaatagcacctctcttgcatgtggttgtgaagattaatgtatgctatgcacctggtccaatgtccagcttagagtagagtagatgcctttttttttttttgagatggagtctcgctatgtctcccaggctggagtgcattggcatgatcttggctcactgcaagctccgctgaccaggttcacgccattctcctgcgtcagcctcccaagtagctgggactacaggtgcctgccaccatgcccggctaattttttcgtattttcagtagagatggggtttcaccgtgttagccaggatggtctcgatctcctgaccttgtgatccacccaccttggcctaccaaagtgctgggattacaggtgtgagccaccacgcccagccgagtagatgcttaacaagtggaaaccattattatttttctccccttcgatacatggagccttagggtctaagtgacaggaaaatgttcagataaagatgttttaattatgtcttcttagtacttccagaaagaggtctgcatgggtttaggtcagctctgccttccgacagcttacgtgcattcttgtgttgctctcccatcttcactgctcttcctacattccaccctaatgaacggcagagagagctatgcaaagtggtcaaagtaaaaagggattctttccgatgtttcccagattggagaaacaatgaacatgattactttattatctctgttttgttttaatcttgttgtgccccaaactaatggggatgctcatttggaatgagctttgtgtatctttgggcaaagaggaaaaccaagatgaatttctaggagggcagcaggagagtgaataagagagtacaaatcatcacaaatcaagagatgagtaaagagaagggggttgggaatggcagaattggaacctgagagttagagtccatgagagagaggagaagcaaaatgagaaatatggagtctgagtgggaaggaaccccacatctgtygtctgatacaggcacctactcaagggaggaattcggcatcagtrtccctcacagatggttgcctgacacagtgatttctataaataacaattatatggcactacgggaagtggatgaggctacttacaaatggagctgaccagcctggggactgactgtccccaaggtctgtcaaagaggtgatgggaagatattttgtgcacatctgtagctcagtgtgctatgagaaactgacctcatagggccatcttggagtgactcacccatgtaccttcaggccttcaggtgattaataggcatgtaggactgacgtttcattatcactgcatcaacgctgatgtagacttattgagcatgtcttccattgatgctgtcttgggttctggagatacaaagacttacaagccatggttccttgctttcaacctgtttttrttaaggaataggagtgtttcctgtggccacagaataaacgaaactaactgtcctggggcttcttcaggaaaccagtggggctaaccagacttacatagtgtttgatacacaatcattaattaaaacagagatgttcaatgataaattaattcgccttctgctcagaattcattgaggagggaagaatggaagccaagaaaaatgattatctgaagcttttttcttgagcgtctgcccttgtaggctgtgctgaatatttgagtgagctaagtgtacttgctgtatgtcaacagagatgacattttacaggtgatatatttatttccagagaaggaaacttatataggcttgtgaagcagaagaatgccagcaggtttctaatctcctattagtaaacaacattatcgagaatctcctgtttgtggagtaatattctaggcatttgtagagtgaacacagaaataaagatgcagttctgtctttaagaaacattcagccctaatgggaatggaggaccaatatgtaaaagagacagaacacatataaagaaggtccataaataagtgcaaataaatgcctgagtgcagcacttaatgttctgttttctattataggtatttgtactcacgacttagccttcttatggataccaaagcccttgagaactgttttcctttctcattcatcttgtgcagagtacacactcaaaagtgttgaatgaatatgtatgctactgtgaggtgtgcctaattgctgggggaattctggagtgaagtagaatgacatgtttaggggaaaccttatagcggcttagcagtgttttcaagtatgagaggacttgtaattggtggagtaaggggacaggagggagaagaaagaaggaagagttcacggggactgagcaaatccaaacaatttatgccaccattcagggtcctccatgatctgatccttcaggtcttaccttgccttgcttgctgccaccaaaggcagcccactgtggccttagcattcccacctctttctctctccttggaatgtcttcctctgttgattggccatctgaatccaccttccacttcatgtctgggtgaaagtagagtctcaggaagccttacatgacatctctatccttgctcctatcttcattaaatggcagtgtttgcaggtctgatttcagtggtcttaaccttcagaggaaacgagagacaatcatggtcttcaacctcgggtagctttcaaatgagatcatgaggcaacactaattttttgtttttttttttttgttttttttttttttttgagacagagtctcgctctgtcacccaggctggagtgtagtggtgtgatctcggcttactgcaacctccgtctcctgggttcaagcgattcttctgcctcagcctcctgagtagctgggactacaggcatgcgtcaccacacccagctaatttttgtatttttagtagagacggggtttcaccatcttggccaggctggtcttgaactcctgaccttgtgatccgcttgcctctgcttcccaaagtgctgggattacaggcgtgagccaccgcgcctggcctggggcaacactaattatatacaaaataataagagggagcagggctgtatataattaggtgctaaacagagtagacagaacagaagaactgtgcagagttgattggaggtcagaagtcctgcattctggttctacttccrtacccaataagtggagtaccttttggcagtcacttggcttttgaaccttggttcttctgtaaaatgaggggtttgtgcaagatgctgtgattycttccagctctagaatctgcaagatgataaaggttagagtactcatattagactgagtgggaaatagtgatttgttagtaagaggggagaggggaacatcaggaaaagcaataaatgatggcgaccagaaggaytgattcctgacaaccataggacaaagtggagaatcagagagggactggttgaagagcggttaccttggtattatccagcatgttctttctggaataggatgggcactgcacaaaacgttcacaatagaggatatatgaagcctcctgtactcttttgcgtttctgatactcacctcccctcttgttttcagagccctttctggtgcttgccactctttaaagaatacaaatctctcatcagcaagccctgtagaaggggcaaaggggtgatgyrctttagctcatcaccactgggcacgttctctttaatcytctcttaaattcacctgctttggctgatctgcatacagtgggagtggtgtcagatcaacacactggccttttcccaaagcaaagcgggatcccagcctggatggcccagcacagggtcagctgcctccatcctggccccccagagcatctgcctccccagcaccctgggctgcagttgcagagggccttctttttaatgtttttctaataatcayttttttcaaaccctaaaacaacactttgttattgcatgatagttgcaaaaatataaaaataatttttaagaataactcatttctaccccctcactccccccacaggttatcatcactattattaataacatttttcactgttttgactaaaaaaggttttcttttaaaattcacccatgacccagaactatttaaataaactaattttattttggagaaagaccctaaaacttttattatagagattttcagtcatgcacaaaagtagagagaataaaatattaaaccctatgtaacccacatcagccccagcagttacaagaagaccttaaagtctttagaggatcyggcatctccctgttgggcttctgtgtcagagttcagaaagggagaggggagggacaggataaatatcacatgacatcaatgttggaattactaggatttaagcagagggattttaagcacagcaggaccctgagccctgcccatattggaggtgcccacttttgcagaccctgccacggcagccttcgtagtcctatgtggcaccgctctttgctcttgaattgtcctcccaagagcgtggatgggttttcactgacacacgggtacctgcctgcccagtgccagtggtgaggactgcccacatctggggtgggccatgccagcccttgcagctgaccggccagagctcctgaccctggtctcggtagcatcgtgtggctgcttgtaggttgggtggaggagtgtttctttctgtgctcctcctctttgccaaacactctgctgcattttcccactggcaaaagaaggggaagaataggtggtgaaatgtggttctggactgaggcactgcttcatcctcagtgacaatcactgacattcttggcagcggggagatggtggctgcatcaagtccagaggattctgaatgaccwgaatgtgtgggaagccttgcttactcataacggcccctggctaagycagatgctgcctccagagattgtttgtgtggggagacttagtatgtttattaaatatactcagggctccaagttacagtgaaacgccctgctcctgggcctgacaggctcagcctcctggctgggtggcagcaggtgcctatgtttcacttggagctctaggtcctcattctttcccctgctccccaacctttgcctcttgcctgggkgctgagaagacagctttcatttttctggctgtaagatcctagtggtgactgtcctatctgtcttttgttctgccctagaaggtagtaatagtatgggtaggattgcttttaagagttctggaactaaagcagacatgaagagtcaagggtttgcaagaagttgacccattttggttctagattgtggccccagatctgccgataagttgcttggatcctcagggaagtcgctttgcttccttggggctcagtttcctctcctatggaatgatgagttggatgacttgttctcatcatcctcttccaagagtatgactggatttcctagtctgcaggaaacccgttataggcatttaattgcccagtgatgtgtgggktatgctgtacattgtatccttttcctaaaatgtgggtgtggtcagaggaatcataccttggctttgaggtagaaacaccatccaactggtgtgactcaggggaggggtgttgccagctttgtatggtgggtcaaaaccctgatagaatgccttaaatcaaattccctagaaactgattgtgaaactgagcttcttgtggcagtgttttaatgagggactgctcttaggagttacctaaaggtatgtgagggaagcaggataggtcaagggaaaaactaggcaaagcctcagcctggttccatgggcagcccaaagtgtgaattccaccacagcaattgtcttacccagtggcaaaagggccgggccattgataactcctacattaggtagttatctgttacagccccccatcatcaccagcaggggcaggaataacattccaggtgaagctggtctgtcaggcaagggcaagcatctgaaaagcgtacaggagcaaggcaggtgtgagttattagcagccaacagttacrtagcagctgggggatgagacatgggccagaatgccacagagcctgccacgtccttactggtgacagccgcgcagggaggaaggcaggagtagggtgggagagggctgtcctgggtggctgattcctgtggatggctcagcacatgcaggaaagtgttcagatgggatttccaattaggtcaatctaagtgattgttctaaaagttgggatgatgttacatttggggtgggggatagtgtgcctaggaagggacgtgaggaagaccttaaggttatctagaggctggttgtccagtgatatatattttgacaaaatccggggtacctttatgacttgcatttcagcataacatccacacagagctccagggcgctgctactgcaaggtagtagcagttcattctgagagggcgttccccaccctcttttttcttcttataggtcccccacttcttggcatgtcttcatcttaatctttttctccatctttcttctacctccataattaatcttttcactgcctttctggcttctgctgtctcagcgaaggtagtttcttagactcccgtgttattgttttccctgaaaacttcagcacatccttttctgacttcccggacccatgcaggcccacctgccccagttccctgtgctcccttcatagcactgaccacactccagagttaaagttacatttgtgtgctcacttgcttcatgggtgtttcccccattagatcacaagtttcaaagagctgggactgagactgtcttgctcatcatccttaacacacagaaaattatctgtcacatagtaggtggcccatgaatgtgttgaataaaaaatatggcatttcagctccaagacatggaatccaagtccctcggggtgggacaggagctgtcatacttggtgctggaggaaatgggagcctaggggagggtgtgctggcctgtgaggtgcaggaggccaggtatgtgtctgtgagggaaggtgtgaagtagttgaatcagtccctggcctctttccttccccactcactgctctgtgaattttcctttccctaggagtggtcagcagaggctttggacagatgcttctgcagagatgaatggcctggcttttttgytagcctatgttggctgctccaaccctctcctggcctgagccgaagatctctcctcgagatggagccttgagtccagcagttcttaatcaaaagtaatcttgtcccccagaacatttggcaatttttgattgttgcatctggagaagtactagtggcctctaatgggtagaggmcaggaatgctgctaaggcacacacaggagagcccccaccaaacagaactgtctctccacaggtgctggcagtgctgcagtggargaagccctgcctaggccagccctgatctaaccagcaggtgctgctgacagcctctggagcaggtgttccccagagaccctttgcttctgaaaggaccatggaatcagcatctgccttactcccagccccaacacactcagcctccccactcagtcataggcaattcagcctcccaggttacagctgctctgtgaagagggtgcacagacagggagaatgttttccatggagccctggggaaccctgttagagacctgtctctggggctgggggctgggccctgcctgcatagcttcagctcaggggacccatggggcccctttcctcctgcttgctctatccccatctttctctccaatcctcctcccaccccaccttgcagcatctcccccagtcccctggagattaatgtgataattaccatgtgtgcctgtttacgcagggagtgggtgagctcaccacccccatcagtcaggttcccaaaggaacacattcccacaatgtcaggactggtacccgctgagcactcctgtgcaggtgggctgccgcccccgaactgctttctctgtcatcaccctcgtcgtgcacacgtgtgcatgtgtgtgtcactcaggggatcggcaggtgaggaagatggagagcagccagtgtgccagtctagggaagggctgggtggggagggtgttgggagatgggaggagcatcagtgcyccatgtaagaggacactgaccaaagagaagcactctcctatgatgcctgactgatagtaggtgttgcatgagtggtgtgggatggaggggctggcgtcttctgggcagcattctttgcagggagggccctggtttcccttagctgctccacagtagaggtctsggctgtgaaggttctcctggggccagaatcttgattggagtacttagcatggctgtcccgtgttcctgaaggaagagtctctggggaaaatagagtgcaagtcttacatgaaaggagcttgcgagaactgccactctgtcacagaagytgggggggatgctgtagagagagaatgagtgattctccctctcacaggcaaccctcctctcttgcacctcctgctgagacagacacgtgcacaccacgagagagaaaacagtcacaactctgtggttgaactggcagcttcaccccgacttccacttcacgtgctttctgggtacttgctgccttgagttgtcggttgctgctgcttttttaatctcaaaggacgcttgagtcattgtctctcctacactggacaattttgttttaataatgatgaatcagaaggagattgaagccccaactggcatcagaaagaaccatgccattttgaaaaagggaagcatgcattcctttgctagcctgcttcctgccgaggtgtgtccctttgtcctaccgggtgtgtcactgacccgtggacaaacatgcaaggggagtggaagccagttggccaggaagaatgaaacaggagggagaggagcaaggtgtggagaagggtggggcaagcctattaaaaggtgtgtgaataacctacaggagctgtcaagctgctttctccagaagaaccttttaagctgtcagtcatcttcaagaacccccagggccttgctggtgctggtgtcttcccagctatgcttttctccttctagttcccatcctcctcttttttcatccagcaggccccactgtggtggataatgtttgcggcaattcagagaaatctccacagattgagagggggctatgagaatgaattgtatcagtgtatttttaacaggagaatcttcatattagaattgtggacgttttttgattagtcgaccatctatgcatgccaaaccctttgttaggtgccagatacagaaatgagcagacagttaaggtttctgcctgaatataggttgaagcaacaccaaaacatactcacaaaatgctgaatcaaaagacactgctcgtcattggttttttatagaattgagaaacacattccagattctgacccactgtagttcctacatttcaaaggctatgttcttcgatgtgttactagattttctctgaaaatgagggtttcactatgatcaaaagtgtttatgaaatggtggaataaacaaggtaaataatgttctttttttgtggatcttctcacgggctcagaagaaaatataatctgctgtttcccaaatttctttggttacagaagccccttttccacaaaatacactaacttcttacagatctctagcaatgagaacaatgtaattttggacatcctcattacagcatccctggcaagtagtcacccaagtgaaattgctctgagccaccctcaaactgtagctcaattatttaagaacaaaattatcttaaaagtcacaatttcatcattgctattgctgatacctgctaatgtttgttggcaacaaagtcctatctgggtgctgggtgtagactcagtttttgttgccaaggaatgttggggtgctggggggtttggccactggctaagccatagagtgaataaaccctgttaatctggagctttactggtgaacsatcagagctagccagccttacagaaggactgatttgtaatcacaaataaacacagagctagctatacaaatatcattgcaattcacttttcagctcatagggaaggtccatgtcttaacgatctcagagaaaacggcttcctacctcccttaaaaccctcaacaactcttggcatctagttcctttggatctttctactaatattcaggaacagttttctctgaggtctggcccacatcttccctgattgtatttaactgaccagacctgattgaaccaaagagctccatcttacacactgaaattggcaggtccctgcatctgtcccttcccattcagaaagtgttttcttgtttacttttaacttttattctgcttcaattgcaattatctctctctgaatagtgtaggggcaaaaaaaaaaagacacaagtgtggtgaaaggagattgccttagaagctgttttagtggggtgattcctcaaataccccaaaacagaactagcattcaacccagcaatcccattactgggtttgcttacaacccaaaggaatataaatcattcggttataaaaacacatgcatgcatatgctcattgcagcactattcatgatagcaaagacatggaatcaacctaaatgcccatcaatgacagaatggttaaagaatatgcaatacatatacaccatggaatactatgtagccttaaaaaaaatgagaacatgttctttgcaggaacatggatggagctggaggccattatcctcagcaaaccaacacaggaacagacgaccaaatactgcatgttctcacttataggtgggggmtaaatgatgagaacacatggacatatagagaggaacaacacactggagtcttttggagggtgaagggtgggggaaggaagaggaccaagaaaaaagcagctattgggtactaggcttaatacctgggtgatgaaataatctgtacaacaaacccctctgacatgaatttacctatataacaaacctgcacatgtacccttgaacttaawataaaagttaagctgttgttaatggatgaatcaactatacagtgatagcttccatgactgataagaggctatattctgtggactggaatatttgaatgggagacagaaatgagataatttggaagaaaacaagagaatgtcacagaagtccacaggaagcatggggacaatgaatcaaaatatgttttcagaatttagtagtgagagggggaaaaggtaaattggagggacaagaaatactttgctatagaaattctgagttctggtcttaattttactaatttagcttgtgagttttaggcatggcatttgactttggccttgtttttccagtgaagtagagataaaatatctgttgtaagtttcaaatgggtcttagagtttgtgtgtgagagagtggagtgggggtcgaagggatttcaaagccctgcatatgtgaaatgcaattcagaaagactatttggaaagacttcgaggtgctgtcaggggaggaagagtcaaagggaagactgagaacccttagttgagtggtacagcttttagagagactcccaagctctatttcaaggttctaataagatatcctgctaagaattgcttctttgtttaagtcatgagatataattcttcctcaatccctgaccattcaagggtcttgcatctgattcatgattcgagaatccggaatatggatttgcaggcattttttaattcactgagtgttaacattagagtgcaagtgatcactcttcaaatctagatttattccttgttctggccagagccttgctggggccaagcctgggccagctctgtgctattgtactatgatggaagaaagcaagctgagcgtgggtcaagggctgagcaagacgcagaggaccctaaaatgtcttccaaataaccctgtcaaggcctttgctagcatccatggaatagattgggcacagcctgcctttgtctttttgagaatttgcccaattttgtgtgcagaggcttagaacccacattaccaaatgctataaaaccagtggttgtttgcgtgaccttggaaaagtatctgacctttctgtaytgtcttctcatgtgctaagcaagagtgtgagaatattccaactcagtatattatggtgaggctgatgctgtgttcttcattacgtacatgggagattttgagctaactcacggtaataccaaattgggaatggagtaaggcaatatttaactgtattgcattgtggtttttacatcaccctctgtgcagctgcaagaatgtaagctttacttatggaagatggctttaagtattaaggaaccatttttctttctttcagaccaatgatgccttaggagccacctggaattggctgtacttcatccccctcatcatcattggatccttctttgttctcaacctagtcctgggagtgctttccgggtgagccagatgtttctctcttcttaactcatttgctgactgctaactgtaaactaatgcctcctgactcatggcagattcattcatttaaccttcatttagaagacacttacctagcagttcctctgtgccaaatgctttctagatgctgggaatgcagtagtgaaccatcattctaataatcttgattattctcaggaattaaaaagtcttgatgtcaggcacaacactgaacacagtatgtagtgagagttcatttattcatccatgctttcattcagtaactcagcagtcagagacctatgtcaaacacggtgctggttgttagggaaataaaattgaactagacacaggctgtgcctcaaaagtttcttactctgtagtgttttggggatcaagtctcatatttgtggcttgaattagtttatacaaatctgcaactatttggggtccaataccatggtaagcatcgccaggagcacacaaagtataaggtgtggttcctctccttaggaaacatgttttgccaagaagatgatacacatgaaacagagaataggagttcttttactgacttatacaaggtataatcatttgttttggggaaaggacaaatctatgtaatctgaagtcatcagggatagtttcatcaaggattgagattttgcttggattatgaaatatgtagtaggattacatagactatatgggagtgaacatttcaggaaggggaacatcacaccataagcaaagatgaaaaaatgggacttgtcatggagtgtgaagaaattataatgtaacatcttaggagagctgagacggggatatattttagagattcttatatttttctaagcaaaactgaacttaattttttgtcagagtggcatacgttcttcaaatgaaaatttataaggtggcacttctgtttaaacatggcagattgaactaagttggtcatttcttgaaactccactaacacagaaaataaattttaagaagggcactaggacaaagagaacaagaggaatgacaagagatgaaagatgtcaacaacatttttgaacatagaaaaaattggcaacagacagtgataggaaagctgaagtttaattgtttagggaatgccagtaaaaaagcaaactgattgttcttcggagccctagaaaggctcaggaattggagacaccaggtaggtctgagagctggggtaggcgtggtgctaaaaacaaaaggactgatgcaaagtccttgtaaggaacattagaatccctgccccaccccactataacctccaggcaatgctgacagatatctgcttcacccaactcccatcctagcaaaagttaggagacttaatctctgtagatgtggaatcagagaagcttggaattgtaccatcagatacacctgagggtagtgttgatatgttgtactgaaaacaggagggctaaatgaaagtctacaaactgaatgtgcgtagtccagcccacttctgcttgactcttaaaaacatagcagtctggtaggagttgagaggattcctcttttggggaactgtctgaagagaagggacaaatttatactgatatttgggagagaccagagaaacaggttcctacctcatcacctttggtgagactcactgtattaattacctatggctgctttcaactaattaccatagctccgcggcttaaaactgtgagagaaacttcattttcttatagttctgaagggtacaggcccaaaatctggtagggccattgatatagtttggctgtgtccccacccaaatctcatcttgaattgtagctcccacaattcccaggtgttgtgggagggacctggtgggaggtaattgaatcatggaggtgggtctttcctgtgctgttctcatgattgtcacgagacctgatgattttgtaaaagggagtttccctgtacaagctctcttctcttgtctgctgccaagtgagatgtgcctttcaccttctgccatgattgtgaggcctccccagccacgtggaactgtgagtccatgaaacgtctttcttttgtaaatgcctcagtcttgcgtatgtctttattagcagcacgaaaatggactaatacagctgtgctccctccaagggctctaaaggagaattgattttcttcctcttccagcttctggcagccccaggcattccttggcttatagccacgtcactgtaatctctgcctctgtgatcatattgcctcttyttcaatgtctgtgcagttttataaggccacttgtcattggatttagggtcattctgataagccaggatgatctcttatttgaacatccttaacttaataatctgcaaagattatttttccaaataaagtaacattcacatgttccaggacttaggatgtgaacaaatcttttggggggctcccagtcatcccattacattcaccattctacaagctccaagcttgcatacagagttgccaatgaggcttttgtgccgtgcttttaaatatgaacacacagctagggatcatcagcatttgaggaaaatgmccaacacawaagaacaaaaaacaaaatcatgaattataaaaaggtaattgagggaatatgaacaatgcagggagtagaagacaaatttaaaagctgtatctgctattagagatagaagagaaaccatttcatttacagaataacaggccaataaattaaaaaaaaaaacatttagaggttaagggctcttggaaattaatgtaaaatgtacattcattttacaaagtaatatatatatacttatatatatttacattaaatataaaaatgaaataatgtaaaaatataagaatgtaataaaatataaaggtaatacatatttggaatataaaattgatgaaattacctacaaaacagaacagcaaaataggattgatccagcttttaactataataggagttctataaaaagaacagagacatggaaaggaagaaattaacaaaaatctaagaaatgttcccagagccaaaagactcacattgccagattaaaagatgtgttgaggcagatgcaaggatgttctttccagcattatttcatggtagtggggagttggaggcaacgtggatgtccataactgggagattatataggtaaaatattggatgtataccatggcacagtatgtagcagtatgtactgtggcatcctatgtagcacagagcaacaaatactgtgtacacatgaaacataagatatcttgggcggggcgcgctggctcacgcctgtaatcccagcactttgggaggccgaggcgggcagatcacgaggtcaggagatcgagaccatcctggctaacacagtgaaaccctgtctctactaaaaatacaaaaaattagccgggcgaggtggcgggcgcctgtagtcccagctacgcgagaggctgaggcaggagaatggcgtgaaccccagggggcggagcctgcagtgagccaagatcacgccactgcactccagcctgggcgacagcgagactccatctcaaaaaaaaaaaaaaaaaaaaagaaacataagatatcttaagaacatagattttagtgaaaacaagaatcactgtgatatgataccatttacataaaactacatgcacacaaaatatacagtttgtgaaaatacattcaaatcaaaggcacattttgaatgtattataatttttttaaatttttattttactttaatgataatttttatagcagggtgatataaggtaggtatggaggtaaaagagaacaaatgagtttaattaataatgaaatacacactgaaaactcagcatgactaatggaaagtgagaaccccaaggtgaatcatcatgaaatttcagaatatcagattaaaaaatattctgaaagtgcctggtaattaggaaggagatagaatttatctacaaagaaataggaatcaggatagctttgggcttctcaatggcaacactgaaagttagtaacaaatagataagttcttaaaactttcataaggaaaataattttcaagatagaattctatacctagctcgaataccaattgttttttaggatgggatcacaatatttttgatatccattttgaaaaagttactggtgaatgtgagtcactaaaaataaggaagtaattgaagaaagagaagaaygtgatactcatggaaacaagggattcgatggaggagagaaagaagaggaattgattcccagggcgatgaacggaagtctaggatgacagaagcctagagagtatcaagcagtatcaagatttgagtagggtgacagaggcctctaaaaatgctatctgtaagaaaaaataaaactaatgtattccccaatgtgtgttattattttcaaaagagctcatggttttgccaaaactatatacagtcatgtgccacataatgacatttcastcaatgactgatgtatatgcaacagtggtcccacaggatttagtggagctgaaaaattcctgtggcttagtgatgtcatagtcatcttaacatcatagtgcaatgcattactcacatggttgtggtgacgctggtgtaaaaaaaccctgaattgtccatcatataacagtagaacatatacaattatgtacagtatatagtattcgacagtaaatgactatgttactgatttggcatttactttcaattgttattttacaatttattcctacttatttttaaaaaagttatctgtaaaacagtctgaggcaggttcctcaggaggtattccagaggaaggcattgtcatcataggagatgacagctccctgtgtgttattgctcctgaagaccttccagtgggacaagatatggaggtggaagacagtgatattgatggttctgaccctgtgcmggcctaggctagtgtgtgtgtttgtgtcttcgcttttaacaaaagattttaaaaagtaaaaaagtaaaaagtaagaataaaaaaagcttatagaataaggatgtaaggaaagaaaatatatttgtacagctgtacaatgtgtgttttaagctaagcattattgccaaagagtctaagttaaattttttctaagtttataaggtaaagttacagtaygtgaagattaatttattgaaataaaaatgtttttaataaattcagtgtagcttaagtgtccagtgttgataaagtctacagtgccatacagtaatgtcctaggccttcacattcactcaccactcactttctgactcacccagagcaacttcctgcaagctccattcatggtaagtgctctacggtgtaccattttttaaaatcttttataccatatttttactatcccttttctatgtttagatatatttagatgtacaaatacttaatgatgtgttataatttcctacagtatttagtatagtaacatgctgtataggtttacagcctaggagcaataggttacagcatatagcctaggtatgtagtaggctataccatctaggtctgtgtaagtacacattctggtgttcacacaacaacaacattgcctagcaatgcatttctcagaatgtaccccttttgttaagccatacatgactgtatgaatatatgtatgtatttgtatatacacacatacacaaaaaaacactctaagcatttaattccatgaaatatgaaattgttaccagtaagaaatataagcatagtaagtaggtcctctattcagctcagttgtcaaccaaatttatgttgctgatgcygaattttgatatagccccttacagtgctgtgattaccttaagtggatggaggaggctgaatatgaggaggggaaagggagggggagatttcagtcaaagactgaaatcttaggttccacagtaaggaagtatttaggcaatatctaaaatggaaagataaagacatttcagtttttaagtataatatttagaaatttggaaatgaataccagaagaaacaggtaaaagagttgaaagtggttgcctctggggagtgaaattcaggggttaggagaggtaaagcagagggctgccagtttttcattagaagtctttcaaaattatttgactttttaaattctacatgtgttactttgaaaaaatagaaattaaattttaaagtaaaaatattgcacacacacaaaagtgtaggacgaaaggcgtatataagaatattcatctaacatccgtgggggaaggattggcatggagagagaccagattcagtaggattaagcaggaaacaaccatagtaatccaacgacgtggtactaagagcctgtggtggtaatttgtgaaaaactgaagacatcgtaaagaagaactttaataatgtttattttgagtggagagtcttaagacataagagatttcttctatatttactcattcagtgagtgtttgttggcattctttgttcgtgcccaagcactgctagacgttactgtctccagccagccagtacctacaactccaatgtgcaccttccataactctggcccccagagaagcctgaccacaggctctcctcttgtatttctactgagaggataatgtcatgtttgtgtaatcttatctgatattctttgtcctaagtgtgtatatattttagtttggaaaatttaagacagattcttactatatatttggggagaaaagtagatgtggtgccaacaaaagccactggtgttctggatgaggctccagcataggtttgagttgtgtcttaacagagctggaaatggaacagaacactaccatactggacagtgccttgtgtctgaccacatggactctctctggtttggaatcacatcttttcattctcttacgtctttctctgcatgggaaacagttgtacattggaagaggcatgggctttagcatctgacattcatgggtgagaagcctaaccctgtaagaaaccacttattagcattgcgaatttggataagttactctgagcctgcttcctcctctgyaaaatgggatagcaatagctctctcatatacaaaaccctagcccagggtctggcatggagtagcccttagctcttattagctgcctatatccttcgataatattaacatacattttctcagcctcttaggtccaggtggcatcacctgcttaacggcctgtggatgttcgattgatccagctgtcgggccatgggctcctctgggagatggtctgcacagattagatgtcatggaactgggatggcagatgccttcttagcacttctggagaagcctaggaagtgacagtggcagctgggaacagctgatatgaataaattttgacattttaaggagtgttcacaataggggccttataggctgggactgaaatcattctgacctggtttctttttctcattctgaagctcagcacagtttggggtgggctttattggtgtctgcagggggttcagcagcagccagtcctgtgtacaggaggggccgtgggttctctcttctgcttggttgtctctcacatgcctttggaaagattgtgagctttctccttagagtgggggtttagttgggatttaattcagaagcagcctgggaaatagcttggaaacctagggagcaggtttcttgtgacctgcaggcagctgaatgttatgtaccaaggctgttcccagagcagagagagacagaaattaaagggggaacacacatggctcctaggttgggcaagtgagggagagagtccatgtgagagggggcaggccacatccactggtgctcagggacccctggatgccaagtgtggaaatgactgaggcacctgcctctggggcacaggcattggtgggaggaaggctgtgaggcatgtttgtcggctcagatttaaagaggaagtatggatggaagcattgtagcatttttacttgtctcaaaggaaatgggatttgatgaaaaccattagcttaggcatgaagagaagcagagcttcctgtctccatggaaacaaagcagggctgcataagcacatcctgaaatgccatcaggggctacagggcagcggctaacacaaacagaaatgaccatgagccatcccactgtctccatccattgttgcctgggcttctggacagggaaaggtaaatatggggaagcagttgagctgtctcaaaaccagagcagggacagtcagaccagagactgcttccatatacgtgtggggagcaatgtgagctctcttgtgtaaagcatgccatagttttcaaagcacctttgcttttgtgatcatatttgttctttgcaatgactccatgcagtatgtggacagtatctttatttggaaatgagaagagggaggtttagttaatctccaactagttactggcagaggtggggccagaggttacaatttctcaacttctagttagtgcttattttagtgtacactacgtagcttctattcagggatactgacacctgaggtggcatacccagagatatgccgccagtggtaagcctggaatatcatcttgaccatatagatttggtgcaagttttaatgtgtatgtgcattgatgtacacactaattcacacacactgatgttcacgtatacaatgtgacccggtatgtgtacagggcagaagatgccaagacccactgtcaaggtcctgctgccctaagactaatgggaagtagtgaagtgtccatagtagaggaggaattcttctggttgcatctcatgaatgcatagagtggctcccacgacaagccaaactacagctgtctgccttgctagcaactcatgtgcaagctgattctgtgcaattcagcaagtgtttattgagtgtctgctatgcaaaagatacctggctagacatttagaatacaaagatgggtaaaatgaggagattgtagactaattatggaaatatttcaaaaatacatgtaatgggactctaagttcaaatagtccagaaggctagtccctccccaaagctaatttttttttgagattcatatatgcaggtcactaatgttgggttcctactatcttgcaaggcattgttgaggataaaaagatgaataagacctaggtcttggccacaatgggcatattaacaactataacttcagtgttaaaccttgcatctcctgttgggtgtgccattgcatcttaggaggtggttcctgagtgtttcccatgcctgacctgagacaggaatggctgctggtcttaagaaggaaattattcatgcccagctcagtgttccagatgagatctctgaggggagttggtgggtattagtttgacgtatatctgctcctcccaaggctggctgacattgaaggtgactggctaacataagggagagtaattctgctgggattctaacactggaatcaaccagtagaaagtcaatgactgactcacgcaagagttactaagtacttgttgtatgtgactcactgctaggggctagggataccaggtcaaacaaggacagagagctgctacccctcaacgggtttgagtctaggaagagatagcaacaggggagcatttaaattagaaggggcaaggatcaggtaaggccaactgaggcaggtgacagtggtgtgtgcctttgaagagccagcgatagtttgcgagcacaagggagaagcacattctagcacagaggcacaggcagaggctcatcgagaagggcttcttgggctaagctggtaagtttaagcttgattccagaagcttgtgggaggttttagattgttagataaggagatggctagatttgcatttgaagatgatcaccctggagaaggtacatagagaagcaagactggaagcaaacagagaggagcagcagttcaggggagaagcagagaagcagcggggctgaagtacagcggtggggacggaaaggacaggacagctccaggaggtgttgggggccaggtgtcggatctgcaggactcgggactgtgtgggtatgtctgagtgggtttggtgtggaaatcagagggaagtcttctggattgcttttaggtttctgaattgagactgtaggtggctgggggagaacacaggccaaagggtaggtcttaagggaaagagggcaggttttggacctgttgagtatgagaaagcgtaacacacttcatgacttttggccagttcacaggagtagagtagggtttgttttaagttgtttttcttgtaagctataattttttgagactgtgctacccatcaagcattgtgccaatcacatgacacatattgtctcatttaatcctcacagtgaccatatgaggaagtactaacttccttttataaatagagatactgtgggatgcttggtaatttgccaaagtaaacaaagctcatgagcagtagattcagaatttggactgagatctactaggcacaaacacctatgcttttaagcagatcctccagatagtttaaatgtcctttatggaaggaaattatctgtcatctagtacagcagaacttgatgaaaatgaacaggtcctccatgacggccatggcacatgtaacttcccagtcctgtggacagaaatttcctgtatgataccctgctatgatgaccagagtggggtgttcataattcctacactgatgagaaggacttttcctgggtgagttgtgtgaccatgggggtcacataaaaagcttatgggagcttgctgagagaatctgcatttccccaagacactgcttagtgtatcagttgtgaaaattgtatcttagggtgagataaaaattatttgaggaagacaagactctaagtgtcgtttgtgcctgcctccttgttacagtggaggaaactcggctggagagtgaaatgacttgctcagtttgtagacagctatttagtgttagaccttggctagaagctagctgccctggctccctgtctggggtgctttttcctccatgccctatgtatagcctagtagtaaaatacagactctagacagtctagctgggtttgagttctgttcctatcacttgccagctatgacaatgatgttaggtaaattatttcacttttctataccttcagttacccaattgtgaataaggatattggtgtttgtcatataagattaccggggaaatgaaatcagataatacatgttaagtgtttaatacctgggtgatagtaattacttaataaatgttagctgttagtagcagatttctttctcaagagcctggtttacactcagtaggtggggctgggaaagagccattcttacctaccaagtactcccattgagtcaattagcatgagctcagatgttttcagataccactggtagagctgaccatccatggcaccctacagggaacagcaaagacagactgtgcccttgggccccacatgaggccatcagcttagacactccaccatttgaagttccttggagtacctgggcctttctattctctgctcatgtggtctggagtaagcctctaattttctttgttaaattcctgctcatccctctcagcttgttttaactttggcttctttcacaagatctttccaggtctataccccccaatctcattttacaattagtattaaaatctttctcccacatgttcccatagcactatatgcctgtttgttatagaatctgtcactcatagtaatatcatggaattgttatataatttaatactactaaagataagatgtaatatttattgaaaccttgtcatctgcccgataccatggtaaatgctttatatacattatttcaattaatttttgtaacagccttatgaggcaggtactgctgttaaccccattttataattgaggaaatggagactgagagtggctaagagtcttgcctaagggtgcacagtctaatgagaggcagagctctcctcccttctcctggatgcactatcttcctgtgctttggagtcacagatgtctctgtcacccattaagttttgtttcttctgctgaggatgtctttccatgtatttggatcgctcctgatatcttagtgccttgtttttgtgttcaagaaatgattgatgaattgaagggaaaccgagtaacatcaggaccctcttagggaatgccatgcccccctatgacctcctggaggatagtattgcagagaactgaggaagaggctggcatcttaaaagtcaggakcataatcactggtactggagatcctcgaaaaacctgcagagaagctgtttgctttctggaatgttgatcccagcttacaagcattacagacaagtaattatgataggttggacatttttacacttggccattgctaatatttttttctttgagttaattccttataccatttgcccattttcccataaattggcatatttatctttttcatatgaacttagattatttgcatagtaaggatattaaccttttatatcatatgtggtgcatgttttcagaataatcacttctaaaggattgttaaagctgttatcctataggcaattgtgggcaaataaggctgttggaagcagaaaaagacaaaacagttattcttttttattttagagcatttggtttataaagcatttcatgtgtttgattcccacaataatcctaagaagtatattagtattttacaaacaaggagattgcagctcgaagtgggcaagtgacatgccctaaatgacaaatgtaagtgtgattttaggactcccagtccagtgctcttgttccacaaaggagtgcttcccctatggagtgggcatttgcaatgggacctttgctgctcagcttctactcacaacagagatgtgatttacacacatgccccagcacaacaacaaagtgctcttttgagttgattaattcaacagatagtgccaaacactgttctctagatgctggggattcaaaaatccctgcctccatggagcttatatttttctgttgcacatgtaatctatattttatgtaatattacccccattttaggactttattattaggaagaagtacaatcagcaccaacaccctgaaattgccctgtattgataacgctatgggctgtgaaatgtgaatgtgaaatgtaatgcagctgcttttggggggaaaaaggctctgattttcttgtattaattaaaattctgtctcctttcaaaaattaatctctagtgtctcttgctgttatctaccttgagaagcagaggcagtgtcaggataggtggttctgggggctcagccaaggtgagagcatccttggctgcagaggtatggcgggggtggagaggtgaagtcatagctgggagaagccaagaatcctatccagaaaggttgcatgtgagaggcagggtgaaggtgttgagggaaaaggaatagagaaatcagtaagtagaactatcaacataaataatcaaaacaaggtactgttttacaagcatttatcctttttaaagcgaactgttgacaattagattgggacttcattaggtgcctttttggatatgaagacaataaccaaatataaaaatgcctccattctctgttcaagttttcacacatgaaatttctggttgaccaagttcttaggtaactgaaacatccttgtagctcctcagccatgctctaacttagtataggtaaatcttctaacactctgatacctgtatacctatatacctatacacacacacacacacacacacacatatacatctatacatatgtacatatctgtgtatatatacacccatatatgcatacatacacacacattttcacacatgtatatgatgttttctattcatgtgcaaactgcaattcatatactccaggatttgtcccttcatttagtacttaaggaacccagtagatgattgtgccattctctgaatttgccttgcagagtgactacatttaaacttatttcaagaatgttccattttaaaatctagttttatttgttttttagaggaggagataacttctacttagtaaaatataacatgaagtaatgtttaaaaagatggctttttagataggtgaaataagttctggtgttctattgcacagtaggtgatgatggttaacagtaaggcattatatattacaaagtagcttgaagagaggcttttaattgttctcaccacaaagaaatgatacatgcatgaagtgatggatatgctaaataccctgatttaatcattaaacaacatatttatgtatcgaaacatcagattgtaccccataaatatgtacaattacaatgtgccaattaaaaaataaaaacaaatgaaaaaaatttaaaaagatggctttgctaagagacagacctggatttaatgttccagtctgctactaagctccgaagtgtacatattcacttagatatcccttaggtgtcttaagcttaggatgccccaaacagaattcattstttaacttcttttcctcatcactaaacacactctctattctttctatattctctggttttcttttactctttctgtgattcttttatcacatttgttatccaagatagaaacctgagttaatcctggtatcttctcctcacttattctctgggcctaattgctcatcaagacctactgattaagtttcataaaactatgtcctggactatagcaattgtctttttaaatgttctccctgctgtaatgcagcctgctattcatgagaaaacagtctttacaaaccagacatttaattatagaatttgtataccttagttatttataatgggatcccattgcctaaacgatagaatcacttatgtattcacttaaccagttttcaatagatgttgagcttctgtgtgccaggcagtattctagatgttaggaatacagcagggaacaaaacaaaaatccctgccctcataaaagttgctttccagtatggggagagtctaaggacatatattctgatttaggtaaatgaaaagacaaaccctgctcttgaaaaggaatacttcaaattacaaagatgtctgctttctccactttagtctttaatgtgatattgataaatgtaaacaatgtttttactaaattatattaaaatttatctgaaaatgtaaatgtataagagtagccaagacatttccttaaagaacaatgaggaacaggaactttttatatagggagtaaaatatattctaaagctacaataattgaaatgatgtgatataatataggaatacaggaaccaaatatatatatatatacacacacacacacgacatatattgtgtatgtgtgtgtatatatatgaatttacagtatatataagtgtaaagtgtcatttcaaatcattgaaaacraatcattcagtgaattgtgtgactggctagttacttggcaggacaaaaattgagttggagccccatcttatatcttatatcaaaataaattgcaggtggagctagtacatgcattttaaaaattaaatcataaaaggattcaaagaaaacacagacaatttaaaaacttcaagggagaagacctttctaagcattatgcaaatcaataagccataaaggaaataattgatatgtttgaatttgtaaaaataaaaatacactgaccactataatttattaataacttccaaaaacaaatgagttagttttaaattttagattgattatatagaggattcaggaaggtgataaaaagatgattgataagtaataagattgtaataaagctctagttccagacagaaaatgaggatttcaagcactgatggctgaaatgtaaggtgaaaaccagctgaagattttaagtggtaaaatagtcaggagatgatgaatgactggctgtaagcagtagggaagatcacctagtatatgatcccaagattcagttgcaaatgttttggagaactttggttccatttactgacatgaataatagaagaagaaaaaagctcttattctgagagaaaggtttgtttaattttagrcttagaaagtttgaagttcaagaggcctggacaagtagataggatcatccaatatctgtgtcttaagaaaagagggaggaaagatatgatacactatcagaacacaatagagaaaatggtacaaatacataaggttatccatggaggggaggtagagaagaaaaaacagccacagatagaggtttctagaaacaccatttaagagaatattaagattttcaaaaagacataccagaaacatcacatcatagaggatgaagaagtacagggtttcaaaaaggaatgagaagaccccaagtgctgaatgagtcatagagatccaatacacagttgactaaaaaatagctgttgaagctggcaatgtggaggacgtgtctgtcttttttttttttaactttttttttgaaataattatagaatcaacaggaagttgtaaaaaattacagggaggtcctatgtattcttctcccagtttcccccagtggtaacatcttgcataactgtagcacaataccaaaaccagaaaattgacactggtgcaatccatagagcttcagatttcaccagtttcacatacactcatttgtgtgtgtagttccatgtaattttatcacgtgtaaatttgcataaccactgccacaatcaagatacagaactgtcctatcaccataagaccccttgtgctaccctttatagccacatctactatcctctacccttgccaacacattcttctaattttgtcatttcaagaatgttaaataaatggaatcataggatagaaaactttttgaaattgacctttcttcacttagcataattgccttgaagtctatccaggttttccatgtatcagttgttcattcctttttatttctgaatagtattccatggtatggatataccacggtttgtttccatgcactccttggaggacatgtgaatttttttcagtttgggttactacaagtaaggctgctatgaagaacatttgtgtacaggtttttgtgtgaacataaattttcctttctctgggaaaaaatgctcaagagtgcagtcgctgggccatatggtaagtgcatgtttagttttataagaaactgcctacctgtcttccagagtggctgttccattttacattcttgctagcaatgcatgagacttctggtttttccatattcttacctgtgggcttagaaaattaaataatatacaatgaacattaataagtatcttattaattaacaaatttatctcgaagttataagacaataatgtagacccaggctgggcatggtgactcatgcctgtaatcccagcactttgagaggttgaggcaggaggattgcttgagcccaggagtttgagactagcctgggcaacaacgcgagactcagtctcttttaaaaaaaaaaattagctgggtgtggtggcatgtgcctgtagtcccagctattcaggaggctgaagcaggaggatcacttgaacccaggaggtcgaggctgcagtgagctgtgtttgtgccactacattccagcctgggcaacaaagtgagaccctgtctcaaaaaaaattataataaggtagaccaataattattaaatcatgtttttaaaattatggaccagtaagttctcaggaaaaaaataaacaacaaaactaacattggttgggtagaaaagttgaatacagagttaataacttttaattttagcagttaaagactttaaaacaaatagattaatcacaaaaactcaactgctagcttcactcaccatcaattcattaaagaaaaggtccaaattaatgttctttgttttgcaagacctctcaaagctttgctgcaacctacttttctagcctcaattcaacgattcctctgccttagcctggccacacggctcactgttccyggatttcccaggtaatcacttctttggctagaaataaccaacccccacagccacttccacccactgctgtatttgactggggaactctgactcatccttccaggtcaagtttcttcatctgggttcccattgcactatatatactcctctattagagcactcgttacgttattttatagttatttgtggaggtctttgtccctttcacaggattacgaagaagggcatcatggtgagttcactttcttttccccagcatttagcaagcataattaacaagcacacagtaagctcccagtaaatggcctcaagtgaacaaatcaaaggccaacttcctgtttgtgatgtctgtattcatcagaaattttcctgagattttgagcattgttttcagtgtgcataattcccctgaaacccaagtttaatattagctgaagagcagagcacaaggcacttgtagtaggactccaagaagtgtgccactccaagaacgtctccattacatcgagaaagagggaatatttgttatcagcatgatggacatgatcccagtgtaattgttgctgttgtgaaggccttttgaatggttttccctctccccatgataatttatctcctacattcacttcactatagctttgataccaaaatcttgggcttttccagattagaaaaaaatatgtttttgtttaaacttgtctctttttctggtctatagaacctcataataattggctttgccacatggaaatttgtaataacattagagccccacatcattctgaggttatagtccatagtcgaggccctataattagacatgttttctgtgcacttgcagacacgtatacactgaggtggctgaaataatacctcccaatttccccggctgataatcagagtctttacaatttggttatatactgggtgcttggcatttctagctgttaagttgagaagctgttagagttgtagttgaattaaaagttattttccccttggtgtcaagtgtatcactacattctcaacacttaattatcgttgtgtcccaaaatattcttcatttagcaaaatattgaaattactctttcctgttgaagaagctaactctactatgcaagagagcactgagatgccgtgttccacagagaacccaggaaatgaatggcatttgagggcatttggggcaactggaggagccccaaaacctgttaaaggggccacatattcttacctatattagactcaacttgatagctaatctttttagcagctgacacgtcctcaggctgaagctgaccagaccaaaagaggcctccccaccctcggcagagttgactgaaatggcattaaagtaggacatgacttcccttccccatgcccccaccccactaccttttgtgctgttcacagagaagtttctcctccatcctcttgtccctgtgttttcacattgtatgttctatttagatcaaggtacccagtgaccaaatataatatgaggaagggatgatctaattatgagcaattaataccttagtgagcaagagctgaaggaggaaggtacagactaattttttaaagtaaaaggtggtaagggggagaaatacttctttgatcacttactaaaatatctaatcacaaacatttattcatttattattattgttattattgagacacggtcttgctctgtcacccatgctggagtgcagcggtgcagtcatagctcactgtagcctcgacctcccaggtttaagggattctcccacctcaaccttcccagtagctgggactacaggtgcatatcaccacacctggctaattttttgtagaggtgggatctcactttgttgcccaggctggtctcaaactcctcagctcaagcaatcttcctgccttggcctcccaaagtgctgggattacaggcgtgatctactgcgtccagccaccaaacatttgttaagcaccaatatgtcaggcactctgagtttgatagtgaacaagaagatgcagtcccttgctcttatgaactttatttttctcatggctgagacagaaaacaagcaagcaaataacacaaataatgggaaatgttatgaagaaaatgagcaggctttggatagcaactttgattcctgtcttagaaagaaaaaacaatcagacttgagagaattgctgccagacttctacagcctgcattgatctgaccccgtgtgattctatggatatgcttccctcacctgacataacggctcccacactatttccctacaggagaaatgatgcttgtgtttctctagtggccagtgtcagttactctgaagatgtgatttaccaaccaactgggctaaacaaacaaacaaacaaacaaaaaccggagcaataggaccttgaatgcataattaacttgtgtggaaggcttcattcttcactcaggggtgttaaaaaggatgcctttgtgagctaaaagcagaactaccatttgacccagcattcccattactgggtatatacctagaggaatataaatcattctactgtaaagacacatgcatgtgaatgttcaccgcagcactatttacaatagcaaagacatggaatcaacttaaatgctcatcagtgacagattggataaagaaaatgtggtacatatactcatggaatattatgcagccataaaaaagaacaagattatgtcatttacaataacatggatgaagctggaggccgttatccttagcaaactaacgcaggaagagaaaaccaaatacctcaagttctcagttataagtgggagctaaatgatgagaattcatgagcacaaagaggagaacaacagacagtggggtctacttgagtgtggagggtgggaggagggagaggagcaaaaaacataactattgggtactaagtttaatacctgggtgatgaaataatctgtacaacaaatgcctgtgacatgagttaacctgtacatgtaccccaaacctaaaataaagtaacttttgaaaaaaaggatgtctttgcattaactagtggggaaagttgccctagtggattaagtaacttaatatttcttccaaaggtaatgatctggaaaccaagactgtgcttttattgatatcttcaccttctaaattccctctgtaaacacctatgaataggagggaagaaaggacctaaagtggtcagagggaacctcgaggccaaggccaagttgtatcccagactgtctggctccagagaggaaggtcttccttcagtcattcatttctggccccctttcctctgcactaccctcagaaacagtagcagatacctattgcaaggttgcgctgtgctggtcatgttcacagacaatgcaaacattttccctgctttctaggcatttcttatccatatagtctttcaaacctggtcaaggttttctcctggcaaaatttgagaagttggtggcatttgtatttgagatcatgcacctttgctgtcccttagtttaatgttccccttttctcttccctgtccttcggtcagggaggagttatttgttggacttaactagctcacgtatggggttttggcctgggttccctgaaagacgaccccaagaaaagaattggctgcaaaagggagcaagtgagaaaattgaggcagagaaggggaaaaagccaaagagttatgtgttaattgagagggttgtcagtatgaactgctgaggcttaatccactgggaaccctagaaggaaccatgtagaacgtacctcagccctgctccaccaagcaactgggaaactgggacatagatacatgtatctgtatgtttatgtatgtatgtatatgagtatgtgtgtgtgtgtgtgtgtgtatttttcccccatccatcaatccctgtccatccttgagtgatgacactttggggctgccctgtttgtggacttaacagtgcctggagaaattccgtaggtggagaagcaggaagatgtaagcactcaaagtgggcactgtcacatacctgtgtgagtgtttaagtcctgtccactgcagctgcagaacccagaggtggcccgaggggatatggggtggcatccagagcatatgctcttgctccacattcaaggagtagatcattcattcaacatttgtggagcacctactatgtgccaggaacagcttttccaaggtgagtgagttagaagaagcagagtgacaacagaattcaggactagagtgagccggagagcagatggtccactgcccagaaagaggacatcccttatagggccagcggatggaagccatgggctgggcaggacattcctgtcccaacccacatggcagctagagtcctggaaattacagtcgacatgaccccacccctctcctgaaacacagtttcctcctcccaaccccacccagcagtgcacaccccaacacccgctctgccagctctcgttcgttgcctctttctcctcaatataaccaccattttattttatcccagctcccagcgtgcatttgtcctgcacagccttgctgcccttcaccctgctcctcagtgtagagtaccatgttcccgttattattgttcagttccccagccacacagctaatcctgttagggccaatttaggcaatacaagagtctggagcttttatgacctaagcagttggggctctccttatgctaccaatgataaatgatagaataagtaagcagagggctgggcgcggtggctcatgcctataatcctagcaccttgagaggccaaggcgggcggatcacgaggtcaggagatcgagaccatcctggctaacacggtaaaaccccgtctctactaaaaatacaaaaaaaaaaaaaaaaaaaattagccaggcatggcagcgtgcgcctctagtcccagctgctggggaggctgaggcagcagaatggcgtgaacctgggaggcggagcttgcagtgagccgagatcgcgccactgtgcactccagtgtgggtgacagagcaagactccatctcaaaaaaaaaaaaaaaaaaaaaaaaagaataagcagagtctcaattaaaatactcattgatcatgtctgatgtcacagagtttaatcttaaattcagtagacccataaattaaaaatactggatctcagtagccagagggtcattctgtcttagagcccctggacacagtccccctaatayggaccaggcctcatctgaatgttccatgccccctcagctgcgaattcccatgttttctgggccagttatctgacctcttcctgcgagggcagtgcagcaggggtgtgggctctcagggggacagagggactctgccacaggcttgacctgaccatctctctcaagtctctctctacaccccagcacagagagagcagaggtctgcagagtgccacccctctagcagctctgtggaccaaacaagcatttcacctgcaggtgccagctcagcgtgccagggcatgagtgtcccccaggtggcagggtgactgcctttcttaggtggcttatgttcagtgtggaagttcaggctctctcattcctgtttcgattccttttccctctctgtctcacctggtctttgatagcaaaggttagtgttataattaaacaatcaatttagcaaattttctttggggatttcctttccttttgttttgccaactgtaattcctccagtctccagagagatcccctgtgaagtgcatctgaggtgttttcactttccctcatccacagttgttgttgttttcagggactaacaaatgacaaataagacacagcatgttcgtggtttatataagcaggaaggaatatatctgcttctctctgcaggaagagaggaggaggaaaagaggaggaggcacagctgatggctgctacccaaggccttgctccgaaacatcatgggtgaytgggagtctaagaatattaattggagacagtgggaacaggggtaatttcacgtacccagtagggacatgctgtgctaagagcgtgtgagaaaatagcgtgtgagaaaaaatttacctgatggtgctgctataggtcttattttcttccatgttttgtttcttatgcaaaacgtatatgtgttaagagaaggggatggggaaggagagttcatggaggagagaagaggaggagaaataaactttgaaaattctagttgccatgacaacataatgagctccaaaagtggcatctctgaaccagttttgcatgggaaggcagagaagctcaaaagggaaagaattaaaataataaaaataataaaacagtgatcatgaagcaaaggatacatctgaagaggctgtkagcccttcttgtcaccctctgtgtgttgggagtgtcaaagctgcttgctcctggctgacctgggcagagcctgcgggattgccgtcaggggttggaatgcctttgcagcctcccgggctctggacaatgcgcagctaagggattttgacaaaaaagacctcatgcattgtgtgtgaagtgcattgtgcttgagaacccattgcaagccaggctgtcttcctgctccgtttctcctccctttcctccctcccacccgccctttcttatagctcagctttacycttttcaatgaatttcactgtagcccaagcgacagtgtgtgctgtgtcactcttaccaccatggtatagaatgtaaaatccccattattgggcactcrttagaactataaggctcttctccccagcaaagtgtcccagagctgtgcgaggcttatacaaaagaaggaagcattgagaagtgcagaatgtgaaagccaagaaggatttgtaggtaatgatgtttttgcccaccatactcaaattggaaatgcacccacagcatcttagaattatttattattaaaagtgtattttaatgaagatatcccttggtatcccttgtcctggttcaagtcgtgttcatgttttcctcattataatggccaggacgttgcactacatatgtttccataatataatcggtgtttaacagcatctgagccaatccatcagttaaggcacttgttctgagaactggttgaatgtggggatcctgctgcccccttgtgcttgtttgatattgttgcccacgagactatctagggtgtacattatgatgtctctaccaccaagctctgtgtctggcacacagtaattaatatatgttgaatgaatgagtgcttagttccagctgaagcatgaagccctccttagtatatatgtgctccggctagactccaacgaatagctgtttggcaatacatgtcaagttgagtggatgatgtataagtgaactaatatcccctatggaggacagcaattctcagtgaaataagcaaatcattgtgtgagttctgtgtatcagcaaagattaaatctattaagtttttagcttctttcagatgttaaccacttaagtagttaatatttgcataatgcttcctatagtttagaaccattagtcagtgaggggaacctccttttctctgttatatttcttggtggaagaacttcctccagaaaacactttttaggcctttgtcatcatcctttgctcattcctcctgaactgtaatagatggatttagaagaactggctgtgctcctctcagcttcttcctcctctttagaactggccggccctccaggaacgtatcttctctactcccttttgcttgtagcttctgggacagtgccctgtaatagggtaggactgggcttctgtggttgttcctatgactggatggttcaaaattctggggtatacactcaggatagatctagaagatagatgatagatctaaagtcatgttctccaacttgctttatcagaaatgaaactgattattttttgtctttatttatctaactccagtatgtcccgtgtctcagctggtttcataatcaggaggggaataaaaggaaaattgtatactgatccccacagcactgctatacatgattagaaagtcttttccccctttaaacatgtaattttaaatgatacaatacaatctcagatgtgatttttgtcaccttcaagacatccagcaattctagcaccttagatatttatatcgcaggtcagttggaaaagagtagtcacaaaacacaaattatgttcatagtacacttggctagtgtgcaatttcctgatcaccaaacacaggagaattcaaaagaagtatgaaacctggtcctttgtcttgggggcttatttcctcccacagaaagctgaaacctgccacatcttttcatatgggtgatccctgaaataggcattctgggctggagataccactgtggtttctatcatgtaagagcagttttgtagaagaggtgagatttgaacagggctttgaaaggtagctggaacttatataagcccaggggtgtcatagagtgggttttgggggagaagttttaggaatarcaggatgatccccaactttgaggcaggccctaatttatttgtgggataaaaasgatattgaatatgagagtggtgggaacatcattggtttagttaggtctggttagatcatggaggacctcacagcagagggaattaaggcaggagagttactgtgggtgctggatggagggggcaggatgaccatgcgggacatagtatttggggaagattagcttgcaggcctgttctgtggatgaggacacttgcttgtctgggttctctgctgcctcttcaactttaatcttctaggaactctgagtggccccagcatgagggctctagtggtgcccctctgccagccactctgaactgtggcagacttgcccagcacagaagttaggataggctgtctctaaaagaggactgagagagtgtttattctacccagaccatggctttgagattggatatcaggatgcatgttatttttttaaaagagcttttttgttgttatcttctagataaatgagaaatcagaaacaaagtcaccattcacctgaaaaggcaccactgtctgggagcagtagcaatgggctatatataataacaataatgataataaaacaggtactgtttataaagtgttaaccgcctgttagaacttttcttattgtattgctgcacatctatctaacatgtatgtatctaacaaggacatactgaactaacaaggacacactgaatactggtattaggatttgaaaaggctggggtaaatacagacatacaaaaacaaccctgatttgaaggttttggaaggacctcttaggaaaagagggaggcaatttagcattgttttggattacggggctcaaatcctcattcttcatttaattagctgtgtcaccttgggcacattttctaacctttctcagacttagtttctccacctggaaagtggggatcataatatttcatggagtttttgttgattaaatgatgtaatgaatacaaagaacttagcacagtgcctggcacataagagatgttcagtaacacataactattaagaacctcttaaactagcctcctgtgaaacatgaattttctattattcatttttatctttgagttaaggctttttaagagcctctagataactacaaatatgatatctggtgaaagttccacattttcttcctcatggtctttcacacctttgcatgacgcacttactggcacctaaggatgacagagtcccaggagagaggtactcagacaggacagagtcattttaatagatagggagtagagttgtaaacgatgaagaaatctggaaaagaatagccggaaagttaacaaaatgtattggataactacaatgtgctaggttttgtatattatctcttccttacaacaattcagtatgacaggctgtgtttctccatattacccatggtggaatgtgaactgcaggagccttgcatacttccccaaggatccccagttagtaaattggggactaggatttttcacttgggtctctcttaatccaaagctcacgtgctttgtcctacactctgctgcccctcggaaaatgcacagagcaaaggtcctattagaagaaggcaaactcgggccagrgctcctgggcagccagggggcagataaggacataatgccagggagctccatgtaaacacgtgaaagagggaaatgggccacaaggtatcctttcacaaacggttacttccagtgtccttagagctggcttggtctcaggaggacagagaggccacactcacaaggcatattacccatcaggatggcactgcagtgatgggattctgagatctttgtcctcctcctgtcagtggctgggctaacagcaggccaggctggacagtggcctgggaacatagggcaggcaggcaacctgttacttgccatagaagtgtgcagaattgacaaatccatgttcagaagggcatcaaagtccgggtgaggctgatcttctaaagttaagtccacctgtaattccagtgctttgggaggctgagcggggagaatcacttgagcagactgggcaacattgtggaacctcattttgacaacaaactttaaaaataaaaaatattagcagagcatggtggtgtgtacctatagtcctagctactcgggaggctgagacaggcaggttgcttgagcccaggagttcaaggctgcagtggttgcatcactgaagtccagcctgcatgacagagtgagaccttgtctcaaaaaaaaaaaaaaaaaaaaaaaaaaaaagagtccccaatctcagcagctagacagagagcaagagtcaagacccaggagaaaccagtgggtggaagggaagcagtgaatgaggggaatcaaaatgggcatttgggagatgtcactagaggtattccctgggcagagaatgggctgttagtgtggttcctatgtccttcttgtgacagtggctaggcactttcaaggagccaggtctgacgtgctatgatgcatgagcctccaaccattagggtgaaggatgtgatctggggtgagagcacaagccaatgatgtgacaaccacatgggcctgagtgagtgaaaactgccacagtgagcagcgtgtaggctgccaacccacagggccgggaaagtcaagaactgtgtgttccacccgcacatgttctctcatgcacatgccgaccagcccagcccaccctgcttctcacacgccctgcctccggaaacgaagagccaaaaagggaaaacctcccgagagtgctttttacatcttgccagacatcggtccacgcagcagcacacttcaccacaccccatccctgtcctcagttatcctctgtgttcccagtcagtggtctctcagccttgaagctctttcacctccttggggcgcttgaaaacgttggccagttccttgagaccttccttctcccctagatttctcatttctcacttcctatgtgtctgaccactccctcccagcatcagtaggagaaaccttcagccctgttgccataggtgctaggtcagagttgcttcccaggtgtcacacagggactcaggctgaggaayactccattgtctgccaatgctaccttttcaacaagtacccgtgcagtcgccctggaagaagggaaaggctgcagagggagcactgtcagttaaatgctttagggcggtgtgtgacagttctactgacgtttcattaggaaatgagtcacgtggccgtgcctcccctcaagggtgaagaacagttgaggagaactggatgtgttctttttctctgggttctgggtggttctccacagggagctgttctgagcgtgattgcctaccactgctctaagccttctgtgtccttgtgaccctcagatccatgtccccaacttctgcctctcctgtgctgcaaagccgtattttcaactgtgtggtagattcaaatgaagtacttcaagcttagcatcccacaaaccaaattaatttcccctaccaaaaacccacttggccatcttggggggcctctggaattcctggagcatccttatctggtctgcaaattcccttttattctgtgaaatgtctgttgctctccccatcctcctgtttatttccagtatccttgatcctgtcacacccaggtttctgccatagcctaccaaatggtgtcccttcctcctctttagtttttggcaaaaacatagctattttcctaaaaatagacctaatcatgttactcccttatgtaaaaaccttagactatttcctacaacccacagaatgaagtaaatcacatcaagtcattgggggaatggggttgtatttgaacagaaccagacaaggatctgaatgctggtctaccacctaccagctgtgagtaagttatttaacttcattgactctgtttttcaatctataaaagggagataatgatacctacctcacagggttgcctttattttttgctgtgttctgtgcctatcatctggttggctgggggctttgggcaagtcattttcttcctctacaaccarggatggggaagcagcttctctctgacctcatcacttcctactctcttgcctacttctcttcagccacactttctataactgtgaaaggggaaagagaagctctggaggtccttaccctggcaatgcaatatttgcccttaaatgtatttgccagaactggtcatgtggccacatccaatgttgggggccaagaaggctgggagccaaaagtattatgtgagcagcgttaatgactatccgattaacgatgaccccatagtgggtatagacccttgccctttggagtgcctcttgcctggtcaaggtctgacactgggaccccgtgtgaccatagttcagttgactttgtcagatttttcttagcttccttccaaagaggatgggatacacaatacttttaagtacatttaggacttgatgataaaaactgaccctccaagatgctctaactagaaggaatgctgactatcttcttgtcagttttgcttatcacaggtgaggaaaccggaggaccaagaagggtgagacattcccgccaagctggttgctggcatctcagactcagtatggccacctctgaactctcattgtccctcccagcaaatcccaccctccagcctatatttcctcaatggctggttgtattagtctgttctcacattgctataaaaaaatacccgagactgggtagtttatgtagaaaagaggtttaattggcatatggttccgcagactgtgcagtaagcatgattctggtatctgctgaacttctggggaggcctcaagaaacttacaattgtggcagaagttaaagcaggagctggcacgtcttacatggcaggagcagtaggaagagagtgagtgagtggggaggtgctacacacttttaaacaaccagatctcatgagaacttactatcacaagagcagcaccgaggggatgctgctaaatcattcatgagaagtacctccatgatccggtcaccttccaccaggccccacctccagtgttggggattacagcttgacatgagatttgggcgggaacacagatccaaaccatatcactggtgttgccattgatctctacttgtcctttaacatgcagtgtcctcttccatgaataccttccccagttccttccatagaattggagcccctcccctccctatgttatccatgtcccatttatggcatatgacgttttatattggtttacttgtctggctccttggtagataagattgacttgagtacagcaagggcatcttatgcatcttatgcatctttgcattttccagtctagcaagtggcactttatgcaatggcactggatagaattcttgtctgaattattggaaaagaaccagttcccacaggttcaacaacaggcagtggaagagttggaacttctgatttttgttctcagtcacttactactgaattgcatttagcttacagtttttcagtctcctgcagcattgtgttccatgctcttatgcttgggtttaagagacttttttaagatcagattttatttctttcttcttttattttaggttcaaggaggtacgtgtgcaagtttgttacataggtaaattgcatgtcactgaggtttggtgtacaaatgatttcatcacccagatagtgaccatagtacccaatagggagtttatcattcctcactctcctctgatcttcatcctcaagttggccctgatatctattgttaacctatttctgtccatgtgtactcaatgtttagttccctcttataaatgagaacatgcagtatttggttttctgtttctgcatgaagtcacttaggataatgtcctccaactgcaacatgttgctgcaaaggacatgatttcattcttttttgtgtctgcatactattccatggtgtatatgcaccacaatttctttatgcagtccactgttgatgggcatctaggttgatttcatgtctttcctgttgtaaatagtgctgcaatgaacatatgtatgcctgtgtttttatcgtagaacaatttatattcctttgggtatatatacagattgctccttcaggccaggytctaggggaaatatgacaatgacttgatcaggtttgctaggtcaaatggtagttctgttttaaattctttgagaaatctccaaactgctttccacagtggctgaactgatttacattctcatcaacagtgtatacgcgttcccttttctctgcaactttgtcaaatctcttattttttgacttttaataatggccattatgactggtgtgagatggtatctcattgtggttttgatttgcgtttctctaatgattagtgatgttgaacattttttcatatgctttgttggccatgtgtatgtcttcttttgaggagtgcttgttcatgtcttttgtccatttttaaagggcttgtttggttttcactgttgatttaagtttcttatagattctggatattagatctttgttggatacatagattgcaaatattttctcccactctgtaggttgtctgtttattcttttgttagtttcttttgctgtgcagaagctctttcatttaattaggtcctacttgtcaatttttgtttttgttgcaattgcttttagagtctacatcatgaaatctttgccaaggccaatgtccagaatggtatttcctaggttttctcctagggttttcatagttttaagtttttcatttaagtctttaatccattttgagttgttttttgtgtatggtgaaaggaaggggtccagtttcaatcttttgcatatggctaaccagctatcccagcaccgtttattgaatatggagtctttccctattgcttcttattgtcaactttctctcttgtcttcatttggtttgctgatttgctttgtttcatgtttggtgataatgccatattcccattcaagatggatgttcttcctaaataaaggattttttaaatcctttttttttttttttgccttgttagtgacatgctacagaaaataaacagggtaattctgatttgtgattggacagcctttgaattaaaggagtacatatggctttggggggcttaatatattgtaaagactgagttactcttgagattctctgtaagtttttcaaactgtaaagtggctgacatttgaaagtattatatgtaacatccagcatcatgtctgctgcatagtatatactaattaggagaatttgatgaacaaatggagaagttttcctcccaggagcatgcttacaaaggaaacatttttttttttttttttgccttgcctaggtagcacatagcccacctttaagtttttttttttttttttttgagacggaattaagtttttaaatgatttttatatgtgttatttcatgtcctcataacaagttgttgtgcaaccatatatattatamctctcaagtcaagtattatgttatgaatgccttgtacaagtgttgagggaaccgagttggaatgtgaataactaacccagtgtggtctatcttctgccagtaacagtttcattgcacaatcttccttactggaggtcagtcaccttaccccactgacttggcccctcttggagtatctcctttttacttttggaaggttctcagaactttctcaataatatttcaaattgccatgttttggccaggtgttttcagttgtgtaaatcttaaacccatttctggaagatgttctcagtcctggtctcacctattcaataaacttaaagtttctgctatgagttaagtgctctgttaattttggtggggaaagcacaaacagacctrttgttaaggcacactctcaaactttgtctggaagaccttttggaatacttcacctatatctcatagttttattatttctggtttctcaatacttactcatttgtaccccacttgtttcctatgttgtatataaaatgaccctgtcctttatattttttatctcctgcatcctagttctctaagttttacttcctgaaagcaatcaaatgcaactaacattgggtttcatttgagttagacctgtagagtgcttgggctagaaaggctctcagggagcactttgcagttaaaatgaagccacccccacccgcccccactctctgcctccccagggtagtcttgaccaagacctagagacagtgaggggtagattagggccagaatccaggcccctgactcctagtcagtaccctatgtctacctatccttgtccggtgaaccttttgatatttgatttccatccttgttatccctttttctttatttgatgctaagctattgtcatcattcctcattagatccaattacagaggcttggaggccagtaagaaccaagttttttttttttttttttttttttttttgagatggagtttcactcttgttgcccaggctggagtgcaatgatgcgatcttggctcactgcaacctctacttcctgggttcaagcgattctcctgcctcagcctcccgagtagctgggattacaggcatgcgccaccatgcctggctaattttgtgtttttagtagagatggggtttctccatgtttggtcaggctggtctcgaactcctgacctcaggtgatctgcctgcagcagcctcccaaagtgctgggattacaggtgtgagccactgcgcctggccagagccaagttttttaagggatggcttcaygtctgagttttggcctttcacactgacttgctatggctggtagcaaggtgatgaggctcttttaatcttcatagatatccagataatacagcttggatcactgatagtaggaattacaaggccctcctaatccagtgaggacatggtgttcagaggccaagacatggtggggatgcttgcagcaccttcatgtgaagagtttccctgcatggaggtgtttggaaaacaggcttgtgggtgaggggcaaagagagttctaaaaagactgcattgaccttttggatttttctgtagctcacctcaaagacaggcagagatcctgggtgacatgtggtgccaatttttattgtattcctactggctctgtagatattgtcttttgttatgtccttggcaagagaaatgtgattgatgtgattgggaacatgagactggtggggtgggggtggttctcaagctccccataattcacagatttcaagagaggagcacagaaggacttcatttgaagggaggaatgaaccatctaacctccagtggcagatgggagccgagaccctggagtcattggggcagcagttgcctgagcaaggggaataacagcagtttcccaccaaaagtcttctattgggattttcatgttttctgtcctgccttttaatgttttttaatgaacaataggatctatgactctttatgccttggggagtcactcaggacaagtttcatacccccacttggagttgggattattatttactgatttagacagcttggggggctgtcaccacacttcttctgtcttgtccagttcacccctcagctggctaagtctgagaaggtgttacacgcacagctcaggaagaaggcatgcctaagtttctaactaagtgaatgcaaggcagctgggtctgagagccccagaggctcacctctgcacatggtgagggaaaaataaagatggcttctgagtgattttatgacttttgaaagaaggggcattgggacaaataaaaggatacagccaatggacacgcagttctttggactggaagaaaaattataacctgtttgcttttagggtcattgtattcatctacaatagtatatggtttgttacagattccagggcattttccrtatatatattttattttttttcctactataactttaaaagacattatttcccccattatttcaattaataaacaaaggcttattgatgatttaactagaatcacatagaatatgccagagtcagaacttgaaaccacctttattccttctggctcagtgttttttctcttattattcaatataactcaattccctcataaccatgaagcattgtgttttygtgacttatggttcattgacttccaaacatcattttgtctgaaatatttcatatacacaaaagaatatatatatattacatatggtttgttccatatatgtgggacaaatgaaaatgaaatgagtatctgggcactaacaataaagcttaagtgatagaacattactgatgccagggaaacccaattgcctttcctgcaactctcgccctcccactcaagggtagtatttattatccctttgcttatcatttagttttaccacttgtgtatatttccctatgcaatatatcgctaaatgttatatgaattgtaaaatacagtgtatgtttttatagaggttggttcattcacttcactttcgctgctgwgcagaattctacacagcagaagtgtaagtgtattgcaagttatcccctctccacttctagaattttgctaatgcaagtgacattgctatgaagattctggaaattttctggggctataggacatttgcatgcttaactctgcaagataatgcccaattgctcttttcccctatcctttttaagttataattgacaaaatttttacatatttacaaggtacaaagtgatgttttgatatatgtatatattgtgaaatgtttaaatcaagctaattagtctatcacctcaaatacttatcatttatttgtggtaagaacatttgctatctactctcagtaattgtcaaatatacaatacattgatattaattagtcaccatsctatataatagacctccagaatttatcctgtttaactgcaatttttaccatttggctaacatctctccatttccccttcccactccagcacctggtaaccagcaggtgctgctggtctactccttgcttctatgagttctacttttttagattccacatataaatgagataatgcaatatttgtcttcttgtgcttagcttattctatttagcataatgtctttgaggttcacttatgttgtcatgaatgacagaattttgatttttttaactttaagttctgagatacatgtgcagaatgtgtaggtttgttacataggtatacacatgacatggtggtttgctgcgcccatcaacccatcatctacattaggtatttctcctaatgctatccctcccctacccgccccctgattccttgacaggccccggtgtgtgatgttcccctccctgtatccatgtgttctcattgttcaactcccacttaggagtgagaacatgcagtgtttggttttctgttcttgtgttagtttgctgagaatgatggtttccagcttcatccatgtccctgcaaaggacatgaactcatccttttttgtggccacatagtattccacgatgtatatgtgccacattttctttatccagtctatcattgatgggcatttgagttggttccaagtctttgctattgtgaatagtgctgcagtaaacatgtgtgcatatatctttatagtagaatgatttataatcctttgggtatatacccagtaatgagattgctgggtcaaatggtatttctggttctagatccttgaggaattgccacactgtcttccacaagaattgaactaattgacagttccaccaacactgtaaaagcattcctgttcctccacatcctctccagcacctgttgtttcctgactttaataattgccattctaactggcatgagatggtatctaattgtggttttgatttgtatttatctaatgactagtgatgatgagctttttttcatatgtttcttggtcatataaatgtcttcttttgagaagtgtctgttcatatcctttggtcatttttttatggggttgttttttttcttgtaaatttgtttaagttctttgtagattctggatattagccctttgtcaaatggatagattgccaaagttttctcctattctgtaagttgcctgttcactctgatgatagtttcttttgctgtgcaggaactctttagtttgattagatcacgttggtcaattttggcttttgttgccattgcttttggtgttttagtcgtgaagtctttgctcatgcctgtgtcctgaatggtattgccyaggttttcttatggggtttttatggtttggggtcttacgtttaagtctttcatccatcttgagttaatttttgtataaggtgtaaggaaggggtccagtttcagttttctgcatatgactagccagttttcccaacatcatttattaaatagggaatcctttccccattgcttgtttttgtcagatttgtcaaagatcagatggttgtagatgtgtggcattatttctgaggcctctgttctgttccattggtctatatatctgttttggtaccagtaccatgctgttttggttactgtagccttatagtatagtttgaagtcaggtagcatgatgcctctagctttgttctttttgtttagaattgtcttggctataagggctcttttttggttccatatgtaatttaaagtagttttttccaattctgtgaagaaagtcaatggtagcttgatggggatagcattgaatctgtaaattattttgggcagtatggccattttcatgatactgattcttcccatccaagagcatggaatatttttccatttgtttgtgtcctctcttatttccttgagcagtggtttgtagttctccttgaagaggtccttcacatcccttgtaagttgtattcctaggtattttattatttttgtagtaattgtgaatgggaggtcactcatgatttggctctctgtctattattggtgtataggaatgcttgtgatttttgcacattgattttgtatcctgagactttgttctagttttttttaatcaagtattttggattttctacatagacgacttctttaaatttcttaggcttctttaaagactttatcttggtgttatggagtttactctaatggtgctagttatgggtttccttttagctatcctgcttttatatgcattgtgctcactgcatctatgtatctgaatatttcattcttgaaaaatcaaatattatcttttcaaatattttctctcatcatttgtctcttctcattttatgaaactctgacttgacttatttaagatcttcaacctaacatttctattagcctcactttcagttttctcatctctttatttctatgcactgcattaaaaatatatatgtgtatatatatatttatttagttctttgattttatttatcagagttttgtagttttccttatgtagatattgtacatatttggtcagatttttacttatttaatttttttaggtactacattttacatacattttctgttctgctatctgctctgtcctgtaacctatctttgaaatttaaattttaaagaaaaaacaacacaaatgatcaaaatctggaatgaaaagggtggcatcactatagatcctacagaaatcagataattaaggttatattatgaataatgttgtgccagtaaattcaataacttggataaaatggcaagtttcttgaaaaccaaaataccaaaacattgccaaaaaaccatatgatcatcttaatagatacagaaaaagcctttgataaaatccaacattgctttataataaaaaccctcaacaaactagacatcaaagaaacatacctcaaaataataagagccagctgtgacaaactcacagccaacatcatactgaatgggcaaaagctggaagcattcctcttgagaactgatacaagacaaggatgcccactctcaccacttctactgaacatactrctggaagtcctacctggaataatcaggtaagagaaagaaatgaaaggtattcaaataggaaaagaagtcaaactatctctctttgctaacaataacaattctacatctagaaaactctaaagacttcacgaaaagtttcctggaactgatgaacaacttcagtgaagtttcaggatacaaaatcmatataaaattcagtagcatttctatacatcagtagtgttcaaactgagagccaaatcragaacacaatcccctttacaatggccacaaaaaataaatacctagsaatacatctgccaaggagatgaaagatctctaccaacaagaaaaactataaaacactgctgaaagaaatcatagatgacacaaaaaactggaaaaatattttatgctcatgaattggaagagtcagtattgttaaaatggccatactgcccaaagcaacactatttcaatcaaactacaaatgtcacttttcacagaattagaaaaaactattctaaaatttacatggagctaaaaaagggcccaaatagccaaagcaatcctaagtagcaggaacaaagccagtgacatcacactacctgatttcaaactatattataagactacagtaacccaaacagcatggtcttggtacagaaacagaaacatagaccaatgaaacagaatagggaacccaggcataaggctgcaaacctacagccatctgatcttcaacaaagttgacagaattaagcaatggggaaaggaatccctgctcaataaacaatgctgggatagctggttagctagatgcagaaaaatgaaactggacccttacctctcaatatatgcaaacattaagatgaattaaaaatttgaatataagacctcaaactatgagaatccaagaaatacacctaggaaacaccattttggacatcagccttgagaaggatttatgactaagtcctcaaaagcaattgcaataaaaaacaattgacaagtgggacctaattaaactaaagagctctgtatggcaaaagaagttatcaacagagtaaacagacaacctacagaatgagaatgcaaaatatttgcaaactatgcatccaacaaaggtctaatatccagaatctctaggaacataaacaattcaacaagcaaaaaacaaacaaccccattaaaaaatgggcaaaggacatgaaaagcactttttaaaagatacacaagcaaccaacaaatgtgaaaaaaatgctcaacattgctaattattggagaaatacgaatcaaaaccgcaatgagataccatctcacaccagtcagaatggctatctaaagcaaaaaaaaaaaaaaaaaaaaaacaacagatgctagcaaggctgcagagagaagggaatgcttatactctgttggtggtaatgtaaattagttcagcccctgtggaaagcagtttggagatttctcaaagaatttaaaacaaaactagcattcgacccagcaatcccattactgggtatataattccaaagaaaataaattgttctacccaaatgacacatgcacttatatgttcattgcagcactatttacaacagcaaagacatggagtcaatctagatgcccatcaatggtggattggataaagaaaatgtggtacatatacaccatggaatactatatatccataaaaaggaatgacatcatctcctttggagcaacatgaatgcagctggaggccattaacttaagtgaattaatgcaggaacagaaaaccaaatatcaaatgttctcacttataagtgggagctaaataattgggcactcatggacataaagatggcaacaatagacactgggtactactggaggtggtagagggttgaaaaactgttgggcactatagtcactacctgggcaasaggatcattcatatcccacacttcagcatcacacaatatactcatgtaacaaatctgcacatgtaccctctgaatctaaaataaaagttgaaataaagaaaattaccaaaactaagagaagaaatttaaaatctaaataaacacagatctgttaaaggaatttaattcatattctaaaacttcccacaaagaaaactgtaggccacattgttttaccagtcaattctaccaaacgttaaggaagaaataatgctgatccttcacaaacccctttaggatatgaggcaaggggaaaaacacttctcaactcatttgatgtgatcagcataaccccattacttaaacctgacaaatatgtaatgagaaaataacaatgtccattgtgaatgtaaatgcaaatttccttgaaaatattattaaatctggcaaaatataaaggataatatgtcattaccacgtgatgtttaattcgtgaatgcaatgttgatttagcatttgaaaatcagtcaagttaatgtactacattagcagtaaaagagggagaaagcatacagcaccttaatatgtgcaaaaataacttaaaacttactagtcctttataataaagacttgcagtaaattaataatagaaaagaactttctcagtctgatgaaatggcattgctattgtttgaatgtgttttccaaagtttatgtgttataatccccagtgcaacagagttgagaggtgggacccttaagaggtgattaggtcatgacagctctgccctcgtgaatggattaatgccattatwgtgggagtgggttcttgataaaaggatgaattcatcccactttcccatgctctgttgcataggctttgccattacacccttctgccatgagatgatgcagcaagaaggcccttgcaagatacaacccgttgatcttggacttctcagccaccagaacaatgagccatgttaattttggtttattgtaaattacccagtctcaagtattctgttatagtggcacaaaatagcttgggacaggcatctataaaaaacctacagccagcatcatacttaatgaaatattaatccctcttccctgtaatctggaaatgggcaaggactttcacttttaccacttgtctttaatgttgttatgtaaatctgagccatattaataaggaaaggaaagaaaataaagggtacataaattggaaaggaaaaaataaaaaccaattttttcacagataacatgattatgtattttgaaaatctaacagtagactctaaactacaagagctaattaagtgaattcagccaggtcacaggatacaaggtcaacatacaaaaattaattgggttatatatgcttgcaatgaccaagttaaatttaaatttaaattaactaaaaatggatgttaaatatttaaggaataacaaaaaaatcaaatatctagaaataaatctgacaaaagatgtcaagacctttctactgaaaactacagaacattgctgaagtaaattagtcttttgaaaaatggagagacatggtatctttatggattgaaaaacttaatattattaagatatccattatctctaaatcaatatggagattaaataaaatccccatcaaaattctagcaggttaatttgaagaactagacagatgattcaaaacttgatatggaaaggcaaaggctttagagaacccagaacaattctaaaaagagaacaaaattgtaggacttattacactacttgattttaagatccactgtaaagctactgtaatcaagacaatatggtattgctgtcaacagacaaatagaccactggaacagattagagagcccctcatgtatattggtggttgatttgtggcaaagatgcaagttcaatttagagggggaaaggaaagtcttttaataaattttgctatatccactgtatattcatatwaaaaaagtgaatctacagctgggtgtggtggctcatgcctgtaatcccactttgggaggctgaggtgggcgaatcacttgaggtcaggagttcgagaccagccaacatggcgaaaccccatctctacaaaaaatacaaaaataacccaggtgtggtggtgtctgcctgtagtcccagctactcgggaggctgagacatgacaattgcttgaatccaggaggcggaggttgcagtgagttgagattgcgccactgcactccagcttgggcatcagagctagaccctgtctctaataaataaattaataaataagaatctagaccttcctctctctgtgtagattaaaattaatttgagaatatctttgcraattcaggcgagacaaatgtttcttggacagaatacaatataaaaagcataaacaatgaaatcaaaacaattaataagttgggctttgtcaaaataaacaatttctgtttatcaaaagatgccattaagaaaatgaatataaacaagacacagactaggagacaatatttacgtaacatatatctttttttttttttgaccttggagatttccatcacttttttgtaagcttaggaatgcattaattatcatgcttgtcaatctagcacttgggtgttttgtgtaaaagttatttcagaacactggtgttttattctgccagagtagaagtcagttctttgacttttcagattctctgcaaaatataacatttttctgagcagcattaggtagaaatatactatagtatcatgtgattaccttatttcacacaaacagaattatataaccaaattctctatagttaccccttcagaagtaaagcctatacttactagtttcccagggaggagtcgttattgcaaaggagtagattaaacctgtggggaaaaaatgttggcctggtgtatctttttaggcatcagccttcctgtaagtggagctgtgaccaggtgtatgtatgcacatgtgtatgcatgtacattttcatgactgcagatgtagacacgtgtatgcacagataatgtttgcagataagatgtattttcagataagaatggagtaatattttaacttgggttcattgtaatgtttggatataagatatctaaaaaaagatcagtgtttattggtagagcgtgattacttgcaaaagaatttgactattttatttatgctagtgacaactagtgtttttcataggaatccatttctagtaattactgtttgataatataagggtaatgtgaatttcctgcttcctgcacataataagaatgtgaatttaatgccttctttatagcctcatttctccactccatagagcaggatgaggaagagatactctgtagtggagttcaggggcttttctgacctcgggtcctatcctttcatctgagtacatcctcagagacaagaggcagaagagaatacagaaggggaaaaataggatgaaaaagaataacaaaagcaggggaggaaacacacaggaagaaagaagaggaaaatacactgaaaagctgtggtgaaatgttgctgatgtaatcctaagggcctcaggtggcacaggtcccctggcttctatttgcctctctagacctatctgtggtcagaagaaccttgttctgtcagtacttagatgtatgatcttgaacagattcttaaacatcctttggcttcatttaaaaagtgagctagtatcaggtattttgtagttttgtgaaaatcaaagcagatagtgcttacaaacttcagcagagcatctggtacatcataaacacaaaataagtggtcattagtatgatgatatcaataccacatcttccagctgcaaaaaatggttttgctccagacagtgcttttcaaactatccgtgtcgaagaattgcttctaaacattaccagtctactgtgtgtttatacttttgtaaaatgcatttgtttataaaaagaattacctgaaaactgaaatgaaaaatataaacagatataaaatacagccatcaatttttattcttacatttggtagacatcaaatatctgtaaaattattgtagaagttactagtgcttttaatttctgaatttatcttatggactggaaatagtttgcagataggcattggtccatggttcacactttgaccgatacttcatacactgctctgtgaagagcagatctactgttgcctataaatacataagggtggactttgctaaggcaagggacttaggagtatttagaagtctatgctggggtgggggttatggtccaagctggaagcttccaccctcgtgcatgtctctgatggctccaaactctggagagtctgctttgaaggaaatcttcacataaaaggtcctatgtaaaaatgtcttctcctgaaggtggtagagttatttagaatctatgaggygaacagctagagttcagaagttgtctaacagtctacacgtrttcagtaacatagactttatcaaaagatgcactctcctcctctctaaacctcaccagtattccttcccttccagtgttgatttgtattatccttgatgcaaatgtctgatttgagttaatatttcaaggtcacaaagtaataagagttgtcaactgacagtactttgtactttaagagagcagctccttaggaatttcagagtccactcttatctgttgaagatctaccatactaggcgccatgactggtgccttggttcacatgggcttgctgatgcagcagctcagtgaagttgcagtttttatcaatgccatttattaggaaattgaacttcagaaagcttcaataacttgcctgtggtctgattcaaagataggtgtaatgagtcccaatacagtttttatttttacaataccacaggtttaatcgtctttcatggcattttgtcactgtcattgtatatgtattgtacgaatcctcatggaaaagtgcatagcctaccacagccctaggcactggagtccatgacaggccagccatctagtaagaaaatgtctttgcttgtatgtcaccagcttttgtttcatttatctctaatagataaggatattttcaataaggtaacaattaattgcattttaatgaagaacttaggttaactgtaagacaggcttaaagaagttggtgatttattaaatatcctcaatttaagaaagacttctaagtaagggatgataacggtcaacttaaatgatactgagactacagagggacaaagtctcaattgcagcagaaaatatttaagctgaatatagtgaagaatttcctgccatgatgttgctttacagctttggaatagtcttgaaagttcatatagagtgtcaaagaataggtgtacagcttgttttcagaaggtcctggtagagaattcttagattgactacattaccagtagatatgatctgcagtggttgtgactcatagaggtaacctccagaagaaagaatatgtacttctgaacgttctgatgcctttatccattcatgcaacaaatattgcttgaattccttctaggcaccaggcattgttctgaggatatgatggtgaacatggcagaagagatccttttattgtgtagcttatattcttgagcaaagacaaaaaaccaaatagctgaacaaggtagcttttagggacagatgttattaatgaaataaacaggttaatgtggtagagtgcagcaggtaatggggccattaattttaattttgtgatcaggaaagttctcccatcccacgccagtggtcgggaagagagacagagcagatctatggagggtctcataggccacaataaagggtttgtattttaacaatgagaagccagcagaaagtcttaaacagaaggatagcatgatgtattttgaattcacaagtcaccctgttttcctgctatgaaggaaatagggggattgggacaaagatggaaatgtgaagtcagtaagggaggctactgcgctcttgcagccaactgaaggcaagaagcatccaggcaggagacagcagtagcctggactagggtgacagcagtgggtttggagaaaaggggtaagactgccaggaattgcttatggattgggctgaggttgggatgagaaaggaagaagggaaaatgacccctaacttgggtggttttgtttactgaggtgggagagactagaggaggagaagtttggggagaaatcacttggccatgttacatccgagatgcctatttgacatccaagtagctgatgtcaagttgacagttacataactgggtttcaagctcagtggtgaatttgggctggagacaaaaattcggtagctttcagcatagagatgatgttggaagtctccatgggcctgtgcaacgtcacctggagggagaatgttttagaagagaggacctatgcctgggccctggggcactccaatgtctagaggaggagtgaaggagattgagaagaatcaaacaaaagagtgggtgtcatggaagcccaagagaagaggcctctcctggaaggataagctgaagtctaaagatccactgagccccaaacccctgttgagtccacagaccctggacccacacagcttcaggactgacctggaattgagctaacctcagttgttttaggtcaaggcacagggtgtgtgccccctccactccattctctcctgttgttcccaaatctgaactgcttcttgtctggtggctgcccgtagtgtgtggtgcacttattcatgatgtaaacagttgccagacagcctgtctgtgctgggacttcaggcataaccatgaacaagagcaatctacacagtttctgcccttgcagagcttacagcatcatagggtcaccaacgagaaatgagacaattccaagaaatggaaatagttgaggtacagctgcttctagtacagactgtgtgatatgggtaagtcaagttgctgttctaagcctggattttcctgcctgaaaaatagaactaagtctgagagactttctaagataccctgaagatgtgaattaatgactgtgtgaatcaaaactcctatacatcccatcccattttaattgcatccctggaaaggacagcgagtggaaaggccaggctagtccttctgtgtattgagtcacgtttggtgcgttagcccacgcygagcctctaaacttccttccgctcacttcgagtctctcctcaggagctccccctgstccattttccctcatattttggctcttctttcccatctccaccatcccatttctgtgagctttgggccttctccttggttccacttgaccgtcccaaagcatataaaaggacttgttttcataaggaagaaccttttggtgatgaaccatgacattttgccttcctgagaggaatctttgatgtttaaattatctggggatgtttaacaaaggaatgtgggaaatgcaaaactttttacaarggggaaagatgcccacacagggtgaagtgtacaaagcttcaacctggtaataaactctcaatttcttccttgaacacagctgcacctctcctcagacacctccaaagcttttggggagggagctggttgctgtgccttctcagaggagtgcgaaatgtgtctctgagaagaacacagccatttgttctgttaggatgcttctttcagactgtaattagagtgctgtgkggggtgtagatggaggagaaagaagaatatgaaatgctcttacttccctgtggctcattcttcctgcaccacggggctttgaacccactgaaatattgtgactgaaacatacastgttatatgcagagacagagagaaagcagcatgtacacctctgagttcatgccttgatagtatctgtgtgctacaatgaggtggcgcagactggcggagaattaaacagagtaggtctgaattctgctgtgtaactctttgtctttcaacactcttgaaagcctttatttttccaaactgcgaaacagagatgaaagtgtggtcccctagcccttttcttaaaaggttttaaggaccaccatgtgagaactcataacttttcaatattcatagtacatgctattctgtgatcatcccacttatgggagggattcatgaagcagttataatgaaatagtgtagcatccaagaatatttgtgggttttttggttttgttttaaactttatttgcagcaatatcaacaacaatttattgatgatgttttactgaattatcagttaacatctttctagcatgtgccagcagaggggaaggagggtggcagagaaagagcatctaggatggttctgtttcattcacagcaganaatccttgaagcagctggcacatattgtgtggatgacagagaatttggtgctattgagcttaatgatctttaatataaacatgtcaggatatccagctgacttatatacacagctgaattcctgatcctccctcttcccaaacctgctccattatcttttccatcctggtttgtttaactccattcttctggttgctgtagcttaaaactttggggtcatcttggatgcatgtctctcttacactcctcgtccaccagccagcaagtcctcctagctgtgtcttcacagtctatccagagccccactgtttctcatgagctatactttaccactctcgccaaggccaccatcatctggatacaacctggaagatctccctgcttccacmcttaatccccttcagtctcttttcaacaggacaaccagagacattctttgcaaacttaagttgtgggactcctctgctgcaactgaccaatcgtttcccaatsacaccaagtaaaactcaaatctttatagggtatctatggccctacatgatggccctccacttccccactgcctgctaccactctgaccttttttccatgtattcagtccactctagtcacattggctcttttctgttcttcaaaagctcctgcaagatgcttctgccccacagctttgccctggtcatcacctctgcctggaatcctcctccccggatgtctgcatggctcacttcctcacatctctcatgtcattcctcaagccacctcagtgaggccctccctggccactcaaccaaatattccagctccccgacacccaatacttactatacttctctgctttatttttccctgaggaattatcagtttataacattctgtttattatgcttatttatcttgtttattgtttttctcctgcagtataatgtaagctctgttgaggacaaagatttgcttctttttttgagaagggggtcttattctctggcccaggctggtcttgaactcttgacctcaagccatcctccttcctctgcctctcaagtatctgagattacaggtgcataccagcatgcccaattatacttgctgctatatcctcatattctaaaacagtacctaccatgtagtaggcactcaataaattgtattttggaggtggaatgaatatataaaataaaggccttgataataggttatctgtattatgatacattctcagaaaagtcagtaatataacagctacttggarcacctactataccttgcacattctatcatttaatcctcacaacaaccttttgagataggtatgatcattattcctaattttatgaatgaggaaactaagatttagtttaagaacttgccccagatcacaccacgatggagctaggattcaaacccaggtctgtacaacttcagagcttttaatcattatactttaacattctggattccaccaacttcaaggttaaaaaccgaaacaggaaacatattccagttccttcattatctcccttacattaaktgtcatgcttttcttcccctgtgtctactcaaacaaataaatgagatctcaatattgagaagagaaagaaaaaagaccagtcattccctgagctcctaaaagaataatcttctttgagttctcataactgaaatgtcatgaagctgtggaatagcactggctttggaacgtgatgctctaggtctgccgccaccgccctaatccttggaaatggcaagtcatctgacctctctctatgccttagtttccctgcttatggaaagccggtcttggacaggtgatctgtcaggttcccctcgcctgatatcctggtctgtgagactcctggtctgtcttccattgccgtggacataaggtggtggagtaggagtgggatatagcacttcatgtaatgccatttatttgccttaaccactttagggaaggatttctgctcataggaggagccttctgaaagctccagattctaaggaagaatgaccccatatgatgtcgtcgagcatttgcatcacccatcctgcttattagagtcaataatggataggatttagagggctagcttctgttttggcctttattgacaacctaagtctccttaaatcctttctggaacaagtcaagggataaagcataaayaactttaatactgctgaactctatgaccttcagkaaggtgtttaccttctctggggctgtgtttgcttctctgaaaaatgggagaaatggttccccaggctcgtaagaacactgaaaatatagaaacattgaagaggctcaccctaaccccaacccattttccaatggcactgaaatgaaaccactgccaacacagaattgccaatcttgcttccaatttctctgttagtttcagaacatttagggttgaagaggtttttcttgatgtctaacycaaattcctccttcctaaagcaaagactttacaggaaccttggcaaggtttccctatgggtagcaaagctctctgaaacatggactctgaagattaataggaatatgaccatgtggccatttgtgtgcttggcagagtgtgtgtacgtatgctgcttgtgccaggatgagtgtgtgtttccatgccaatgtgtgtgatgaagcatgcaagtgtgtacagtagtgtggataaacagatctttgagtcacacaggccagcccatcctggcactttgtcttccttttggttgtcatgacagcagcgaggggctgtgcatcagtaaacaaagctccctgcatggagccgggaggagaggtctggagcgagaggctaaaacatgagtcaagcagtcctccaaccgaggctttcttaccccagccgacctaccagaacatcttcatcgctagacaagcatcgagataccagtccaggtgccctgtgactgactctggggtcacataacatgggcagacatttcaggctggagctaggctttcatcaacctcacttctaatccccaagagttagcaacagcataatcaagtctagaaatgtgaatgaccgaagaccctcctagtatcagcctatgggctaaaaccagttacttcattaaggcagaaattagccactttgtgatttgtctgtagcagtggctccttataggttcatacattcataaaatgctaattttaataataacctaaaatgatttcaaagaagtctctgtcttctctcccctcatccctccaggcacacatgataaatgttttgggcattctaccttgtatgagattatgtaattcttccacttcatcttaatgattaattatatagaattagctgtgtatgaatagttgagttttacaatttatatttctcatgtaaactgctgcagaaaaaaagcagtcacaaatacaaatgtagtaaccaggataaaagaaaactgtgctcaaccatgcagggcaaagagatccaccttgttcttagtttccatgactgaaatttagaaacccaaaccttgcatacatatgtagcatctagagtagaggctcatccatgcttaactccaattcaccttacttccctgtatgcaagagcngtatgtgaggggacctacaggttatcctccctcagaggagccaggtttggggctggaggagcaayctaaaattaaggatgacagaattgggtaaggagaagtatcgggaatgaaacacgacttggatttgtgtcactgtacaatctcttatgggaatctantcaggactctcagagtcaaccagatctatccctgcctctggttatgagcctagggtttatgtgggtcctaatgtcaactcttactgatgaagaaattgagacagcaaggtgactgtccagtttgtaagcagcagaggatacctagatccccagctctgaaaatagaatggtggtgtttctgctgcatcacatggggatttgtttttgttccccttgtttggaattctgaaatctagatgcatcccttcttgatttctgttgcatctctcggtgtagaaaccctggatagaacaaatgaaaaggagccaattacctatcctcttaccttaggccacaggctgttgccaaggggccttagggaatatgaacactcttcttctataggccagattcccccttttacattttctatgccttgctccaagggaactggataaattaagatattcatagtgccctgctatgagctgcctttcagtgggggaattcagcagtcatctggtaaactaaataaccgtaatatgcatcatcatccgaatcaccccaggatcctctgtgaagaggacagggtactcagatcctcagaggagagagggaccagttaaaggagtatgctttgtttcgcaggtctggccacatatatacccatgagcctgatgggcatgttaaatctaaggtttatgaagctgaatcttatttgctcctgttctctccagaatgcaatatgtgtatgaataaatggacacaaaatcaagcagtatatcactagcttgactaacgctatgaattttattctaggtctttaataacccaacacagagcaatggatttttatgctactgtctcaatgaaaaggatagtcccttaaagaaaaacaaaacccatctgttttaatatccttattttcctcaaccttgggctgaaatgaaatccctcttgtagattttaaatgttgacttctagatagcagggaagacagctaaggcattgtggaaacagcacataacctggaagaagacattagtttgaattttgtctctgcctcttgctaattggattatcttgggcaagtaatctttttgaatctcgcagggcttttgaaactataaatgaaataatttacatgaaaatgatttgtaaatttaacaagtttaaatgtgttacatgaacattagctgttcttgatattttatttctataatctatggaatctatcataccagacactgggttaagcttcgctgacccttgttggaatgtgatacttgacctcatgaaggctttacttgacctcatgaagcctgcagactagtcagggagacaggccatgggtactaacaattacagcagcgagggcagaggggctgtaagagttaggaaagacacaggtgctggacttgctacccaggttcccaatgaaagaacaaaacagaaaaggctgcttgataaagcatcataaagaaggtcccccacatcctccattaaggtgctggagctgcttaggaggtactcccagtggtgcacattcgttgctttacttcttttagccaagaggcttggccaaattggttgggctctgggactgtgagttccagctaggatgccaggtgggagggtgggaggaaagggagcctacaatggcgaagaagagcagggaacccagcgagtgagacctggatccaggaaacttccaaacacaaggaggcatgtggaaacagcgcttaacctggaaccggaagaggttagataaagggaggttagacgggggtttgttggcctatcctaccagaaatcaagctacatcgtcattctgggggccttataragatgacataccccattcttcatagtctaatttacactgattatagtggagtcaaatgaagagaaactggtggcagtgtgcaggagttgctcctagttcacctgctccctttgagtcagtgcagagatggagtactcctccttttaagcctctgggagtcagggaagaactatgacttctcctagttagcctggatatttgtcattaaaaaaaatctactgaacatatactatgtggtaggcctattctagtctaggaagatagaaagttgagtaaggcacagaatgtttttgcaaaaagctcacatagaaggagagacatacagctgaccatagtaaaggtctgactgcaagatgagctctaaagggatggggaagaggtagactggaggccagaaggttggggtgcagtgatggtgggacccaaagagaagaggcaacatttcagcctggccttgaagaaggattttgactcaggcagataagcattgtgcactagccttgaacgcccatcctgccttttcagtaagtgtgggaaatgtgctgtagttgaagtgtggctgtggtgggctgtaggcaggcagggggtggatagggatggcaggaggagataaggcttgaagagaaaggtttggctacaactgtgtaagactttgaacgtcacgcttgaaggcttcatcctcttcattgagcagagggtgatggaagccatagaagaggggctaatagagtagaaagagatgaaatttagaagatctgagagttgtggttcctctgaggggctatgtgtccttggacacttgccctctcaaagggccacttaagtcactttagattcagttttctgagctggaaaatggatatgttggtcataatgcttatcctagatgctcaaggatgatcatgttcctccggtcgtagcctgcttcaattctcctctttcaaggtcttgctcaaaatatcaccttcttattaaacctccctggattcccccagggttgagaaatcaagacacagacctatgaaaaggtaaagtaacatataaaaatgccatttggctaggcaaatatgtggtgcatgaaggacttgggctcttacaagagaaaggcctgggttctaatcttggctctgtttcttacttaaactccatcaagttgcataacttttaagttaaggatgaaaatacctattctaccttcttctcagaatggttgtaaagattaaatgagcaaaatatatgaaggtgcttggtaaattaagatgtgctctacacatgttacttgccatggttagtactggaggtttggaagtggtaagatccagtgaatgaccttttaaaaagataacgttgatagtgtgagatgggtgaaaggaggagaaagagacaggaggttgagagaccagccgggtgctattgcagtggtccaggcagggaaggatgagatcatggatcaagatagtgaggatggagaggcagggtgaattcaagtgcttttatgaaggtagaaccaacaggacaatggtactaactggacaggagggattgaaagaagcaaaaatccaaaggtaagaattttggtggatggtgatgtcatgaaccaagccagccccttgttactttcaaatttctgaaattcagaaagtagaaaggaggcatcccagggctygaattcagttatcctggccctcactggccctggtcrctcttcattttgactctttccttcccttcccccatagcacctttagtagaacccaatgaacctgaagccaagcacaggagaatttgtccttccrgtgtgcctttccctacaccttctgcctgattgtaagcaggtggctgtacccaaggacaccagctctattttggcaggagggccaggtgtgacacgaacaggtgtctgttggcattatggtagactggcgtcttccctttccctgcactgtagctggggcccatcccccagcccctcattcatttcttctttcctagacatgacagagaaactggcaggacttacagtgggtgctggactccctcagattcagtctgcagctctatttttttttaaacgtcttgctctgttgcccaggctggagtgcagtggcatgatcacagctcactgtaacctcgaattcctgggctcaaacagtccttccacctcagcttcccaaagtgctgggattacaggcatgagccactgtgcctggcctgcagctctttatggggatcacatttaataagtagaacagcttcccaggtagtaggagaacacctgagccatggctgggaggcactgcactggtaagggcatcctagcctggaagggtgtttggtgatgagagaggcattgctagaggtggcttctggaggaacctgttagcaaactgtgatttatttatccccattctttcacccaataaatttgatcctcctcttctctatcagggagcccttagtcctcttctcttctctttctcccatggagctgtagccttctcattcctgttgtcacacggagtggcattggccccctgagcccatcttgggctctatcttcttcctgaccctgaccttcacctgagtgttccctctgcctcatgatctcccctccaccccacccccaccaccttcccactggctttatgggagtcaggtgtccttctcacgtcccttcctttcttatttaactgacatcagtcaccttcgaatagcattttagcctttgaagtcatcaggctcattgatcttcagtggcagcttttattgagcactagagtacaggacagcagaggcaacacagcattgtggttagggttcaaatcccagcaaggcatttcacctcaagaaaccttggcttccccatctgttaaatgggaattttaatagtattaatacttcataggatggtcgtgaggatgaaatgagttaatgggtgtaaaaaccttgatacagggccaacacatcataattggtcaatatacgttaatcactattgttatcaaaaggagaaagagtagctgtgcccttcagagggttaagggtttttgttgtagctgaagaggtggaacatggcattttgaaacctagtttctcacatggctaagaacatacctttcaaaacagagcaagcaatcagttggtcctgactggaatgcagctagtctgggaaggcttcctttgtgaggctgaatgaggtgtgtttctgtgtaacattgtaaggaggtcatatttgcagcctgggtcaggggaaagggtacatgggcttaatagaggtacttgctcagatgctctctctctgttgcttgattcactctttcccytagtcatggccctgtccaaacccagtgaatcttatccttcttrtccacagggaatttgccaaagagagagagagagtggagaaccgaagggctttcatgaagctgcggcgccagcagcagattgagcgtgagctgaatggctaccgtgcctggatagacaaagcaggtaggcctggggggctgcaggaggctggtgagtgggctgcagagacatcagggccggcccctcactcccaatgctcccattcaaggggcagcctagacaagacaagagagacactctggatgcttggttggctcttaaggttccctgctcatccgactttcttcctctggggtctaactgtcctgtctatcaaactgtcccaacaccttaaggcaggcatcttagcaaggtgaactgagtaaaagtaacataacccaatcctggagctgagactgggctgatggcgttttgtaataccgttcctggtgctcacagcagtccattcattcagcaaatatttattgagtgcctactttgtgccagaccctgttctaagcacttgggatatggcagtgagccaaacagtcaaccagctcaccaaagctcttctcttgtaaagctctctagttggctaaggcarcgataaacaaaataataaatgagtaacttataagacaatgataaggtggtaaatatgatgggaaaactgatcaagttaggggtatgggatatagaatgtgccacagttttaaataggaggtcagggtgggcccattggtgtgtagacttgaagaaatgaaggagtgagccagaagaagttctgggagaggagtatttcagcgccaagtacctaacatgggagtgagctggggtgcccaaggagcagaagggggaaggaatagggaggaggaacaggagacagagtgacagctgtcatgggggaagtgggcagcaatcgtgtttgaccttatggggccttgtaagggctatgggcttcactctgagtgacacaagaaccatgggagggttttgagcagaggactgacgtgctggccgcattgagaataraccatagaaggataaggctggaagcagagggactagtagtgccgccatctagggaggagataatggtgagaacaggtgttttcctaagccttgagctgtcatcagttcttaccctgtgactcaacattaggaatagttctcagctgcctgtgagaataggtccaaacctatcatgatttcattaacccacagagccaccagattcaagtttggctgtggctcagatgcttatgaagggcatcaatcacccccatatttgtcaataaaagggacgggtttgctttctttattattttaaaggttggtttgcattagtattatatatcttcattttcttccagaggaacaagtgatttcttaaataaaaactacacgtatgacagtatcttttctctattcctaatagaaaacatagcacaaaagygaggtcacagaggaaaaatttggagtwtgatttagtgcttagttgcttgagccttattcttctgtaggagctttggaatgacactataacacttactgtgactgccaacacacaaaaaccctctctaagctctgcagtcaacttttggtgacctccaagggttgagagggtacctgtatgattgcgatctgcactcccttgtagcctctggaaacatgagcaatgtgtgttgactatacttgcatttcgccctttctcctccaaggctgttgtgtagggatgaagtggacacaaatatcccctaccgcttcccagaatggtaactcaggcttaccatgggaggtcaagcagatttgcctctaggccaggaaggcagcttgatggtcccagctgtccttggctttctcggcggaggagccatctgacagaccactaagagagctggcagcagacccaggaaggagcccgcccagccttggccaccccacacaggtcaggtggcagggtatgctgctcgctggggctctgcttttcaaatacttgcagaattccaagscttccctttcttccagttggcaaagccagctctctcctccttctaagaaaaaagacgcactgcgacgtcaaagtgtgcttcctggcccttccctttacaaatggagcgccagtgaatcagagacagatgggttacatttccctggaaagacactcaagttctaaagcgaacttggcaaaaggcatggggtgaggaggaagggggatggcttcagcaaatccagagcccttgagtgcttcccagagatctcggcagcaccacacaccttccatctgtcctggggggtccccagatctgctcaccccaaagcccagacactgtgcacagcaaaagtgacttgactgtctggctragataattaaagttgctatgaggtattttaacaagttcctaatttttaaatgatgccctccaaacacgtgctataaaatgacttaaaaaccctttatgtctgcaggaaggagtgccccaccaataacacttaacctgttaatttagcgttttgccagaggctatacttaaaaaagaaagcaaacatttatgactttgtaataatggccatccggtgagtaccatcccagccttaaaatgttcccctccctaggaaatacattatgtactctcagttttatctgtagctggaattacggtaatgactttaacctctcctactgtccttttacttgttaaaagtgtttaaattaaaccattgtttagtagggtctgaagctagctttcccccagcagctgggatcttagggaatgtttaacgaggcctctggctccctggcctatggrttgagctcaaactcatcccgttactcctcatagggcatgcaggatcccaccagacttgggagagaagggctattttgttgatgcacttggagggatgctagtgaggtttggtctaaaagtcttagtagaaaatattccccttcagatgatgacacctcagtagagtatgggactgctcctggggacaccaagtgggaagagtacaggggactgtctggtgtcattttagaactccaacaagcaaatatattatttcatcatcaaccagtccttcagttctctaacaccaactaggtgttcaacaatcagttaaattctaacacgaaatactacctcaaattagcatagaccccacaggttaaaggctcggttccacaggactgcccccactttagatggcagccaaaagtgggatctccaggcaaccaacatatctgcctggctgactacaaatctggggttcccacaaccatcaccccactccccactggttcagtaatttgttagaatgactcacagaactttggcaaaaccatackgtattataaaggatacaactcaggaacagcccaatggaagaggtatatagggcagggtatggtggtggggagcacagagcttcatgtcctctctgggaacaccaccctcccagctcactgatgtgtttaccaacccagatgcctcctgaaccccaacatgctgaaccccaacatttagcatgcccatcattacataggcatgctygattaaaccatcggccattggcaattaaactaatctctagtgcccctcctccctagaagtgggagtagggggaggctgaaagttctagcctccagtcctgtggctgtttgttctggctacaagctacctcctctaacctatccagggcccctctctcctccatgagtcatttcattagcatatgaaagactgccaggaaccagagacaaaaaccaaatactttttaaattttatcttagggacaaattcatgattggcccaagcctctttggctcaggctctggtcaaccaacaaaggatggaagccatggggacaggaggaaacccacaagcccccctcctgtctccaaggacctttgggcatcttcctctgactcctcctcagagacatagaataaagcccaaaacatgggctcagctcctgaatgagggtgtagatgttataacccatggccactggcaagagaagctaaggaagctgttgctgctagaagttcaaggagttaggaaagacaggaagctgggtggaattaaaaacagaaatggaaatttttcattcctatcaaggattttagcttcttcctctcttctcacaggtatcctcctgaacaggagtatcagacacagagccgattgttaccccaaacaccccctccccgaggcttcctttctgttctcaggagctctctgtgcaccctctgtgacacttgctttctttctgatgctggtgcctgtgacaggctctgaactctgctctctctctgttgccctgagctgaagttgtccctgagggattttmatcttgcagaataatttggcatttacagataatttaccaaaccatttgtttccatatagaggaagtcatgctcgctgaagaaaataaaaatgctggaacatcmgccttagaaggtaaggaaatgttctgatgccttattccagttgcatttgcccctcttaggcgatggcaatctctgttattcaaaaggrgagaaagaaatgaaagatggtgttctgggattggaaatgagagtctttctgtcataaaatccctcatgctttaaaatgaagggaattgagtcacagatttaaatgccttttaaagtgatgaaaatgaaacccaagagttgctttgttccagggcatgtgattgatactgagcaaggaaaaggcsatcctacaaccaatgctatctaaagggaccttctcttaaaatgtgtggggatcaccttgagaccactttcattaccagkaagtggcattgtagatgawgagccaggacagatggatacggagtgcctgtttacctcctgcatttagataggctctagcatggcttccagagctcttgtgttgcaggaaggtgctggtgagcacagcatttgcggtccggtagacatccgtgatttctgttaccctggctcaggtattaaaggcagatagatgcctgtgttacaggggcctcacacaaggcatcttgcctgcattcctcaaaattttgtccagaatggtctgggtgtacttgtggcctctcactggtcttccctttccctgatgcagtgcttcgaagggcaaccatcaagaggagccggacagaggccatgactcgagactccagtgatgagcactgtgttgatatctcctctgtgggtgagtggatccagttagatcttttactgctctgaatctcccacgaaaaggaagatcctgtcttttgagaagcaccacaaggagggaaagaatccaaagggtccagaatttaggaatgtaattaaggaaaagggtggaaatcgaatctagattacaatgatttatttaaaaaaaaaaaaaaaaggacctggggatgctatttattcacaygaaacatgggatttagggctaagaatccaacccaagtttttcaggtgtggcagatgtattccatttgcagaagtatccaccctctcctgggagtgatgatgagaacccactatgggacattgttcaaaggatcctgaggacctgttgcttccagggacacggatgtgagatcttgaagccatttgcttaacaacagtagcccccacctacttccatcatgtgaaatttaaactaattctgattggcaattatttaacattatgtgttccatctcaggtgctcctagagattctggctgatggcaggtttttcctccccagaaaaagggaaaggtcttgttccatcctcaaaagcagaagagacttacaaagctcattgctgttttgtgccaccagtggtagaaatatcaccagtgtagcagaagaattccagtgcttgaagctattttaaaaggaaagggcagaaagaagcccaatctgttaaaaacataaacacgatcctattaagattcaagacactggtgtcctgtctggggaatctttccatttcttaggactgagagtgcccagagaggaaaaacagggtcactgcctatagaaactactgagcccgtaagatggggattccccacacctgcaatgtggcagtcaccttgccctgggactagagcagcccatcttgcccttcgaatgctccctggcccrgaccacaggatattttgcagtctcattcttccttacytctccctcttaggcacacctctggcccgagccagtatcaaaagtkcaaaggtagacggggtctcttatttccggcacaaggaaaggcttctgcgcatctccattcgccacatggttaaatcccaggtgttttactggattgtgctgagccttgtggcactcaacactgcctgtgtggccattgtccatcacaaccagccccagtggctcacccacctcctctgtaagtaaagcctctctctaaagcctcctctgctggtccccatgtggggcagcttgatgtgtgtgtgaacgcaagacagcaaagcaccctgctaggaaaggttctacctcttcacgctgtgagggaggccacatcgtcctcaagggggctggagtatctcatgactgtttccagctttcattctttaggtaaacagatcattgttgatgaatcaacaagatagcataacgttatacctttgggtaccataaagcyttcacttcctttcttaaggaggctcaatgatcaggagttttgatcattgaaatccygggcaggaagttctcagggcaatggagacctcaaatagaccagaagaagagcttataggtcagctccagattagactgccactgggtgtgagtgagggtcaggggcctgtccctgccaggcatgtagggaggaatccagctctttgatcaaagccatagtaagtcctctctttccccctgagggccctctaccatataaagaccagtgacaggcctacctattgaaagagagcaatgctgatctcttgagtgcacctgggactcggcctgggtcagagggtactcggacatcattaggctctgtccagccctggcctgatgtggccaccgaatgtcctgacgtgtgttgttgtgagatcctctgtaggtgggtgtgttagctgagaagtgcatgagcccaccccacatgtggaaccaatgctctacttttaatacttccagactatgcagaatttctgtttctgggactcttcctcttggagatgtccctgaagatgtatggcatggggcctcgcctttattttcactcttcattcaactgctttgattttggggtaagtcctcggaagcctgcctctgctcctgcttcgtgttgatatgccctggttttagataagcagcttgctccttactcagcatgaggcactgaaatcagaatatgtaaaagcggaatagataagattagctaaagggaattcagaagcgagtgaatccttcccatgcagggtttgtttgtttttctgagctctttgattttcaatatttttattaaaatgtaacacatacattatagagggtacacttaagtgtatagctccgtgagagtttacaaagctacccatagccagagttttgaaccacttattatcttgggggaagcctgaaaaggacaaaggacttgattttagaggtggttccataggaaagagaagcttatatatttgtttttctacttcagtttaaaattgggataattatctagatagaccctcattcaaamacacacacacacacacacacacacacacacacacacacacacacacacacacacccttatattagcaagtcctcacagagaatatctcagtcagctgtttactttctacatagcatggatatctaaatgtatacattgtgctaacacttcaaggtgctttcacgtatcttttatttttgtcccctgccgcttacaggagtcctatgaactacattacatttcaggagttagccttcccatttacacaagaataaatagaagctaccgtgcccaagttcatatacccagttagcagcagaactgggtcgcagaactttgggctcctgaaccacttctctttctgtcaatcccactactttttctgccaaagcttcagttaggtgctaaagattttgaacacttgctaatctacattttaacttggaacatatggttctgagtacgggcaattttcaggcataacagctagtgagagatcactttaacctcagtttctttgtgtccgtacctttcggcattgctgtcaggattaatagttgttgtttctcctagcacaatatctagaacatagtggacattcaataaatatataattaaaataaaagaaatagaaatgttcatctgaaattgctgcatcttgcagcaatcagatcctacatcaccatgaactgtcacattgcgggatgcaagacctccatgactgaaagatatttattatatcaaggaccaaaacrttcttgttagcactaaattttaggatgatgagagaatgtagaccttctctgagatttctgtattgagaagcaacttgtactaatcagtttccttggtttgagtaccactcctttgtcagagcagcagaagcagcaactggctgttgtagttttcaccaaggacaggagtcagtaagccaatctacagtgtgaaggattaaagttaggaaggggattggagagcaatgggagagaggtggcagcttcccacataggtagttctactgaaggtagggctggtgggagaggagagtttttatttccccatcccccactgagagctgttgatggtgtgctgggcgctagaatgccccctcttctcctcttcctcctcctctcactgtgrctggcattgcctctctaggtcacagtgggcagtatctttgaagtggtctgggcaatcttcagacctggtacgtcttttggaatcagtgtcttgcgagccctccggcttctaagaatatttaaaataaccaagtaagtgatcagaatttggacttttcccaatgtctttgagagtagaaccttttttctgccttatattttcttccatcttctctttcccccttagggggaaagtatcccttccctgccccaccccttttctattctttagctcttcctttttctccaaagattaaaccaaaaatatctatggtgccacattcccaaggggagcaataggtttctgccctctttacttcctacaaatatacaaatgcagcttatttcatagactaccaggcatatgctgagctgggcttggtgggtgacttggtatgcagtgttcacagctgtcacattgtctgggttttgtaggtattgggcttccctacggaatttggtggtctccttgatgagctcaatgaagtctatcatcagtttgcttttcctcctcttcctcttcatcgttgtctttgctctcctaggaatgcagttatttggaggcaggtaagtgcccagaagctttccatccaaaggaggctcaaaacccagtcgtagcctgtgttgggctagggtcattaactcaatcaccatgttactatcctgtctgcctttgcccatggcctgaattaaccactgagtgagttcatatgtggagtaaacgtctctgcttttattcctttcatgctgtacagggttctcattccggggacccatctctttggtgctgtccctgaaatgtgcagcgtgggcacattcttcaaagtgcatagtttatcagtagtagtcactgttacagtctttgtaagttatgtggaatggggaaaaagtagggaagaggggggttgtagaagaaaggagaaaagaagtgatgaaagctgtgatcttggggaatggaaaacttggtatgtgagattttcatttcattattttctctaattttgtttttcaggtttaactttaatgatgggactccttcggcaaattttgataccttccctgcagccatcatgactgtgttccaggtatgaggccagctgacggttcacaagtgctgcatggggtcccttggactgcacactgcaagacaaggatgagtttcaggataattctgcttttcctttccaggctcctcccaggggattgaggcactctttctagttgagcggtcattactacaataatccctagaacttctgtggctttgttcttaccaatagtaagagagctctgttgggaccatctcactgtccttctctcacacctgtgagtttgcaggagacactgagtctgaggcattcagccaagaatcacatctatggttttctgaaatctaggggcatcttctaacccatttaatgaggtatccattaaatggtgtttatttaacaaggtctcttttccatccctactccccccaaaactcaaccgtttaaatcatggggaaaactcaaaatcaatagtgtcttaggcctaaagaaaaatactgtttggccagaatctgaggttggaccacaacccgtttcctgaactgcagcccacaaggctctttccaatcatgctgctgttccagaccctgtatctgggcagctctgaggacagttaggtaatgaccagaccacctgatctgtgtcatttccacaaggaccttgcaaaactggaggtgggagacactctgtagttggaggaacagaatctttccctttgatgctctccttccattttcaatgcctaaaattcttttccatacgaaaaaaaagtttaggattatttatggaaatgactttttttttttttaactccctggcaagattgtcaagcaagggggtagatgcaaaagacccaggcccagaatttgcccttggcattggccccattttctcctccagcccaggtttctgatgygcctgtcatttgctttttgtagatcctgacgggtgaggactggaatgaggtgatgtacaatgggatccgctcccagggtggggtcagctcaggcatgtggtctgccatctacttcattgtgctcaccttgtttggcaactgtatcctttttaagatgcacctcctcaagctgcctgccttcctggaccagcatttgaggaggcattggtggtggtggtgctagagcttgggttggtgggacaggggcgtggacattgtttggtgtactaaagtaaataaggatcctgatctgaaggactttatgtactagttgggtaaagaatacaaacgtaaacaagatagagtattatccaaatctgtagtgtatgcaaagaataacataggaggctgttacattgaatggttggaggtactatgagctggggaacattagacaaagcagagatcactgtaggctgaaagaggcacattataccactaatgaattaattacatgctaatgtngaacagagcctgccacatagtaagatcccaaaaaattagtgttaggattaatgctattactgctaattatagcaaatatgtattgtatttgggctatacgtgagaccttaaactaagtgcttcataggcactatttcatctaatccttacaagacagagaaaaaaatatctcgagtaaaataactactaaattgtaaagggaaactaaagtccagttccatctaactccagtgccctatccaatcacaagatctagaacaggaaatttaggttttaatcccagcaactctgtgtatcagctgtgtggccttgggaaagttacttaatgactccaagcttctattttttacaactgaaaggagaataataatatttatctcctttgttcgtggtgaatactaaatgagataatttatttgcatgtgatttataattacaaacttctatacaactgttagatgcttttggggagttgggttggccgtgaattgggattagtagaacagaaaggcagaaccatgggacgcaggtgtatttttgcattttccatagtttcatagagaagacatgctgttttacgttttctrccctgaaaacatctagaggttgggacagactagaagctcaatatgagaaactcatgaaaagaacactaggcagtaagtcacagacatggaagctccatgtgtcccaatggcaccatcattttcctgatattctgggggtagtcagagctgggctttgatgctagaacagttctatgttccacaacacataggctttgaagagagttggaaattgagacttcaggcactagagtatggcataggaatagatttcatagtgaatcatgtctgctgtgtcacattttgttaaatgaaatgtggaacccttcaggaccctcacaagaagaatgggagaagttagcatctcattattgggagatgctcagtaacaggggctctggaatctcattctttttgtcgttaaggacagaatggtgtgacgcccattggtctaggtaggattcaattccagcctcccagaatggggagatgagctcccatactgagctccctacacatctcgttcagtgattctcttagttgttattgctatgggtagaggccacagctgtctaaagaccttttgaatgtggctgaacaaactcaaagtgctttttctgttcccttactcatcaacaattaatgcagaagacttctgtaaccaaatgcgtgggtttttttactcaccaacaagcaagcaatccggcagtggatactaattggtgtcctctaattcaattctgacgctatctacctggagatagcatcagatcccacaggtcgatggctcaatccccaagactgcccctgccttacgatgacgattgcatgcctcaggttactttacctgtgttttgaaggctataattcggggttcccacaacccccttcctgggtttggttaatttgctagaatggctcacagaactcaggaaaacacatttactggtttattataaaggatattacaaaggatgcagttgaagaggggcagagggaaaggcatggggatgggcacagaacattcatatcctctccgggagtgccagtctccaggaacctccacatgttcagctatccagaagctctccgaaccctgtccttttggattgttatggagtcttcattacwtaggcatgattgattaagccattggtcattggtgatcaacttaaccttcagcccctcacccctccccaggggttgtgggggtagggctgaaagttccaactctctaatcatgccttggtttggtgaccagcccccatccagaagctacctaggggctaccagataacactttggagtttctaaggatttaaagagttgtatgccaggaaacacagttaaagaccaaataataatttttcacagtatcgtaattttcctcaccccatctggcccccagatggtttgattcaagtatttctttatcctgggtaaagagatgatatgcagaaggagggaagaaatatcctctttctcctttcaacagagttgtacaacatctccctctctgttctcacagcccctgcttaagtgactcttcagggtagcttctgttcctgttaatgtcccaggcaggaaagattatcaggtggcctctcagccttgctgaagacttttgcttttcttatttgcccatccttaattcatcaccccagacacgctactgaatgtgttcttggctatcgctgtggataatctcgccaacgcccaggaactgaccaaggtaagcattgttttctggggatctgatgtttctctagtgccattgggtaccctttggcctttggaactctctcccaaagtctacattgtctgactcaggcctgccaggaaggccctttctggaaacttctggacagttggagagccacayacccatgacggaaggctggttcacttttattgagtttggtgagcctcaacctagcccagggggcctcaaggaacacagaaaataacatcttaatttctatgagccctcaaaggagtcctttccaggatcatcatggagagtcaagaaaattctaaagccctggttttaagttccacctctgctactgcaacctgcggctgtgtgacctgaatcacatgacttaacccttttgggttttggtgggagagagatcagggccatcacagttcctgggctatggctgttgggatattccagtaggcaaaggtcattttggggaaatttcaatgaagccagatactaaatttctcacagaactgttcccttcttttctctgattaatttccccagtgtggggaggtaatattaacagcagtgggatggtctacagagatgagtaaaaacccttctcttcacagagggtgccaatttggttttgggcagaggtgcatagcatcctgctgacatttctgagcttcttccatgcattctctgatgatctttctacatccttgagggtcttcttatctgcatatatggtaggaaaaatatcagctttagtagctgagaaactgggtctgagtcccacacctgccattggctgtgttggctttgcttggactcctgatctctattagcattggtttcttcatgcatgagacaggaatgccatatctgcattgtgtaccttacaggattactgtgaggatcaagtaaaataacgtctgtgaaaaccatagcatgctctgaagatgtatgtgctcttattagctctagtcattttacctgagctggttttccttgggttcatcacatagaggggacacttgcaggaatgctgctgaagggatgagatcttggcctaagcacccacttagctgtgcaaagaagacactacaatggggcactcagcctcagcactttacttggcggggtccttgcctggaaggcccctgctccatcacttccagacactgtaggacatctgggaagtgtcagctcctgccactgacctccacagccatagccagctccactgagggctaggggttggggtagacttctcctggttctcatgagcaacctgtggatggctccaggatggagacagggattgctggccacgctatagctgtgagactactgactcccaaggggcctggcctctggccatcagaagtctctgagccaacctaacatctcgctgtcttgtttatcctcttcckgtgtcttcctcacttcacttggtattcagaactcctccttaggagagcagccaagggaagctactctccttcctggggatcccaggcaaagccatctctgctttgtgtctaggatgaacaggaggaagaagaggccttcaaccagaaacatgcactgcagaaggccaaggaggtcagcccgatgtctgcacccaacatgccttcgatcgagtgagtcagctgcccccttcactgatccctgagctcctgtgctaacagccaattcatcaactcacagaactattggttataggagtgtacctactacatgctgggaactgttcctgagaatacagcagtgagccagacagagtctgttttcatggaagtgttatttcagtgagtgagatagataataaacatgcacatcatttcagatagtgacaggtgctataagtaaatgaaacagggtcctatggtggagaagtacaggagctgggtgggagcagcttatgtcaagccagaagggattctctgaaggggagctgtttaagccaagacctaagtgtgtagatgacagtcatgtgacattttgaaggaagagtgttccccagcaaggttcagtgtgactggtgtgtaattaatgaggggaaatagagaaagggccagggagggggcaggggccaactcggaggtccttaaagtccaggtggaagagtttagcttttattctagctgaaatcacaagaggacttcaagtggaaggatgaataggatatgatttacacttttaaaaaggtcactctgttctatggagcataatggactgtaggggccagagtggaggcagggaaagagtctgctctcagagtaaagtaggtgagaggtaatgggggtttagactagggtgggggaagtsaaggagatgagtaatcccattcagtcggtagtttggagagagagccaataggatgagctcatggattaaatgtggcaggggtgaggatgaataaaagggaagaaacaaaaatcgatcccaggttttaaggttttgtggactaagcaacgggttggggagtggtggtagttactgtatccctggaaactgttggaaatctaaagttcattttgagatacttctaaggcatccaagtattgaactggctattggttacctgcatctggagctcagaaaagtcagaattaaaacaatgattggggaaggttgttcgcatttagatggcatttaagtcattagtatgggtcagatgacccagagacccagctgctgaggacagaggctgacagcgctcctcctgcttaagaggagaaatcagctaaggagaccaagggagtgcagccgggaggcaagagaaagaacaggaggtatagtgtgctggaaacctgtgaaggaaaactgcaggaaggaggagtgggtgccggtgctacatactgtagaaaaatcacatacaatgaggaacagaaaagggaccactgcatatggcaaaatgaaagctgttagtgaccttacaagagccattttcgtggccaggttggaacagaacccagttgaagtggactagggagagaacaggatgtgataaaggagagtggtgagtccactgcttcagggatctagcctggacctgtggtagagctacaggtagtcggcctgggccctgcgtggcctggtctctgcgtggtgacacagaggggtgttggagaagaggctgggaagtgaccatagaaccacataactcctgttgttgcatcggggcctgcatgaggactgtgtgagtggtgagtggtgctggggcatctgtgggagggtccgagacccccaagggggtagaagtctatcctggcaatgaccctgtcattgttacttgaagctagtaagggaagagcccttggttggctagagttccagtgaagggctcccaggcagcctcttccttgccttgtggggtgtgccagggttgtgtgttgaagcrggggacctccctcctgcacggccatcatgttgcctttgcctttcgtaacaaatgcctggcccctggatccctcttctgtgagtgaaagagaaaaattcccttccaaatcgttaaaggttgatagggaaatgccaaagattgatagggaatattcctctctggaatattctctgggccttgagtaatttctactccaccttccctgaactcatgagtttgggttaaaaacacatacacacaggtatccaaaaatgtggatgggtaggactggctgtcacttaggagtgggtggttctatttactgagatgaggaagcctgggggagaagtgggtttagagagatgtgagttgggacaacgcttggcccagagtagaaactcactatttctggaatgaaagaatgaatgaaatgtgggtaggcacaggcagggccgtgggaattgagcagagtgtgcatcagggcacagtgaggtggaaggacgtgctgcaaacatccaagaccagcagagacccgggctttggtgctgtacatgtgctgtgaggttggcgttgctggtgtgagccacctccgggtgtgtgtgccccgctcagctgtgtacactctgctcaggtatgtaccctgcacagatgtgtgtgccctgcaaagacgtgtgcaccctgctcgtgtgcgtactctgcccaggtgtatgtgccctgcacaggtgtgtctacattgcttaggtgtgtgtgtcctacataggtgtgtgtcctctgcccaggtgtgtgtgccctacacaggtgtgtgtgctctgcacaggtatgtgtacaatgctcaggtgtgtgtgcattttgctcgggtgtgtgtgccctgctcagctatgtgtgccctgcacagatgtgtgaacatcgctcaggtgtatgtaccctgctcacgtgtgtgtacactgctcaggtgtgtgtgcattttgctcgggtgtgtgtgccctgctcagctgtgtgtgccctgcacagatgtgtgaacatygctcaggtgtrtgtrccctgctcasrtgtgtgtacactgctcaggtgtgtgtgcattttgctcgggtgtgtgtgccctgctcagctgtgtgtgccctgcwcagatgtgtgaacattgctcaggtgtgtgtgccctgctcaggtgtgtgtacactgctcrggtgtgtgtgcattttgctcgggtgtgtgtgccctgctcagctgtgtgtgccctgcacagatgtgtgaacattgctcaggtgtgtgtgcactgctcaggtgtgtgtgcattttgctcgggtgtgtgtgccctgctcagctgtgtgtgccctgcacagatgtgtgtacactgctcaggtgtatgtgccctgctaaggtgtgtgtgctctgcacaggtgtgtgtgccctgcaccagtgtgcgtacattgcttaggtgtgtgtgctctgctcagttgtatatgccttgctcaggtgttcatgccctgcttgggtgttaaggcgaaactgctgatttccgactacactttaagtgcaaacatggctatccatgaagaaacacagaagaagcactgttaaaaagcaaagtgcctgagtgctagttatatttgtstcactaatataccctgtgacctcagagagaaaaccactccratctcagaacctctatttcctcatctttgaaatgagaagaatgccacctgcccttcctatcccacaagggctattgtgaggcgtacacaaggtctcattcatatgagttggagacatgtggatgcttctctgtatgattttaggtatgaatgtaagtttgaatctgtgcatatgtgagtagagagaatgctcatgcttgtgtgtgtgagagaatccttccacgtacgtacactcttacacacatgcttctggatagctggtatttgaatatttgagaatttgcaaatagatggtgtgatgtgcttttcctagcagatgtgcatgctgcctgtctaaagcgtacgcttctacttctgtatctacccatgcttcttggctctcccgcccccacctgtgccttgttgcattgcaggtcactgatgctgagggttgtattcagttgaggagctcacaggcttctccacaatgatgtctgcatcagtgggtgctcctgggtggccacacacatgtgcactgtgcatcttccagacacccagagtgggcctcagaccaactgcctctgctccctcagtcccacccttgtgtggggctcttctgcagacatgtgaaagatggcagttgagggggattaatttgcctagcatgttctccgtgggtgggcatcagctttatcaggaaaggatcagcatttgccaacatcccaggtccaagcagggcccactgggctggactgagttcatcaggccagtaactggggcaggctcactgcaaggatagcccagatgtgttgtcctctagctgagcattgaacctgtgctgacagcttatttaccaggcatcctgtctgtttttgcgggaacagttcatacgttgccattctaaccttgtgtttgtaaggacacaacatgcatatggaagagagttttctctgtacaaggctaagaaggtcaatactctgctctgcccaggtgaacatagaacagggtctatggccagggcctctgcgttgctcaaaggcagaggtcactgctcacatcctggagtacatggatggtggcctacggaaagatggtgctgcctctgaccatggaccacttsgtagccttgacatcgtgcatggcagagcacttgctccgctgcatgttttgtgaagctgggtcaggttctgctatgggagtcatgagctggggagccacacccaatgaatgtgctatgctagccctagaaatgactcgggggaggggaagaaaactactcagcaacatctacaggatttccaaaataggaatctgaaggatgtgtaggtggaagtttgcgtgcctgtgaggcatggtgtttgagcatctggagctgtggatcatgtgaaatggcataacctgtgtgcctctgcatgtgtgcttcaaaaactagatccatgtatttgcacatagcaaggaatcgaaagtcactccattggagaatcgaatgtggggagtctacagaaggcaagcaggcacatggagacctgatggccacacagaggactccctgtctccctctggaaatctgctggtggctgtggggcttgaggttcctagaggttggggtgaactgaacctgtccatttttcttccccagaagagacagaaggagaagacaccacatgtcgatgtgggagccacgcagcagccacctgtatgtgtgtaccagtttgcgtgtttgtgagtggttaygtgtgggcgtgggacaatgtgtcattgtccttgccatagacaaagtggcactgggtgtgcatgtcagtgtgtggcttggtgtgygtgtgtgtgttccgttcacatgatctgtggatatgccctctgcacctctcaacatttgcttatatcagcgtgtgtctacctttgtgaactgtgtgtttttcgctcttcagtctggcctgtgagtgggtatatgttgtgttagtgttggtgggtatacctctcacgtaggtagttgtgtacagctatgtgtgggcctcagcgaggatgcgtgtgggtacatgcgcgtgtccccttcacagtttgtaggtgtgcgcccacaggcacaggctcagggaggaggtaacttcccctccgcccagcgagccctctcccatgtgctctcctgcacttgtcatgttcatgatttccygctgccccatgaatgctcctctaggcccctgggctgaaatgctcgatcgcagttttgagtatgagctgctggtggtctctgcacttagccttctctggcttttattagctattgtggaagagactcctagcactcttacttttgagggtgatatcaagactttttgtaataagtctgcctggcactcttcttacccttcaatggtatctgaccatttcagccctcattatcccgggctgtaacctgagagggaagggagatgagggggagaggaggaggaaagacctttgaccttgaatcaagggccgttgagtgtgtwcaagcagatgccccgaaagcaaggagagcaggggagtgaagacgtggtaagcctgtggatggctgccccagcaggccctggggacttggaactcctcccagggttgatgcctacccagccctcagctactacaaagcagggattggagcagaaagtacctgggctgggaggcacctgcctgatgagctcctcacgtgtggcccgcctgctcctcgcatctttctgtgcttcctgtctgcaggtcctgggcactcccatttgccccyaccatgtgtcctgccctctcacatggcccctgtggccaccctccctgcctgcagcttctgggctctgaccgcggccctgccctttccccttggcaggagggagcggaggcgccggcaccacatgtccgtgtgggagcagcgtaccagccagctgaggaagcacatgcagatgtccagccaggaggccctcaacagagaggaggcgccgaccatgaacccgctcaaccccctcaacccgctcagctccctcaacccgctcaatgcccaccccagcctttatcggcgacccagggccattgagggcctggccctgggcctggccctggagaagttcgaggaggagcgcatcagccgtggggggtccctcaagggggawggaggggaccgatccagtgccctggacaaccagaggacccctttgtccctgggccagcgggagccaccatggctggccaggccctgtcatggaaactgtgacccgactcagcaggaggcagggggaggagaggctgtggtgacctttgaggaccgggccaggcacaggcagagccaacggcgcagccggcatcgccgcgtcaggacagaaggcaaggagtcctcttcagcctcccggagcaggtctgccagccaggaacgcagtctggatgaagccatgcccactgaaggggagaaggaccatgagctcaggggcaaccatggtgccaaggagccaacgatccaagaagagagagcccaggatttaaggaggtgagtgagtcacagggctcccagatggatggcacacaggctgctgttaggtgttcctcaatataagcctttctgagctccagtttcttctcctattataaaatggaaatgatgctgacacacactttgtgaggtatgaataaatataacaggcagtgggctctgtccccccaaaaacgagggcctgttggaagtgggtcgtggatagaaggatgggaataaggcagtggccatggcttgtgggtcttagcacctctctgcctgtctggttggggtggaaggcagtggtggccttgtaccttccaggctgcctgagcttccccgccttccccttgtgccaggcacacctgccatttggggacagcgtctgagcaccagctctctcttcctctctcttcacaggaccaacagtctgatggtgtccagaggctccgggctggcaggaggccttgatgaggctgacacccccctagtcctgccccatcctgagctggaagtggggaagcacgtggtgctgacggagcaggagccagaaggcagcagtgagcaggccctgctggggaatgtgcagctagacatgggccgggtcatcagccagagcgagcctgacctctcctgcatcacggccaacacggacaaggccaccaccgagagcaccagcgtcaccgtcgccatccccgacgtggaccccttggtggactcaaccgtggtgcacagtgagagcacagtccctgttcccctccacccccaactcctatcccatctggggctggggccatgacaataaagccacatggaaagcaccaccaggaggagtaaatcatccttcaagaagtaaaaatgagtggcggttttctcccagtgtgcagaacaaaaataagctagcgttctcttcatcttaaatttttcccataaaatttccccaggcttgttcctgtgaccaccctcaagtcttcagagtgatcacttgtgactttgtgcccagttagatattcagctgtttgctttggtgcatgaatatttgatggtgttgtctggggtctcccaggtgctctgctgccctggcaagttagggagcctctgatggagtggaccatggctctgckcactgagtgatcttggaaaaatctctgcatctcttgaggcctcagtttgtcatctgtaaagtgagagcattgtactagatgatctctgaggcctttccctgtactaacattttatatgattctattgctcttatcaactctttttctcctaggagcttttagccacaagttctccccatcacagttcccttaggcaacaaatgttaatcaatggtgtcctaaagggaaacacagccaaaaaaaaaagcacttccccacccctgccctgaccctacatcccatccctgtattcatcctaccccttatccttgccctgaccccataccccatccctgccctgaccccacagctcatccctgcattatgaattccacaccttatccttgccctgaccccataccccatccctgccctgaccccacacctcatccctgcattatgaattctacaccctatccttgccctgaccccacaccccatccctgcgctgaccccacacctcatccctgcattatgaattccacaccctacccttgccctgaccccatacccgatccctgccctgaccccacacctcatccctgcattatgaattccacaccctatccttgccctgaccccataccccatccctgccctgaccccacacctcatccctgcattatgaattccacaccctatccttgccctgaccccacaccccatccctgcgctgaccccacacctcatccctgcattatgaattccacaccctatccttgccctgaccccataccccatccctgctctggcctcatgatctctgtgcattaatcccacctgctgccccgtgatcactgaattgtgaccacaggattccagccttgctgttttcctctactttttctgtatttactctttcacatgaaaatcttttccctccctgtttttctttcttccatggctccctctccatttccgcatcttctctatagtcaacgtgccactgctacttcagaaagtgcaatctcccatgtccagtgcatgcttcagttgacttgggcatgtctcaggatcccagacccacagctcttttggtgtttgtttgctttaatacataagaagtgttttgggccttcttttatgagaaagaacataaagctttactctccctctgttgtaattccagagctagtctttggtcttggtcataggtaaaagcatgtgataggaaggcttttggatacttcttatgacttactctttaggaggcctgggcatgggccaggaccaccgaggtccactgctgacacagggttccagggtggagtcattcaatgagcagggagcagtgggcgagggtgactggggccctttccccactgtgacagcttcagcctcctgccagtttaacctacaccgtgtcttgagtatggaaacagagcagcagctgagagctcccctcgacctctggctccttcgtcctcccaatccttggatgcagtcatggacctatactcacatgaatattgcattctcatttctacattaaccatggccgagaaaagcacagccagaaagcctgctgcaaacagaatcatgatttcttgaaatcttccattgcagggtgattcaatgaaaggctataggattttgaattgggaacccatactagctgtatgaccttaggaatggtacttaaattgctagaactttagttttcccatctgtatcatgggagtaataatacatgccactgagggtatacccctcagtgggaaaattcagtaagtgagcatgtacaaagaatccagagtttagatataaaatctaaaccttgtgaattttataacagaaacatcatgttgtttatcagactgtaaaagttcaaccttaaaagtggaaacatgatcatggtcatttatatgacataaaaggttatttctcataacatttggggagggtaaaaataagaagagaagaggagtttaactcagtgtcaggtagtaaatacccccagtgcctgcagggcaccttgttagggacatccctggagccctttctcctcctctcctttcatccccaactaaacacaaatggtgccattttcacatgcctcatgatttctgaagatttcaacrtgttcctcttgcagttagcaacaagacggatggggaagccagtcccttgaaggaggcagagatcagagaggatgaggaggaggtggagaagaagaagcagaagaaggagaagcgtgagacaggcaaagccatggtgccccacagctcaatgttcatcttcagcaccaccaacccgtaagccaccctcgcgttgctccctctttagtgctagggtaaacggccaggtgtgaggcagggcagggtgaaggggagaggaaggatgggggcccagccatcttcttaagccttcctggtggagcatggccagacattgagcatctggggtgccccctaagtgaggtgggttggtaagttagtcagcctctgaactctgtgcccatagctgwaagagtaacatcgacaggagaacatgagaaatgtcattggaaaggaactctttaccagtctttggtcagtaggtagtgtggagggaggaaggaaatctacttgagattttgccaccaaatattccagaagtggatagagccaagaatgtggagcctagaatgaccagatcacctgttggagttgagaattttggtcacactgctctacatgtggagttttgaaatggtctgctctgagcatgctactcagagcagaggcagggacatgaagtgggggtgacagagcggagtctggaaggttagattcaggaaagatggaatttgggaagagcgttccagcagggctctgggaagggagcaacctgagttaaggcatgtgagccatccatggctagaatgcagaatatagaatacagttrctttaaccagaataacctggggctcatgaaaactcattactgctttcgtcaggaattttagaatcaagatctctttttatgttttttggttctttgtaatttccttgggatgtcccagtttcctttcagtgggagagtagacatcgagatacagcagagggtgctatgcagctgccctgagttggtaggctgatgctggctgctccccatggctcagacgtgtctgtggataatgtatcttggcttgcgtgctgcagcctctaaccaatctgattaccttcctccactggggctttaaatcaagggtggtggctgagaaattaaattgctctccctggcggcttcctttgrcaagggcctggctgtctggaaggggccaatatgtgtatgtgggagtgaggagtaagggcatgggcgtggtggggagtgggccagctcagccatgcccactgcccgcaggatccggagggcctgccactacatygtgaacctgcgctactttgagatgtgcatcctcctggtgattgcagccagcagcatcgccctggcggcagaggaccccgtcctgaccaactcggagcgcaacaaagtgggtacacaggggccatgtgccagcctctgtagtgctctggtgctcaccccatcccagcactggaggtgaaccgagatgrtagcaaggtttctggggaatgagcaagggttggaaattgtccactcctgttcctcagggcgaagtatgaaccattcccagacaagccccttcttagcccaacatactacaaggctctgccccaaaccggccagggctctgcagggctctgcagccacccatgggcttggatgtgggtctaatatagggtcatggatggtgtgtgtgaagctggcagctgcagctccaccacagggggccaaggcctctcctggggtcccacgggtatgtgtcaggagacatgagggacgcgaggaggacaggagctgacaaggatttcaggtcccgagcctgaactaagggacaggtatgtgggcaattcagacccaaaatgctaagttctggccaacgagagggagcagccaaggagtggccactgggtcacatggctccagcagggcccatgcccctccttctggcatttctctctcagtccagctagtggctctaattccaagcctttgttctgagggtgcagtgggtgagggccagggtgggcrtgcacgagtgcatgtgtcctggcaggtgggagctcatgtagtagcctgttggccacacatggtcatttccttccaccatatgtgtctttcaggtcctgaggtattttgactatgtgttcacgggcgtgttcacctttgagatggttataaaggtaaaaacttctagagaaaacctgggctcttgggtttagatgggtcacctgtctgctccttaggctagagcccttcctcagtgttaccacctaccagccaatggcagccctcagtagagcttctgccgccccttctctggcctcagaatcctgaagaaatctgtctcagcaagacacggctgcgtggatgtgtttgtactgctgcaggcctgtggacatggcccaagtaggaggcaggcaacagatgtgcagacagggttggggcctgcactcccctccccagtgcttgtcttggctgagcctgggtgtgtgccaaggcaaagggctaggtagagatgagtcttcctgggcttcatctagtcccagccaccacaacactccatagtctgtcttgttcccagcctcatccatccaggattttacccatctgtgcatatgtggcaatgcccagtgctctgagccataaatgaaaggaggaatgtgtcagggttctgtgacaaccaaggagtctagtgaaccctgggtgactatgagatgggggcctcaggactcagttatgtggagaaagcctgctggacctaacctctcattctccaggtcctagcatagggttggttgtggagacagtggcagtgggggcactgccatgatgaacagagctcaggtcaagtgttgcccacactttcttggctcactgtggctgttcatatccttctgcagatgatagaccaaggcttgatcctgcaggatgggtcctacttccgagacttgtggaacatcctggactttgtggtggtcgttggcgcattggtggcctttgctctggcgtaagtgactcttttcatatttgattcccttccttcccctcttcctggagactccagttgatttgaagccctttccagaaatgcaacatgcagggtgatgccaaagaatgcccccgctggaaatctgctccccagtcgccccsagcagagctcctgagcgccttgcagctccagctcacgtgacctgagtggcagaacgggggaagcaggagtagggagcgtcaggagggagaagtcagaggccctaggaattcctttcctagagatgagtaagcatgggcaggcactcacagtgtggacagtgtttccatgcattcagcaatggacccaggaacagcttatgggccctttctttcttgagtgtgtcaatcaaggaagcagcttgaaagaaagatgcagagggtagagcaaagttgaggatcacggaatcctaggcatggtgaggttttctattcatagcaggtgtaaacgagagctcttccagggatgccagaaccatgcttttgcacaaacctaataatatgtgtaatctccaaaaggaaaggctttccaaactttccttgataacatacctaggaaaacagtcttaaaccattcaggcaacaaaatcatgttcataatatttgtgggatttttttcccccctgcacatggatccagctctagccagttttcaatcacattctgacatttcctgtggaatctagccaaggaaagggctcttctagccctcctgggattaactaggaaatgggatgctttcagggcctttttcctaacccggtgtatagagtgtcccagtaggatgaatgacagcctcagggctctgtctgtaccttgttcrccctgagcagcttcagcctcttccaggaggcacaacagaattctcagagccatccctcaagtctctctgagtacaagtggaagcctcatctttaggctaagcaaggctagctacactgtgtagtgaggcaggagagctttcaggagcttctgtcattgatggcagctgcaaaaggaacacagtatcttcatacgtttacccttctgagtggttttccctccaagggtttgcccttccaagtgtttagaaagagatcacccttggaagggtttgcccttctaaatgtttagaaacacagggaagctgacagtgcttctccccaagcttctcttcaagcactgtcagctgctgtctcttatcctttctggcagaaaaacaggtgggataaaaattaccagatgtttctcaagtggcctggtgggggtggggatagtggagggctctctctctcttaaggagaggtacaagatacactcccagctgtgctaggagtgtaggatctcccagaccctggaactggactgtgtccactgcttcctcagccatgagagacccttcaaaagaaaaccacattgagcatagtttgtgactctaaaatgggctggtgatcaaggtaattccagtgtcccttgtccccttgtgcacatgttaattccattgtgtgcagtcacctttgtcccccacaaaaagaaagctttctgtcacatgtggctggactgttcttgaggaaattttacagaagcatggggtattttctcaagcatctgggccctgtctggattctcatggtgcaatgaaaggaaaggcagctctggctccaaaagagggacttccagctcctcttccgtcttcttggaaagaaggattaaagtctgcctttgccctaaggagacccaccttttttgttagagataaatattatccttaggtttttaaaaggtcaagttccctttcattttactaattcatttgcatagattattcactgtatcattcttcttattttgatctctaaaaatcatgtgtctctctttgaagtataaaggacaaagagatagaagcatataggaaagaacccaycccatctttaggaagaacagagcccactggcataacaggacagagtggcaagaaaggttgggctgtggaaccagacgggctcttgtttgaatcccagcccctctactttccagctttgtgtccttgagccacacagcaaaatattaaccctcctaacctcagttctcatctctgaaatgcagataaaataatgtgtgtaaagtgcttaggacggggcctgatgtagtgtgaacagtcaatacatgttgattcccctcctcatccttccattctcttatcacatcatgaaatccaaatataggagsaagtacatattgatgcacaatgtatacagatagatgtgtgcaggctggcccaagacctagttgttttatacagacacaccccccttgcctatgcccgtgtgcctggtaaccaggctggtgtgttggtgccagtgtgggaggaggtgtgttttagagggagctcctgcatgcctgcccattgtccacagtccagacatctctcctgagacccagagcagtgatgatgtgcagtagagctgtcatctgtcttgttctttctttgtgccctttgaaacatggcggtggtggctttggcgctggtggcaggggaagccttaacrgccccggagctgaagcctctctgttggtcctcagaccaggtacagtgcaggggcccccaggaaccccctcgttctggggtccacacttatgtgatgtattgagagttatgatccatcacttgcttttagtcatgttacttcttgaactctctcttcattttctctgaaacatagatgatacttgctcacccttctccatccattttctcttttgccttcaacttcccaagcttgccatgcccattccctctcccctttctccgctcatggagcaggttcccactccccctcctttggccttcgtcacatttgctgagggaggtccaggtaatgctttctctcactcatgcacccatgctttctaactctgccctgttcctttcctcattaatcgtaccagagaattcagctctcccatcactttgatggggttagccagagtcccacctgccagcagagagagggcctggcctggggcagagagtgaaagaagtcactgagcctatattcctcatggtcaggggctcaggccagcagaaagccaaatgtggggttgtctgcaggcttgtcaagtatctctctccttgtgtttacaactttcgttatcatatcccatatatttgccccataatgtccaccattcaaataaccttawtcctgtcccagtctctttctgcccttcttgaaattgaaccatgacttagtgaggaggcttctgtgaagcctattgcttaataaacttgagctatggtggttgccatggtagcatctttctgtggctcctcagaaaccagggctgacatggcattccttccaccacccagccagagccttctcagaccctggcccaactcccaggagcaaagcccctcaccgagtsgggggagtgacctctagctgaattctcaaacaaagctgtggtgtcccctgagccctcctgccgaggcgtgtgcctgccaccatgtatgttttctacaagcatatatgttgtttatgcagtggctgaagagaagactgttctccacagctgcatacatcaagttaagggaacgtttataatgtaaasctggaaaattccattagggaactttattgacttttgaggaggaagggaaggggattttttcattkgtttatttttcttcttggatttattttaagtgtgggcagagcagtggataaaaaaaataaatggaaagatacccacattgcaacttttctgttctttccaattcacttttacgttataaggcatttataagaacactcaggtctccttccttaagcccaccgtccctgcagggaggtgggcagagttttggcaaaggttgggttcagggcttcgttattccrctgccctgacaacacccgctttctgggccacatggagacagagtgtttgctgactataaatgtccagagctgtgccttctgtactytgaggtctcaagaaaagtctggtgagtggctggatctatgaaaccttcctcttttatctttttctttccaatgaagagggattcttttgtgtgatttcatgtgaaaggaccagaaaccgctttgtctagtttccacacaccctgttgccatcgctgctgcttcccagactcctgcatggaaggcaaagatggttacagccttggcatttctggggatctgcacatgaggcacattcccctgctttgggggaccctgctccccaaccaaagtcagctgccttgtagggaggtcacrtaaccactacacagattacattcatgaacctcacagaaccctcatrtttcatgtgtttcatgtctagtgaagtgacttgggcaaacaggtgggcagggacagcatctctggagaaatgtaggagaggaccaggacacctgtgcgtgtgtgtctttctgtgtgtgacacctgcactccaacccaggactctcaccctctccatttccactgcyctrcagcacgttacttgactagctcgattcacatgagcaggtgagcgctcctggattggattctaagtagtcatctcacagcttataattgatcgtcagcacagatggtttaatagaaaaataactagcaattctgctcccatctcctcccccacctcrgaatttaccatggcccgtgcatcagtcagttacacaggctctctggcggctgacgccaaagcttcccattgccatttgctgttgtagcagggcatggggtgaggtcaggactccctggcactcaggagatttggctcacagccgcacttggcctttcattattcagtccttagccagaaacgaaaaacatgagtcaatctgcctcttgatgccagaaggaactggagttcccacattagcttttattacattcttttcattgaagtatgtcactttcctgacacttgacactctgccctagtcactgagatggataaggtccattgaatgcattcagcagtagctgtagcagcagagttatatacacaggcatggacaattttagatttggaaggatcctaaggagccacataatatgttcctctgggagctgggcgtggtggctcatgcctgtaaccccaacgagtcgggaggctgaggtgggaggattgtttaaggctgggagtttgagaatatggtcctctggttccggatttgcttgtgggattttgtgttttagaaggtgagaatgtgcacatgtaagaaagaggtggctattcagcaccaaaatgctcgtacacactcacgctcagcacagcatagaaacaacagacaaacatttcaccctaaacctggctgtttctttctcctattcttcactacctgcctgtgtctgaggcagtcccctcaaacctccagcgttgcctatgggtcttctttcttgacagaacttccctcttttcaaactgaaaggggagtcttccaaaggaagcagtgactgcacattaatcttggaggcaaaaaaagtggacgaagtcctgcttcatgcaaagaagacccatttaccactgagccagacaggycatccagtgcccctgttctgtggaagagaacgaaggattaaaattaaatttagccgtcaagtagcccattaactgtggatttaggaggccagctgaaaaggaattggaaatttccaactgtaagcagataggaggattttgtttcctgacactccagtttaaaagtcacctcaagaatgactacatctgatttttgtgcccagacaaggacactaaggatgatcaatrcccatggacttttgaggtgcctactactatatcatagctgccttgaaaatggagtttgggagggagtaaggagggacagagtggcagccacatggagggagtgagtgtctgaaaggagataagtcctcagtctacctactcttggcattaagtctcagcatgcatattttttagtgaacgctggaaaatgtgttgtctgctgcatgtgacattggtactgctgaggaactgcctgtagaatattcactttgagacctttatcttatggaggcaatgggtgtgaacacccaagtattttttttttttttaattaacagcatgaaattgggagatggttggttgtaaatgggatctcagcccgtggccacagacccaagcaaaatgaaatgatccaatcagggaacactgccccatccacacggtaaccaacaaccaactagacccagatataaaatgcaccctgtgagccttcacaaccatgggaagagcccagtactgctggattagtggaaactcctcatagtgccctccagatttaaaagtagattttagagtaacttgagtcggaagacttcataatgggacttggggaccatcaacacagatcatgccagccaccttcctaatccacatgcacaggggcacagcctagcatttcaaattagtcttcagtgggacaagtgtattgggtggacttccaccagctccaaggccttcttagaaagatcagcagatgaggtgtctttgggtatgtttagaataagacaaaagagacaactaaatccactgttcaccagattgaataataaaactgctaggagacagttagatgctctgctctctcctgctgcttctcagtgtttggacaaaaacacctgccagttggagtatggtgctgtgtatagcaaaggagaaagcttgcaaaaggctctcrggagtgtgtgtgaggagctcgttgaggtccatgtgcaagrgggaaaggattatgcaccacttagcatagagctagtgctctggtcacatgacaaagaaagatggcagaataacaatggattgagggttcgagggtgaccccaagaaatgctgaggcatggaccacgaggaaaaataaaccccaaatggtagccgctaagcagtgacaacgtcaaagtggtaaatttaaaattttcacagaagcagatgaacatatccttatctgcagatcctagagagacaggcactgccagtgcaaaaggggaaacttccccatggggtctttagaatttttaaagtgctttcacactctttattttatttatcaccgaacagtcctgttttacagttgagaagtggattgcctgaggtttgactagtctgactcatttgactagtaaatagcaaagccagttcttgagcaaccttggtgttctgatttgaagttcagtgttgtctccattatgttaagcgcccttctacacatcatgttctagttagctccaagcaattaacccctgtaagctaagagcagtggcttggtatagatctctcctcaacctacagatccttctgtctctacctggtgacagacaagacctatgggtagatggagaaggtcatccctgaacttgtccatcttgttgtttcatctgtaactttttttttcctaggaaccctcatagaccctaaactgattacagggaggggagtgtgatagcttagtatttgagatcaggaagtacttggtcttttactgtttccttctttggttaaaacgctccagtggttcccatttgaaaggcactctaacatcacaaataagagcatagatttcagagtcaggcacatttaggcctgaatcccagcactattattaaccgccttaactttgaacctctgcttcttcatctgtaaatggggattcaaaataatattttggtcctataagcattaaataaggtaaaatgtatttaatgtctgctatagtgccaaggacttagtaattgtataataaatgatagttattatttcctaccaaataatagtccagacacattagtgagacactcgaggctcctcacagcatgacccctccatctacctttcactcctgcgagcctggccattccctgaggcaagagattccttcagatccctgagctattccccgctcatggggtagggcagaaggccatggcacttaaaggacagaagggttctttagaacctgatgtccctgctctgccctcatgggaggagaatcagttcctggcagaaatcaacttgagagcatgtcctttgagaagagggggctgggaggtgaagagcgggattacattgaatgatgagtaattacacatgaaagatctggagggcagcttgacaattgagctggaaaattctcgtcttttactgatgaaacaagaaaaatctgtcatttttttttttttttttttactggagagcagccaggaacttaccaaataaatagaaaataaatggtaaaatrtgtggcccaattgagtcccaattaaagtgagaccagtgcatcctagtgtgtggaattgtccttagattttaacattagagtcaatttttgaacctgatagaaattttattaatgaggcagtgtaaaaatatctgattataatttagtatcagagactagcaaagtgttatcaaacagttacatttaaatgatttgtaaaatgcacgtgaattatttcctaaacaatgtgcctcaattaaggtacttgaagagctcatccttttagtttggtgaaatgtcttccttgcaatcttgttggctttgataatggcttaaatcactcttgtatgtatggatttgggagcagtactttggcctagtccatgtgtaaattatattttaactaatgrggactaaagtgttgaggcgtttcttgactccagggctttgttattcagtactcttttcatttcaaatggcaattttaaaatcagttaaatcttgcccctgttaacaaaactgaggatgaaagcatatttttctgcagctattccaattcatagcttttcaatggctcctctgcagtaagagacctgatgaaagatgcgtagagcaatgactaattttatttttttttattttacttttggcctgtgtctgattgctatccttggctcagacctgtgggagttaggatgtgacaaatagcccccccagtggtttggcagccacgttcagctgttaagattagagtgtaccattaaggaaccctgttttccaaaacaagagacaatggtgagtttgcattataacatgccttatatggtatatgtggtaatacaatgaattataccatgatgctttactaggattctggggggaaattaattcaagagagcaaattatatcctttatccaggtgtgtgggaggagcaggaaatattgggccctcccgcagaagaygcatgtctatgagcatgacctctgagaaccttttcagatgctacaggatagaaaggtctccgagataaggacttgagctaagcagaaggcagaagcttggggtgtgtgatcctagatcacctgcccatatattgatctcccaccctattcttacatcttagagatatgaaagattatcccttagttcttccttaagacaaatgtagcctggggaaagggaaacctttgtggttattttggtaaattttttaattgatttcatttttmctatggcagcttgcagttatacttttattaatgtgcttgtttacttgaggtctatcttccctactagactaggtaagtttcaaaaggttggcaacctcatttgttcacaactgtatatccagtatgcagaacagtgcctgacatatattaaggactccacagatgcttggtatatggatgaataaagatgtgtttggctgacctaccatatgccctgtcttatatgtgagaagatgctggggaagatatttctgtcctctgaacatttagaggttatcacattaaggatttaaggtttataaggccttgggtctaattcccaagtcatgattcatttggcatttatagtgaaaattaatttaattttgaatatgggatcatttgttgagtaaaataaccattagaagtctttgcttgtgacatacagtagtggaacataggtttgccatacgttggcaaaaaataagaaaggaaagaaaaaaagtaaccttcatcacaatgtccaactaagaaccaaagcctgaattatgagcacttcttcttagcagcaggccaggatagggaatcatgagatgcaggttcacctatgtttctaaactcactcagtgaatgatcttaggcaaggcacttcctcctggggcctcagtttcctgtgcagttgggtggatttcagggatctcttccagctcagaaattcactgtgctgtttgacagaaccttgaactaaaacctgctgatgcagagccttagtggttaagagcaagagctttgatcatcatacatgcttgggttcatgtcccagctctgccagctgatgtcgggcactcaacctctctgaatctcttctgtgaaatggggatagtgattcctatgtgctaaagttaggaggtttaaataaagatttgcactaaaattgcttagcacagagtctggcccagaataaataaatattcaaaaaatttagaagttgtcattatttctatcttgaagatatttatgccctgacttattttaaatgcctcaccagtagaactgggatgatttttcaccttcaagctgcacagtatgctcacaatggactggcggtcatttaatttatcaaaaggcaaactttggtgtgacatcatgatcttgacagacaaatgcctccctcccttatttcaagttggtttaatggtgttgctcctctgagcttctaagagacatcagtgagtctctctctgagtggttgcgtgtccctctttagatgaaaccctttataagcataactgtgccagtgtgtgagagaatttctggcccagagtgggcatagttcctgcagcctggtttcttataaattcactggaaacagagtttgtctgaagactgcataggaaatgaaagtaaacgcctgcacttagaaaactgcagttaaaccagactccatggaaataacacacaatacccagaagtctatgtagaattgtcccttgtgctggcagagggccttcgcccctgcaggctgggacagtggcaatggagcaaatggtgtgctggcccttcctttcacaaaggtgtggacactctaagtgccaaggctgtgggtggggtcccctgggcctgtgctgctctgattccctatcattgtagggttctcttttctccctgaagtgttctgactgtctttcttctctctaccccaaccccatttttttgttttgttttattttgattttctactgctctctgattggatcctccataggaacgctttggggtaaatatgttcgattatctttgaagtaaacgatacaaggaatgagttggaggagygagaaagtatggttgggaggggaggggctcacgcactgagaaaagagtggtcagtttttatttatatccaagggatcaaaattaggagtcaccaagccttcttgggaaatggtcattcttattggtttggatatgtattcggctcatatgttgcctcttttaggtatgtagacagatgagcctaatgcagtgaaatcgtttgtaaaacatgccaaagtctctggatgctaaagaccacatcagtgcaaggcttttggattatttatattcagatctgggattgaataaaagtgacttgtaggtcatggcctataatcattaagagagtcttaaaataaacattctgggcaaagtcagcattccttcaattcgattaaatatcttttggcctcgttttctgtgaaagaatggatggacttttatctccctgtcaggggggtggggtaggggggtaggtatcgcaggaaggtcagggggaaagcagccggaagccttgcagttcccacctgatgttctggaccccatttcctcagattgttggtgtaagagtaatctgggtcaacatgaagaaagagacagagcctgactccactatttagagtcttgttttccaccatttgtgtgttttataaatgacaactatttgaattgaatgcaaatatctcaggggatsaacagagaagaaagagaaatgcaaatgtatttgttcattttattcctaaaaataaaaagagaaacatactgtcactattaggagtaaacatttccaagaggctgactagggaggatcaatagctgtagggccaggataaaggtaggctgggcctgcagtttgggcctcctccagttgagtggctctctgcagcctgtgctaggtgcacaccatctgcaatggaagggactgcgggaacagccagccacacagaggtactggggtgtgagccaaggtcctagctagaagcctgcatgacatgctttctctggaacacgtggcccagtgagagtgtcatgtctgccaccctgcctcaccttgctgtctcctgaactaatgaactgtgcagcggtgacaaacccagattaagtctagtgccctgatgagacttgctctcaactgtgggttcatcaattcagcgaatatcatttgagaacctatcatttgacaagcactggattaggcacagtagggatctgaagtgggctactgctcacgttccctagttgatgtgtcttccgttttcattgtgccagtgtggtaatcagcagcattagactggtagttagggaaggaagtgtttattaacatatgtgcatggatgcctctgtgtgcctgtatgttcctctgtgtgtgtatatatgagtgtgtacgtgcatgtggatgtgtgttcatgcgtgcacactgggaagtgatttgagaatattcctgaagcatttttcgcaggatgtccctggagtcaaatctgactcagtttctggcttcttgcctccatctctcccatacrtctctccccttttagcctgttgttactaatgccatartttgaatgtcatttttatttctcccccattccatatgattccctgggggyctctcccctgcagaaccaacaaaggacgggacatcaagaccatcaagtctctgcgggtgctccgagttctaaggccactgaaaaccatcaagcgcttgcccaagctcaaggtagtgtttacagagtttgttcccatcaaatccccttctcccatcttctctctttagccatggctggcctgcctttggagaatttgttctgggaatattcctttttctcacacggatatcgaagttcttttcatctgcckgagctaaaggtcttagtttcaaaggaaaataaccaacatcccaagaaatctataagaaagctttttcttttaagttcagacccagatggtgtcttctctccggtgtgatatgtcatccmagagggaatcctgtgtggctttgtcctggggcctcctatgtctatgtccccagtgcagacccagaacaccagaatggaagcaacgggatccctctgtgtgttctggtctgcatattttttaaggccgagtatcctgggacattttctttttcttataactcaagaggagaagaggctcttctagccctacccttcataattttgaggcacagataggtcagtaacttgtccaaggacatgcagtccatttttggcagaggcagagaagaaatgggaagtgagctgacatgaattaagttcttcctattgccaggacctttaytaggtatcttacccagatttctccttgtctaatatgctccctcctcaactcccctggggttccaccttccacgagtctccctgcctctcaggaaagcttcctgcactctatcacacaattctgctagactgttgaacccacctgccccaccccgcatactttgctgttagtggaagctgaggctccatgggaggaaagttctttctctctgaattcctgtgaatgacagcaaggcactgccagggagaggaccagagctcctggtttccagccccaaagtctttctgctgctcaggccacatagccagtcaagccccatcttcaggggctacaccagaatacttcccagcaagcagactcaattccctaacttcagcatcacatggaatcatgcagtgcttctcaaggtgtgggtcataggccacctgcatcaggatcacctgggtacttcttaaaatccagattgctgacaaccgcaacacaacagagccagactccctgtgggaggggcttggagtgcgcctcctaaacgggcttcccaggtgactcttagaatatagtgtagtttgagaacccctgtcaatattaaaaagaacccacttgagtgcgaggctcagctctaggacttagaagctatatgacccagggcaaattacttattctttgactttctttcacatgggaaatgaggacacattgtaactcatacatctgtggtgtggagaaaatgaactgacgtgagtggtccctgttagaaaactcaacagttcctctggaatgcctgggcctgctctcccaagcctgccacrgaggacacagcttggggagggctcttgtgcacttggctctcccttgcttctcaattcccacttcctattgaattctcatcacctctgatactctttgcccacgcctaccccagacctccttcaggcctcatagcactgcttccctttcagccatttagctctgcagagaggaggcaaaactaactaggtttgtgaaacagaagaaaagtcacttctgagaggccccgatgtgactgaaacctggctacctttcagagcccagggccctggcccaccgcgtgggttcccagagagagacacccatgctcccaaggaagtggcctggccgactgctgtcctccctggctaccccgccttcccccctggaggaagcacttctcacaatgtcagctgtttcttaccaccttcctgcccataaatgctcattgggttctgcctcacacacagagcgtggccaggctgccttgggccctgacccttatcagtattgtcagtgatcctgcagggcaggattcagtgggcctcaaggagagtgcagacaagcttgatgagattcgttaataggccagagaaagcaccctgcaacctggcttaattctgttaaattagaaagggctagttcctcgctctgcagctccataacctgagagagacgtaggtggctctgatgattccacaagggwrycwrtcacttacattccctgcagtgttgaactaattaaaccagcagtgcttcacccagtgctgcaaagaagcaactgcacaaatgcagcaccaccgtggggctagattgtcctgtgagctaaacctaaaaacctagaaaataacctgaaaatgccctgcaatgtattgaattcccatgtaactcctcacagcttagggcctagagtggaggtctctggaggtctgttgccttttaactgaagtgtaagtccctagttctatctacccagcctcgccatctctaagagaaggtgtctattggtctttcccacattacttctattggtcttcatcccaaatgcagccaccttcactagagaacatttacatgaagtgctgaatataatcataaatgtatgaacttgcctatgaaatattagtgaaatgaacaaagatgatagtgtattattacctgatccttttagaaaggtaaggagaaaacaatacataatcagtatataaatcgaatctaagaacgtcaccaaataaagcacaagctatttaaagactaaaattggctaaatgatctcaaatattccttccagctatacacttctatgcttcacactaagtggagtacccgtaccaggatcacacagaggaccgcattccttgcttgatatcatctgatttctactgcgttgggtctacattcagtttcagaacatgtgttcccatcccaggtggtaggtccttgcagtcataaccagcttagaagccrgcccttaatctcatgagcaccacctcacctcttagcaggaaattctctcctgggacaacttcttggtggggctgggtagtggtggtatggcccagctcggctctaggcaagtatgcagaccatcacagggttcacacagcagggctgtttgctctgtccacaggccgtcttcgactgcgtagtgacctccttgaagaatgtcttcaacatactcattgtgtacaagctcttcatgttcatctttgctgtcatcgcagttcagctcttcaagggaaagttcttttattgcacggacagttccaaggacacagagaaggagtgcatgtaagtgccaccagcgcattccacttgattttgctgaagcatgtcctgatgatcccactccaccaccacaggtccaccctccctcctttctatcttacccatctctgctcttctttcagcaaaaagacaaaatggaatcaataaactttttactgagtgcctcttttgtgtcagacacgaaaacttgagtgtaaaatatctcgtaccatgacattttacactcgagttttcatttcaaacccctataaccagctattgaaataagttttatttgcttattatacaagtggaagctaagactcagaaagtttaagcaagttgctcaaggttacacagccagtagtgaaagggttaggatttactcctgtatctgttgggcaccaaatcccatttttgctccatggtaaaaataccttcctttaatagaattccttttgccttacacatgtatggtgatcattattacccccacattattgcggcctgtagaatgtgctgactcttctgtagaatgagctatagtgaggaggctctctttcatttctgctctggttttagaggcaactatgtagatcaygagaaaaacaagatggaggtgaagggccgggaatggaagcgccatgaattccactacgacaacattatctgggccctgctgaccctcttcaccgtctccacaggggaaggatggcctcagtgagtgattgagttgtcatgcttgtctgtggctgtgataggacccctggttgccttgagaagctgactcaagatgaacaaggctcacgctttgttattgtatcagggaaagtaaggggttttgagaaggtgacacaggcagaaaagaggaagaatgaaaattcttcaggcaaaaatagagaagtgggtgagcaaatcaggaaaatatttgaaactcttaatgttttagccaattattgaggagtcaagtggagccatctgacttctatggaacaaatgagttttgaacagccctgtacccataaggagaattcctgagagctgttatagacagatttatcctccaggggggcccagcacctgaaagcctgaggattgagggttaagaatgagttggcaaaacccaaaggcacctcctgtgatcatgaggaagaccacagaatgcaggtcttatgctgcccgtagttgaaagctaatttctcagagacttagcaatgactaagacaccactctctagtggcaacaggttctacttggcagcaaaatgttaaatgggaatctgggagtctctttgtattgaacatgacaacctaaactatgaaatggtgtccctctgttgcttaggagttgagtgcgtgatggaacagaggctagaaagagaagtggattgttgatagcaggatatgacaacttgggtttggactcaaaaaaaattaatggaggatctgcaaagtcaaagaagtcagataaaaaattataataggtggcacatttcctaacgaagccaagactgtcatccaccatctgtgccctcttgttctgtccccatagagttctgcagcactctgtagatgtgacagaggaagaccgaggcccaagccgcagcaaccgcatggagatgtctatcttttatgtrgtctactttgtggtcttccccttcttctttgtcaatatctttgtggctctcatcatcatcaccttccaggagcaaggggataagatgatggaggagtgcagcctggagaagaatgaggtaatgacaattgrtctaaagtggggagcagcagaggctccagaaaggattcttgggccagcaatgtaagaaaggaggactgcattttcttaacttgattaagaattatagagagaagatgggaaaagtaactattcagccattaaataarcattttccaagcactgtttaaggcccacgtatgaggcacggagatctggaagatatgtaagatgtttaacatgcagtctttacctttgtgtgcacatagtctagaaaacaatgataacttcagatatctgcttatctgactgtgaccttccatgccatgtacttgctgtaagggcagggaatgtgtcttatcgcagcttttccagcaacaagcatagttctggcacattgtaaggtttcaaaagctgtttttgaaatttctttattttattttattttttcgatggaactgaactagaaactgttagggactgtaagagaaatgcgacataaagtgctgtagaaatacataggtaggtagatctttacttctgactaaggacatcaaggaaggattcctgcctaaacagctcagccacatgctgtgtaaaggacttttttaataaccatgaagtccctactccatgtggcaacacctccagttttgtgtactcctttaaggtgacgccttgtctgtagttttgtccaagtgaccccagttgccatctttacttgcccagccctgccctttttcccattcaccgtcctcctcttctgagcatggaacagagcctgccwtggtagatctaggggatttgaatttgtgctaataaccatgactttcttgcagagggcgtgcatcgacttcgccatcagcgccaaacctctcacccgctacatgccgcagaacagacacaccttccagtaccgcgtgtggcactttgtggtgtctccgtcctttgagtacaccattatggccatgatcgccttgaatactgttgtgctgatgatgaaggtgagaggagagaggcacaagagccractgagccccagcgatggttccctcccagggcaagtgggaagacaccccaacatcccagcccatcactgctttacctacttttccatcattgaatccttttgtgatcttattttgttcaataacccaacctctggggctttgggggtccactgagcaaaatgcagtgcagactatagtagccatccaggggctcccaagacctgagatggcaatgggaggcagcttcagacaagggtggaaaaatcaggagacagagatccatcatcacggggtctaaaggagccttggagtattcagagaggctcatcctatttaataytaaatgactaactccagtaactaactctagaaaatgtttcttccctgcccaccctcatctctaggaagactggctgttttgctattaagtctggtggggcgtgggtctgtgttttcctttgttttgttgggtagaatatgtggttctcctctccagcactcgaagtccatctctcctcctgtaccacacaccagagtgtcccacagggcaggaatgagagatggccaacctcagtgacatgtattccccctcttaccttaaggctgtgattctttctctcttcttttttcttcctggcagtattattctgctccctgtacctatgagctggccctgaagtacctgaatatcgccttcaccatggtgttttccctggaatgtgtcctgaaggtcatcgcttttggctttttggtatgttgctgmatccttcccagcactgggcttgtctctttctgttgggtgccttcccagtctttgttgaaggggaggtggttactgctattccagaaatcacccacctagatgtgggctcgttttgactgctcagtaaactgccgtagagacaagatgatgtgtgaggaagctgggagaaagggcaaaggaagccacagccatcagcctggtcctgtgaaattctgtcagcagtccagaggcggccatcattgagtttcactagaactgcaatttatgtgtagatgaaggaggaagccaaagattggactaataaacttcgagtgcttatttactggtaaaaggtataacagttttataacacaaatgggaaaataactatctctcttagcctcaaacatagcaaataatagatttttacctattagtccttctgccattagtaacatgaagagtaatttctgccaaagaaaataggtgtttattacttatgcctataaaggctaatgacctttaaggggtgtgtctgtgtgtgtgtgtgtgtgtgtgtgtgtgtgtatggagtgcaaggggaaggattctggaattaagtttgaggaggtttggggatgatgaatttttctgccatgagccctcttttttcttctcctcaactactattaataattataattgttgggcaaattcttgcatctgtcctcaagagtgttaagaaaatccagcccttggcttcagtgccctataaacaagataatccccttggccaccctccccccaacctgcttcattgtgtgcagcaagttcagtgggatgcaagcccatgtgacagctgtttcacacttacttaggacgtgagctaccatttcaaattacatgtgtgtatggctttccctgcaaggaggagaactttgctcattatctgaataagtgtttgtctggtagcagctttaacagagactctgggctgggttcgataattgtgagtgttgattacrggggctgcttttggtctcccagcggttctttgaaaaaccattaatttgatcattttgggtggagagtttaagggaaccamttgcagttggctgcattgtgtttgcctggctcccttttgagtgttttgagacttggggaaataaaaaagtaaaagaaactactaccaacaaagatgcctttataatacagtctagccctgagcagggggagctgagagagagggagacgcaagcaccacaacagggaaattttttctatgcatgttgattacttgtatgtggtattgacattgtctgtgacttaagtcccattatgtgtctaattatggtgagtgctgaatatatactcacagccttaactagattcggcccttgaagcctgcctccttcccaccctacccccatgttttcattcaaggtctagagggattttcactctgtaaaaggtaccactaattctgataagtctttacattgttaaggcactctaagctttcagaatattgtaatatatactatttcgttagatcttctcagtgactctgaaataggcatggcagatgtcactatcataattgccattattgttgttgttattttaaatgaggaaattgaagttcagaaaaattgtatagcttcttaaagattacacaatgaaaggcaatagaattgcaaggctaaatgggaataaaaagggaagggaaaaagaaaaagagggaaagatgtaacaacaattggttggctattaagtaccaaatgctttacatattgcttttctctccataacaatatattaaataagcattcttattttctcctttttatggatgagctggagctcagaaaggttgaatactttggccaagattagtaagaggtagggccaggattcagaccctgttctatctgacttcaaagctcacaataatctagtctacactgcactgtactattctataccatataccagtgttctagtctataccacagcatgctattctgtattgtaaagcattgttaactggaatccagagcttctggtcctctgagacctagatccatgcaccaaggtttagaaagaattaaaaccaagaattaggaagttcaccccaggttggacaataggagagccctgagaattgaggaattcggagacttaatttagctccaccactgatagactaaatattctaatggaaagtgaatttatgaaactgtgtgattcartctgtccatatgccccataggtacatgtggctttgtaataaggcctctttcagcctcattttctcatacataaaatgaggataatagtagctaccttatggccttagctactttgttgtatgtatccaattaagtgatgttcataaccttctgagtgggtgttcattaaatgtaacttctctctctccacattccttttctttctttattgggtattttcccccaactcctcttgccaactcttccattcaggactttatgaacatgggatatttttcaatccctgcctctaggatccatgagaagaataaatgagttgaaagaatgccaaaggcctggcctagtgtctggctcatgtagraattcaatgatgctagttgtgaggctgggttggagtatacttctgcagtgctctgagagtctcttgtgttttattccaaggatagaataaaataatccattgtcctgtgatgttgctgaggatatcaattacaggtgtttgaaattttctcctcctggtactttctctgtctcctctgaatttctttattctgttgatttaaatctctgttttctgtgttacagactgccctttaaatgtcccaggggcaggcaagtgaattgtttttgagattcaagtgtcctttttgtttgtttttaaaggaacatagtctaaggtctgtgttcatctgagcctaggagatggatgcatagtccaccctctcctgttaaatggagtgttatctggttggtggattttccaggctctttatatctccttcagcccactcattgtattactgcttccttgtacttagttacatctcctcaaaagatgtaacagcagagaaagagtggaaagatgaagtctatttatcctattaccaatcagtagttggtttgaaaaggctcaayggagttaggaggagatttttggcacatctgtaaccttcagtcacttatgacttgtgtgacttttgttgatagttgaaagtcagactgtattttatagggcacttgacgcaatagagataatttaaaagttatagctgtatgaccatggcaatggtttcacaggtacaaacgtttccccaaacccatcaagatatagccattaaatatggatagctttttatttgtcaatcatgcctccatagaggtttttaaatacataaatatttgttaaaaataaaaattgaaaaaaactttttttacatatgagcttttggtgacagttttcaaagataaagtcttcaaatagtgatagaactgctttccaaatgagaaatttccagattagtaaaggagaaatggcatctctggttagaaatgggaaactgaagccaaagtaagagtgaacttatgcattaattgacaagttttatttccaagggacaaacaaagttatataatgaaagatgtcttttctccttttttttttctttccttttctgatgttcctatgactgaattcatttggcagaactatttccgagacacctggaatatctttgacttcatcaccgtgattggcagtatcacagaaattatcctgacagacagcaaggtgaatggcttataagatccatgtctgtaagcttggccctggagtagcatttttaaaactcctctgtatattcagtccatttttaacccaccaaagcaaatgcgtacccctctaagtgttgggaatttactcccttgctgcttggcatcagccagggaatgcaaacttgggagtggcactggatctccaggaaggctttgttgatttgcctgactcaggcagcagacctctaatggggtaggtgggatagacggtgtcagaagagagctagtatgcatagcgttgcactagagtctcaaaggaggcacagtatctttgccctcaaagttcacagacctgtattttttccataaacttgttccttctaaagatgacttggagagctcagggtaactctctttgaatattagagggccagcgtgtgctagaggggttcctagatctgctctttttggcatttaagtgcagacttcaggccactcagtagaagactagggaggctggttttgtgtgcagggtacccttctccagtacatcctttacccttctacctggggatagagagcaggcatgggaaggcttaggagatgggcctcactggccagcccatcagctggaattggggttaacaaagacagagactgtgtcccatttatcggaatgagggataaatacacaaatactagtgcttagatttttctaaatcaccataatgttcctaattatatgtttccttttggtccaccagctggtgaacaccagtggcttcaatatgagctttctgaagctcttccgagctgcccgcctcataaagctcctgcgtcagggctataccatacgcattttgctgtggacctttgtgcagtcctttaaggtaagaggtaccagcaaatcctctctgrgggttgtcatatcagacagtacagccaggcaacactggcatcattacccaagtcccttcacctctgggaagctgaagctagtagaacgggtgtttgttagaagcattcagtaaatactgcaattcttagttacagcacagcttggcttgactgggatcagcttatgtctactggatagaatcttattttagaaaaacaccttgactttgtgactcaggcatcctctctgtctgctgaggcrggggacacattttataagatgtgcttcatccatagagattccagacagtcctgagtaaccccatccatgtaaagagccagccatctgtagtcagatgtcctctgcattttcagggactttgggtgtttgtttttatttcacatgaaagtttttcaaaggactcattgagttgtgtttcatagagagatgattcatacttagccccacctttgtcttcatcagtgtttatttcctgagccactgaacacagggtatactaatggccacctctgtgtcctacaaataaatagggacatctgggcaggttaatatgatgtgtttccyctgcacagtctcgtggagctgtacagaggtgtacataygataaatataagtaaaaaattgacagctgagacccagactttgagtaaaagtttcttaaacatactgaaatatctttggactctagcaaatatcataaattagttgtttttaagctttggggggcctaaatgttgttcaaatgcctgttcttaccaaaatgagtttttcagtgaatgtgtttaaaaataaatttgatggaattaagtgattcaaagatgagaaattatgaattcaccaaattgactttcttattttaattatttatagtttaattaaaaattaagctaaagaaggcaagccagtgaattcatggtttctcatcacttggaaaaggatttctccccacatccatcattactgatttacttcttcatcgaggacctgggattttgagatgtgagatcaattttaaggatgttctggctcctaggagcgacsttgacactttttatcatatccagagaaagtgtttggcgtaatgactcccacgaggcctcacttcaatgaaaactatttttctaaagttagatatggaggatamatctaaaaccttagtgagaattttctgagtctcaggtgattttggatttagaattggaaacacaacatgcttttaaaaccttttttttttagaggattgcccaacaaacttcagtggttagtcttttaagaaatatgtgtcatcctgtcatattatcacaatcaccaagtctctgagaaaccatacactattgagggcaaagaaaatattgtcaaaaawtgatggccaaatggttggcttattccagcaaatactacagagaacagggaagacaggtgaatttgcctccaggtgacactgtgttatagatagatgttcccttttcagaacagttctgtgacacagtatagaagtttgatttttaaaagtcagattaacaaagactacctctgcaaatagaaagcagagagccacacgatataaagagcatcgccattgcctatacctcccccaccctccctaaacagcatccagttttctacctctgacccctactctagagttcttccctcttttcccttattttgtgttagaatgtataaacatgacaagaaaggaaaacagaatgaatctttgcttttctccctacattgggagtagggagagataaactagggactagagtggagacagtagaataagggcagaaggtaaagatgaaaggtagcagcactgcaggcacaagaaaccctgtccttccttctggctttctgtagaggaggtccacattgcccatcaaagtgtagtcaacccccatcayagagcctaggaatcaacacttcattggagagggaattctcccacccactttcagttgcattttaattttagcctctcttcaagttgtaaatagtctcatagggctcttcattttgttagtgctgttgaaaagctctgccctgctcatgcagtctgaaagcctcaattgatctcctgggattcatgatgtgcacaatcaagacagggtggagactcctcgtagcactgtctgccagggagcttagtggatggtaaagaagagggacttctctggcagcgctgagatcaacgcaaaattacagtgtcccactctggccccaaatccaaactgtcctatgtctgcatcytcctccagtaccaaggccagwtcsctgcctcatatctccttgccttgaccctcacctctaaaactgaaatgttatcccaaagtggcrataagcatgcrcagtatggaattttgtgccacatggcttcatggcagagttttttggtggctaacttaccaggcttttgcatgaaacataataaaacrccaggaggcttaaatactgggaaatgacatttcatcagaaaatgaatgacctttctaggaacttacaaacaagtgagaccccaatcatttcactttgattccagattcttcattatgggtgccactttgggtatgggagtgggagggggtaatacagggatttggaagccaaagctaggtgcttcatatttaatttgcatcacaattgctaggttattaattttctgcatggcaagtgggatgaaccccaagcccaggaagttttcccagctttccttctagatatgggctacatttatgggtgagtgaatctccctgatagaggtaaattttaagcctccctttggccaactgtttacctatctgtcagaggacaaggatgcctgagaaagtactacacctcaaaacagaacaaccccagggaatagggagtcccagtctgtgtttgcattagcctccaggcaagatcctgtactgccggtgactgcaggttgttgagcttgggtgctgcttttctttgattaacgtcttatctctgctttccttccaggccctcccttatgtctgccttttaattgccatgcttttcttcatttatgccatcattgggatgcaggtgagctggtaaatcaagggcccggtgggggacagctgttacccagataatctctggcttagcaacctaagcatgcaagacctgaagatgctttgaaccccttcttgcctaagggtgctcccctgaggtcttgtcacagtgtgaccttgggaatttcacatgtgcagtggctccccattttagcttgcctaagtattcagggtagtctggtacaggggcttcatctcaggttgtcagatcatggtgctaattcataagcagctgggcttctgtggtgacagccatagaactaaagcaaagatgacaccattgttcttagccagaaagatcccccaggagactaaggatctatttctcaggatctctggtattttgacttggcctaaaagaaggtcagatgttagttcttcctgtatatggtgacaccaaatcaccacatatrgtcatggctgtcttatagagtcttatacttacacagtcttgactggctgagatttatgccctaagatacatcactgtgaacaactcatggagttcctggcagcccgttcattcctagggagactcaagggccacattccagctaattaggccatgcaacttcctggacagttcccttgttttcccatcccaggtatttatgcaggtagccagaggcctactaagcagaagaagccaaaggatctttcaaagatgatggtggttcttggtgggtgaattcctactgtaaataaccagcagcacatcccatgaacctatctggttggagacacaggctttctgcttgtctccagagggctaactttctgacttggagatattgtgactagatcccagcatagaacttcggctatgtgacagcctcctgcagtcaggcagtctggctgccttgggcctgcyggctgccttcccaactgtgttgccacctggagctgctgctggagtgtcccagccttgctgtgtctgcagccttttccagaccctttctgaaatgtctcttcctttcactcttctctcttgcctgtacttcttggtttcattctttaactctattactggagaattttgttctctaaaaatacaatagaatgtcaagtgtcaaaatgtgtgagacttggttgagaagtagtgggttctccttcactgaggatatttcagtaggaatttaatgatcatgttggcagtgttggaaatagaattcctgctgaagtttcatattggctttgtaacgttcatgaagtcctgtctaactccaatatatttgattctggaattaaaatattcttgaagagccaaatgaaagcttgatttaaattattttttcaaaattgattttttattgatgtataattgtagatatttttggggtacatgtgataatttgatgctcgtatacaatgtgtaatgatcaaatcagggtaattggtttatccatcacctcaaacatttatatcttatttatgttggaaacattataattcttctcatctggttatcatgaagttccttttgcctatgctcaaaatagttcttaccccttttcatcttcaaataaaataaactagaataacaccatctccagtactgatctggtatgaatattgttgattctgataatggtgataatgctgtttatcattatttaaattccttggtgtacaagacgctgtactaaatgtatgcatagagagagagtgaggggggagaaagggagggagtgaaaggaagagagagtgagcatgtccaggcaagacatatgactaatgtttctgagtaatgtgaaaacgtttataggtgagtttcattgtctccattgatgcttagcatagttaagtaacttataacatgctcaagttctcagacagtaagtgaaagaggtgagttgtaagatcagctctgtctgctccctagcccatgttcataactctatactgtgtctcatcccaccagacaagcagacacaagtatttatttttaccctctagttggaggtagaagttgttcaattatgaaattgtagtcttcacaataactgtatggtctaacatcttattcccctcagatttctttccaaaggataatagcaccatgtccattccacagagacatgaatgacatttctgctatgacttgctttgagctggccatccccatcctggtctatgacagagacacagcaccaagcacaaagcagacacctgagcttgttgctagagagactgtttctaatatagtcacaacaaaactgagggatctgtacaaataataaacgcaagggcagagacaagcttttggaaaaatattaatagcaacaaggtatgtytatgagaaaaaccattattattccaaactttcaaaggcgccttggaaaaagggacctttgcagaagaatcggaagttcgaaaggaggagtaacttgctggggatgagaaagagccctgtggctacgtggtgtcaggaagtgggattgtcagcctcagctccttcactgaacaactgtgtgaacttggtgaagtcactgtatctctcttcaccttaactccctcaccagtacagtggaggtgttggttagagaccttcacaagtctcttctagttctaaagttctgtaatcccaactgaaatggatttaaatctatactctcatgagatttttctatgaggcctcagcatcccttctttctcttccataccctgttgatggaggtttaagttagtgacaaggactaagtgaaaagttgaaaaaaaaaaaaagtacaaaaaatttaagaacatcttcacaataaatatgtgtttttgacttaaattatgtttgttttgttctgctttttggttttttttttttgtaaagatgaggtctcactgtgttgcccaggcttgtcttgaactcctgggctcaagcagtcctctcacctcagccccacaaagtgctgggattacaggtgtgagccaccatgcccsgcttgacttgacttaaattatcttagattcaaaataaatagttttggtttcttggactattacacacatactttgtgcaaaatcgcagtgtgctctgcagttagtttgtgattggatgaggtgtttgagaaaatcataatgaattcaactcatgatacctccagaagtgtcatagggaaaaaagacactgtaagttgtatgtctgtggtgaatcagggataaatcatgaattccaaaccaagagggaagaagagggcaggaaatgtgaacagggcaaggataaatgtcagtgccctcctggggtatccagagttaattagatttgactgcttgggtgggattttttaaatgctactatttgtctctttggggccctctagctkcttcttctctttccattcttctctgctgctgcctcacttgccacctccattctccctgagagacaagtagtatttgggttttgaaaaacagcattgagaacaaattcccagagcaggtgtcagtgggagttacttgagcaaaatagctgggggcagagattgttcctcaattgcacattctaaaaactgtgagggggaaaatgtgttccatttagcatacattggataaactgaagcatgttcaatgcaggctgaaaattgtctcaaatgactggaaaagtaacccagtaagtccgcgattgtctcaacattgacttgtgagaataggtcctgatacccaaaatgtggttggggaaggagggtgcatgtgaaagcctccttttcatctgaagagtggaggggttgaccttggmtccaggcagtgctgtgtctgggagttcatcattactcagtctctgtggataaagatctctgagtgttccctcttttgaatgttcacagtgattacattctaagctcagtagccagcagcagatcagcaaatctcattctgtcacccagaatctgcccaaagccattttctgttttccttttcaaagtgcccagttggcccgactttctccatcctattggcctggacttcattttagctcctgcataaatgtttccttttggatgggatttgggtctgttggatgatacatgtggayatatataaatatatgcatgtggatatatgtgtgttcaatctcatagattctacattaatgacatacagaccttctaagatgtgactcaatggatagaaacatatctaaggaagatagagatgccactctctaacctgatctgcttgtaaattgcagggtggcatctgcccaagccataaatgatgtcttcttgcaaatctgaatgctcccatcatgactacctgagacaggaagagaggggtagctccttctgtgcactcctgctgtgagataatgtctttgacagacgcttgagtaccatggtgacaggtaccatggaactaaaagaccagattaggtgtaggaggaactatgtacaggcagaatgacttcaaaagagcttgcgttctacgttatgctyggaccttgctgcatgggtcccctttgctgcactagagcagtggaggataattattcttgcatatcagcccaaaagcacagtatccagcagctctctgggtctgagttgtctgcttcaggggtaggtcatcgggaagagccatgcaagtggctttgccaaccctcatgtgctggacacatcacacagcttggtaatgctcactgttttctgttgtttctctcctcaaggtatttggaaacataaaattagacgaggagagtcacatcaaccggcacaacaacttccggagtttctttgggtccctaatgctactcttcaggtacctggatgcgtaactgtcatagctggggttctcctgatggagggagagagagtttgtctgcctcttcctcccatttccctttgtatctttattccacttcctttgctcctgtcagtagaaaggggaacaggcawtgtctttgccaaactgcccctataacattagacagttttgtcttgtctacagccataccaccatgaatgtgcctgatcttgtctgrtcttggaagctaagcagggttgggtctgctaaatacttgggtgggagaaaatttcatcaatgtctttggctcagcagttaatttgcaaattttaacttcaacatggcctgcaagggtttgggaggggggaatgtcaggacagtgtttgcagaccaaattccacttaagggctgaaaccttrgatagccaggtttatgctgggtcttagagaatcccatgactagtagcagagaccccataaaagatggagacgcagtggatggggtagcagaacccaaaacagacctcagtgggactctttatctctgcatggaaagcactagaaggggtcaactgggtaaaaagagagcctgttgggcccagacaagagcgaggatggggaaattgggaaagaggaccaagaatatgataggatctgcagagctgctcctgctaaccaaaatgtctcttgggctcaggagtgccacaggtgaggcctggcaggagattatgctgtcatgccttggggagaagggctgtgagcctgacaccaccgcaccatcagggcagaacgagaaygaacgctgcggcaccgatctggcctacgtgtactttgtctccttcatcttcttctgctccttcttggtgagcaacattgtgcttttgccttgctatgtggcccatcccatcctacccctaaccctctgatacatagaccggagatgtttgcttcagtgtatgtttgtgcctccctcccctcctctctccacacccccaccatgcacacactcacactcacgtccacacccaggttaagaactagatcatcctctggagaactcttggagattagagtgcctgtcagactcctggatgggtgactttcaatgattgagaaaagtctttgttggttctagggaaagattgttgtgaaaagggaaggtgagcatatttaagtgcattgagcttcatatcraatctatggacactcagagtaatcctttgtcatacctcaggtattttatcttataagtacgtctatggatatcttcgctttgggagatttttgaactgcttgagaaaaggtamcttgaaaatgcaaggttatggcattgataagagtagaatgatgataatggaataaatgtggttctctcttgacttgtaatgttattacatttgatgataattgaccagctgatagatgagaaagaatgagattgcttgattgctttgggtgttagtaaatattgagtagtatatgtggagcatacccacctataaagtggtgggaagccctacgtgcctctgaagtctcttttggagaaagcatgactcagcacacccacttccagaaacttctaccctgcatatcagacaagcagtgataaatagaataataaaagggccagtttagtgtttctggtcactctgaaattcctcagctcaactacactgctaatgccactggctgtacaaaaacctaaaactaagacagtgatgccactgaaaagtggtcaatttcatggccatgcatcaaaaagtgaattaattgtcttatgtccaggcattgctaccttgcaagtgatcccaaggggactgaaacttcccacatgtccagctctccagtgaggggggtgggctacagaaagaccattaagtgttgcctgtaggtcagtgtggcagggagggagctaatgggagatgtgggcagcccacgcagtagtcttggctttgttcctctgctagcctgggccaagacactttcccttttatagcatctataaaatgggagaaaaaaatgacttaataataggaacattttatacacaatgaactgatccatgtgttttaatacacttccttcttatgtatgtgaaaggtttttcagtaaaaagaaaagaatatacaacagtatcttatttacaaatatggaagtataatgtataaagaaaaaaccccctgaaatttagaataatgctattgatgggagttttccatttattcacatcttcagcacatttttattgagtggccattgtgakgttcactctcagcaaggcccatccctcagtcaccagtagtcaaggggtgaaaccagctcacagcttccaggaatcggtgctcactgctagggtgaaatggagcagatagaagcgcatgtggacatcttacttttatcttatatggtttaagtgtttcataataaatatttaaaagaaaccaaagatataactggaaattaattagggaccttaaaggtacttttggaattttgagacagagggtgctgcataattcacattactgttatttttaatgaggctatattcagcacgagatgatctgctttcagatctatatgagactgactgtgaccttggacaagtcacacagcttctcaactcaaaccagccactctacagagatttactgatgcctctacgatgtgcccgaggccttgtgctggaagctaagaacaaaaaatgtgaatccaaagcaattctgtccttgaagggtgatggtaattaaacctgcctcacaaagagttggagcaagcgtaacaacaagtaataggtgtgactgcacacgctacactcttaatgactgttcaaatgaaaggcagtaacagtgctaacagttttcattgacattaataataggtaccccgaaaagtatacaaaagaaatgtctggatacatggaaaaccctttctgtctcttgtaagtgaaagggtcctgcctgataggtagtagttgaacaagttcactgtggctccaacctcagaggcagaaagacaggcccatgttgggattaggttcgcctgcatgagacagaaatctccagataacagtggcttaaccaggagggatgctgatttcccttccacatcagtgaagtctggaggaaggcaggcagtctgtttatggtggctccaaaggggtgttggggccccagacctactcctgctttctgctccatcacctctgtggtgtgtccctcatcctcatggaagagaagacacctagacctccagccatccatctctactctaggcagcaggagaaaagaaggaagagaagagtctggctgttaggtatgaccagcagtctctgtgttgtagaaagactccaaccatgtccttcctccacactgtctccttatcctgtacaccctgtctgcatatctggcacctctgtgcacctggccacttggcctgggggtccacaatagagactccagttttcccaccagttgttatctatcaggcaggaccctttcacttacaagagacagaaagcccagctaaatctgcttcagtaaagtgggattttataggctcctgtaaatgaggagtcctggggcagagcaggcttgatatggggctcagatgatatcaccaggtccaggtttctctctatttacagatctctgcctccaccttgctccatccttgtgagtgcaaatatcaacatctcaagatggctgtagtggcagctctagaccgcacattttcacacatttaagagcaacaggaagaactattttgcccagaagattcaataccattttattggttttgatgggatcaccaaccactgtgcccagggaaatggggtttaatgactagttgaggcctgggtcacaggagggcatcccactgaatctcactaacttggaacagccaagaacctgggccagaaatacagtgaatgggtgagcagggcagccaggaaacaaggaaacagtgctgttgaacatcaagtcctgtcgattccacctttgttaactctctactctggtctgtgctgtcgtcctgcccctggtagattcaggagtactgcaacatcctcccttgrtttcccacccaccctacatgctgctaccaagagttctttctgaatgcaaatgtcactttatctctctcctctctaaacccctttagtagttcctgttgcttacagaacaatctagatcagtggttggcaaactatagcccttgggacaaatcaggtttaccacctgtttttgtatagcccatgaaataatggcttctatgttcttaaatggttgaggaaagaaaacaaaagatgaatgatgtttcatgacgtggaattacatggaattcaaatttcagcgtccataaacaaagcttaaccagaaccatcgtgttcatttgtatacaaatggtctgtctggtgctacaacagcaaaactgaatagttacagcagagaccacacagcctgcagagcctaaaatatttgctatctgaccagttcaccgatcctggtctacactctttagctcagtgtatgagatgcttctgtgatccggcacttggatccagctgctccgccctccttgcagatccctgactattccctgtccctgcatacctctgttctggctcgtttgctaaaacaccctcctccatgccctgaagcctgttcttctgcttcctgagctctgctttaggtttcccctaacccctcttcttccccttgcccttcagatgctcaacctgtttgtggccgtcatcatggacaactttgagtacctgactcgggactcctccatcctggggcctcaccacttggacgagtttgtccgcgtctgggcagaatatgaccgagcagcatggtgcgtaggcccctcggccgccccagcggggcccagagcaaaggtctctggagttcccagggaagaggctggaattggagccacccaaatgcctgcctgttacagaaggaaaggagattcctcttgattgtggcccatagaagaggctctggtatcaagccagtcaccaaggacttctgtatcctcctttcccctctctttccttctgtgacaggrttttccctttgtgggctggtctcatcatccagtcctcacctcagattatttgggctcagtcccaagagaactttccaataatctttttctgccaatggttagtggactcctttgagttatcagggggtttgacaagggtttttggccagctggacatctggccaccatgatcagtgactgtgttttctctttctcgttcctctcaacagatacagttggatataactctgaaattattttttaaaaaccaaacaagttgttcttccaactgttcccttaaatatttgtggatttttattacatggaactaaattaaatggtaggaattggtgaagataacttctttactgtctcttttgctgtttagtagttctgaagtgatagcgtgccttctaggctctagagcagggattggcaaactacatcccatgggcaaaattcagcccattgtctgtttttgcaaataaagttttattgaaagacagctcaaccattcgtttacgtattgtctctggctgcttacatactacaaggaagaggtgagtgattgtgacagagatggtatggtcctcaaatttgaaagtatttactacagaaatattaggttggagcaaaagtaattgtgggccatttttgcaacaacctatatattttactgtcaaaaaatttactgccagaaacatttgctaatccctgctttggagtataaaggcagcattttggccctcatggctgaggacaaggtgagagttctatgaatgcttactccaaaggaactgttctgttccaggtcattttagcttttgggtcttaactcaccaatcctctatccattctggtccccctctgaaaaatactacaagaaatgttatcctttacaggcatggaccaagttgcttccacctggaacccccttcataatcagagacttttcccaaaaatctatcctctggtgaggctgttgaacttgggtcactgttttacagactagaagggtgaatcagaattctttccttcattaattattaatgacttagggtacagagttatctaaatccattcctattacaatggctgagcaacagctttttctttctggtcttactttctaataaatagatcttagaaagcaatgggcagtgtgttagaggagaaggcagccaggcctgcgtgtcttcagctccatggccttggacaagtcacgtaaccactctgggcttctttacctgtaaaatggtgatcgtgatacctacataacttgcaaggtgtttgtgaggatgatattaaatcatgtgtaactgttattataatcaacaataaccacacgggaatgctaattggaatgtctagaaaatcagcctctgttaccatggatatctatgggattgggagcctaagaagggacctcttcactcacccaagaggagaaaccaactgtgagcaaaaaagtccattgttcatctgggctcactcaggtatccttggcttccagaaaccccagcttcttgtggtttcacttatcttgggatccaaatgctgtgtgtataaaacatgctcctccctacttattccagttgctgggaagaaatgattccatgaggatgaatcatgagactcagacgtgtggactgggaaagagcataaagacaaagaagaatttcttctgtgtgctttgtaattcacagtgtaattcattctagttagttagagtttggttggctttctttataaggtgggtgaggaagactaacaaaagtaatgtgagccartgtcttcaaaaggggggctgaaaccagttgcaaaaaatgtcagtctatagccactcccaacccacctacttcccaatctcactaaggcaaaatgaaaggacaactggctaaattacctcctctcaagagttgagagacttggaggtactgatgagctgctatctggaagaataggaggaatcaaccctcaaatttcaaaaagcctagaaagagtaaagctgggctgaagcaatagtctccagacagttgcaagcaaggactgaatgcacagaggtggagatgttgtgcttataatttccagcggaaaccctggtctgttccagggtgtatacagacctgcagatccctgggtgttgcttctttttctggacgctgacagagaagatgctgtagccactgaaaattaatcaatcattaattctatcccttccataggaagctggtactctctaatgggctcctgggaaaagggttggtaagatagctagaattctggctggctccagccaagctgctgttggctgagtggcagaaagagggctgcggggagagtgtccatggcttcctccctggctgctctctgaacacagacctcagcaggctcctactgagtaaagaagacttgcccaagctgaacgcagaaaaatctgtcacaaagagaaacaaagccctttgtgatttccctcatgccaactgtgctccttgctaattagcctaatgggaaatttgtctcttccagactgcagaaagccgctgacttcccactgcccctgaaaagtgggtctgagtaactgactgtaatcagtgtctgtgaaaagcaaacagttctgcagtccacttcaaggcagcctgacatctgctctggacagcggtctgagtcatttgtgaattggcaggctttgttcctagaagcctagctagagccagggctgtgtctgcatctggccaggtatggtccagataggtataatggggtgctcttggtcattaggcagttccctttggcattgaccaggctctgatttccttagaaaattgcagcagtgcagtttggcaaggtaatggttctctggtgcttactgttttcagtctctcctggtctggctttgccaggcccaaggaaagaagctgctctgacctctttcagccatcctcttcatggctaagctgtcatttcttttctacccttctctgagtgtcctattaacccacctgtgcttcctttacagcggcaggatcccgtataaggatatgtacaaattagtgcgggtgatctcgcctcctctgggcctgggagagaactgcccctacagggtggcttgcaaggtttgcctcccagtccccagccatgatctgccgtgggatgcaacatctaacccctcctctctgtcctctgctccaccaccactgcgccacatgagggaaccttcatgttgctttcctttgagtttaaagaggtccaaacccttccagaaccagcagctgttacataaagataagggcatacttggggaaaaggcagaagagttaagaacttcatgtgaagaccagtgtgatcgctctcttcacatgcacacactcatgtatgtgtgtatatgcacatgtacacacacacacacacacacacacacacacacaggtccmccttagtctgtatagttaatcagagggacctctcctttctctatagaatgcagaaatatttttaacccagcaaaagaattctggcttcttttcactggagatggagaagcctcattttagcaaaagagcctcatcgtcccatatgtaatgtatggagtatgatcctagtgatccyaccctcccagctcctggatggtctggtcagaatgactatgaaagctataggacagaaggggtgagaaacaaggaattagggcaagaggtgagagtaggtaaaagaggcatggatttggtgctgtgtggaagaaggtagtaatagctcagagagtctgggaagatcacagtgaatgaagcactactgagagagtccctaccttagggtcctgccatgggttgctgtgagggatctgagggagctgtcataatttccaagtcacttcttgtcagttacaccaaggatattgttcaggggtgagtaggacctccctgctcaaatctgccatacccagggaattctctatatcccaatggctctactaagcccctatgtgaggccaagcctgctaggtaaggaaccctctcctggtgcaagtggagggaagcatgggctccctggggcatagcactgcccaggcagctggaagaygacctargctcaggaaggatgccagcctggacaatgggatagagctggcctgggatggtgacacggtgattccatactcaggaggctggacagctgcctctgctgagactctttaaactccaccctggtgaaacccgcagccgcatgtgggagagctggggagggtagcatggcatgcaagatgctcttcctcctcctgtttttgtttcttctgtccccagcatgccattgacctggcacatgctggggaataaagagcagtcttgtccacagagccaggtggaagcaacggggccaactctttgagcagcaagcacagcccaccaccttcagtgcaagacgccgcctcctgctgcacacacacaccagaggggggatacacgacgttctgcctgtgggttcagtggagaacagcctgacttccaggccagcgccccagccggggtcagaaactccaacccatggctggagcaccgtctatccggtttataccactcacacacagccctgggaattgaaaataagctgtgttgtattggggagggatgaagtgaacagggaagtcaggggaatgctaatcgaggagaaaatgagaccccgtgactgttcccatggagagtcatagggactgaaggttgccaccagttttcccgggtctgtgtggggcgtgatataaaccgcaccaggatggagtcatgtctacgatttgccttgattaacaggtttcctattcttttcccgtttgtccattttgttttgtttttcttctcctgttttctgtattttgttygtttttgctctctgggaatgcctattctcctctcctatctktctgcatccttctccccacttccttctcctttccctgccaccccactgccccgctaacccaccccatcccaactcaccaccctccatgagcagtggccgcatccattacactgagatgtatgaaatgctgactctcatgtcacctccgctaggcctcggcaagagatgtccctccaaagtggcatataaggtagaccaccccttcctttgctctgggctacagaccaacaggaaatgggatctagttgtggggaggccagaacatggggaggaagccaggctggggaggtggaggagggaactaaggaggaaaggcacgatgagactgaagagtcaggaaggttcccaggaggacgaactcatgagacaatacaaggaatggtttttaatactgttcaacatggttttttatgtgatattttgtgtttctacaactgtgtggcttcttgtgagtgagttaccygacaagcagtgttaagtggtgtgtttccttttagaggaggcagagtggtggcctgtgggatggcatatatgggcaagaaggaagcctacagcaaaacagctatcagtgctcatatgcaaagaaatatcttcaatcagataaggaaatcatgcagaaattcctttaaacrtggaattgttaggagaaaggaaaattcctttaaacaagaaatttttaggagagagraaaactcataacaaatgttttcacccatgacataggaagaatggcataggttccttctaggtgtaagaagaaaagaggaacctgtcttccatcctgtgatagactgaggaatgcagctctattccactagcccagctacccaattctcttggaaatactcaaaaggaagggaaataatgggcacaagttgtattcagcattaaatttgacttactggcataacatagttatggggcctggccccagagttatgggtggattcccctatggcttgctgtttagagattattgtacactgggagtcacttgcccttggggtgctcatagcttttggacatgagttgttttgccacccattagtaatagttactgttagttcccctttgctatttagactgacccagaactctggagctctttcattcacctaggaacacatcatagtaatgtttccacttctctagatgtttaaagaagtgggagagagatggaactcaaatccaaacaagaaactggctttccactctaagacaccatgtggcatcagctttaggcaggatgctgcaatggaacattagagacccttctttgggaagaggtacttccctctctgccaggctggtggttctgccagaggacgttctcctgctgctacctcacattgtatggccccagatagcatctcactggaacatggccattagggaccctcattccccccagtacatggctcctcgtgcacagcttaggggctggcatcctttttgctcacgatggccacatccaaaagtaccaggtggtagaatgtggccttgaatttgtacctctgggatgaagcttggtgggagaaggggagcggggattggaggaaaagttaaagagctccaaaagcaaaatactctctggaaagtggatttggccatttcagtgtgatccctttctttgggtaaggggaacaaggcctgcccactctgctcctgcctgrgccacccttcctcgttctgtctcctccgctctccccatcctcctaccccagagcctgtttgcactctcccccttgtccatcctgctccacctcatcctttagacaagttggacttatgcatgttcaatcatgtgcgggcaaatttcatctattaaagactcaaaaagggggcaccaggatacatctttcaagttagataagcaaagcaaaatctcatttctcactgtatttccatatgagtttcagggggtattcatgggacaagtggaaatatggagcagccttgaacaggaaatggagccacctccccgagctgactcctttccttgagccacttcttttagaaatcacttcccatccctaacaaagacattcttaggactccaagggggggccttactgaatgattagggaagccccttccctttggaatttggcatcattcccttggtggagaaaaaacaaacaaactacaacaacaacaacaacaaaacagcagcaaatgagccttaagtgagaagcagggagagaaggactggggcaggggatggggatccttgcccttctttttcgtctgtgcatttgacctctacccttttcttcctttctcactgagatgtctttcaattttttttttttttkgcctgctgtttcttttttctctttcacacagaggttggtcctgatgaacatgccagtagctgaggacatgacggtccacttcacctccacacttatggctctgatccggacagctctggacattaaaattgccaaaggtaagcttaggaagggaggtgggaaggaggaattctggaacaactcatgcaggtggcacaggatggagatatttgaactgtcatctatccagttaaggacacaayaatgcagtcatctgaacatcaagtatctgactcaataactaataattgccctttccttctggtacagtgaatggtttgataatctctagggcttctttcagctttaaaagtatatgatcttcagtgtctggctcacaataggtattctagaaatatttattgaccagaggttaattttgtcctttttttctgtatatggtttattttctctgaagtcttgagaggcttctgtggcagaaggtgctgtcatagaggccatggtagtgttttattcctcttgatttctaatgattgatttaggagagaacaggcttactactacttccaggtggacctttagcctttctgcttttgtgcaatctaaatcctttttaaaatcaggtcactcagactatggagttagggttgctggagggattgatgtatggataagaaggcagaggaacgtacttgcggctattgttattttctcctctgatgtattgagcacctgggaggcttttagaacgaatgaggaagttgctcttagtctgagggcctcagatctcttggcaggatatccctgagtcactgaaaaagggagccaaaatgtgttctgcttcttcagcagaaagacctggtattgcaagatccactgtcactcagtgccaagatttcctcttaaaatatgaggtgccctgctgattcagctcctaccttcacctcctccctcagtcctggttatttctgggtctattctatttattagtaatttatcttattctaggtggtgcagacaggcagcagctagactcagagctacaaaaggagaccctagccatctggcctcacctatcccagaagatgctggatctgcttgtgcccatgcccaaaggtttgggtcttctcctgggtatccttgtcactgtgggcccagcatgtgaagactacgtctttggggggaacccagagtgatcaaagagataaggaaagtttgcccttttcaattaataaggacaaaagggacttaaggataaaacrtgttctttmagataggtcactgtggttgtggatgagacttcctgggtgtatagctctctccctccatataatactgctcagcaaaccttcatgggagaaaggatgttgtcacttagctatagagatttagaatggtaggcgtgatgcttactcatgtactgcttatcctcagtatcgtcaccatcactaggtgggcatgcaagccccctgaggacagatcaggggatctatgcactctgcatcctcagatcctggcaccatggsggccctcaatatacattggatgaatgggtgactgatagcacagacctgttccagagagtgggtaacaaagcttagaggttcctcactctctcccattatctactccctgttcaccatcatgccacatttgtgtttctagcctctgacctgactgtgggcaaaatctatgcagcaatgatgatcatggactactataagcagagtaaggtgaagaagcagaggcagcagctggaggaacaggtgaaagtcaatgccagcatgctaagtgggtgggccatgaggagttgcaggagggaataggcctgtgcctccctggggcatagtgcccggcaaggacttagaagcagcagtaatgggtgcggggcccaagaactttctagtgacgtggaattagaaacccagtggatcgaaggttaaaatggtcaaacaagggataagttatgtgcctgtattatccatgttaattttattttccccacagcaaactcygtagtcattggaattctttccttcttcttccctctttttacccagaaaaatgcccccatgttccagcgcatggagccttcatctctgcctcaggagatcattgctaatgccaaagccctgccttacctccagcaggaccccgtttcaggcctgtgagtagcaccaaaacatccctggcatggctgtttgcaatctgtcacccatgctgttgtgcagaccccaaaactcactgctcagaagggcccaagaacaaatactctgagcttgagtgatcctttttctgaagttgaatatcttaaagtgattttcagcaggagtaagagaaaagcagactaagcatacttagcactgtggtcaacgtcggtgatcactttgaatgaacaatagaagaagggagtttgacttcttttaatatacttgggtcttatagaggagattatttttcttcacaacagaactacaactaattcttgattatcgcttccccgtggatctagtgtcctgctggaagatagagcctccctcacaggtgccatgctggctgagtgtaagaggggaataaaaccagcagttactgctttccctgaggttgacacttatagagacactatttgcagaatctcacttgattcccactctagcagcctactataccctggaggtatatattaatatcaccactttacacatgaagaaactggagactaactgaggttaactacgttgcctaaagtcctgggtagtagaatgtggaactggaatttaagttccttatttctgaccccagagtgttttcactataccatgttttctttaatgaacaaaagggaccttattcagaaagggaacttactttttctataataggagtaaaaataaaacacaaattaaggaattttcccatccttctgagtgataagcctttgccccaattaatctactatagcatatgtatctcataacattatatttcgatcatcagcaagcatttagtgcatacctaaagaacacaagtatttctactcaatgtaaatgagcttttgtgattgggtttaacaaagtcccagttcttacaaaaccaggaatcaccaaatcgcttatgttaattactaagagagtgatacttagggcttgggaatgagacttctgtcggagtcatttggaattgctcagatcattgatttctttctgcctgtggggctggactgtttttgaaaagcactgttttcagagatcaaagtccaacatctttggaagagaagaaaaggatgagagtcatgaccaaggtcattttttttttaaataatttgatgttatgaagtacagtgtgtgaattctcctgtccacagaaaacaagtcagtgtttatcttctgcttgtgtaggagggagggagggaaagaagtatgattggaagagtgggacctcttcactggaagggtttacactgttttttgtttgtttgtttttttgagacggagtctcgctctgttgcccaggctggagtgcagtggcacgatctcagctgactgcaaactccgcctcccgggttcatgccattctcctgcctcagcctcccgagtagctgggactacaggcacccgccactatgcccagctaatttttagtagagacggggtttcaccgtgttagccaggatggtctcgatctcctgccctcatgatccgcctgccttggcctcccaaagtgctgggattacaggcttgagttgtttttgttttggcagtccttggcttagaaatgggggataccaccccctaaattgcaatctctgtttatctacaatttgctttacaaattaacccaccaccataggatcactctgtcttttctccatgtatttattgatccatttactcattgatttttaccaatatttattaagagccaatatgtccccagagctgacttaggcactggggctatggcaaagaacacgtccccatggagacaaatctggaagaagaaattacaagagcaatacaggcaaacgatgctgaagggtgggctgttgtgatgtcatggaaacagctcactcagtttgagggtttagagagtccttcctgaggaagtaacatttgagtgagacttgaagacaagctcttcaagagtggtaagagaaagtatggtaagtttaaggaacctaaaaactgtcatgatggttggagcatggagagctcaggggatgtgttaagttatggatttggagagatacacaggggctagtactttgggggcattataagcaggataaagaaattggattttgtctttggataatggggttttatgcatcagaatcatgtgatcagatgtgtgctttcttgaattcagtgtaggctaaatggattggagggaagcatttctagaggcaggaacaccatttcgtaggttactgcagttgtgtaaattatcagtgatagtagcttggactagcaggatagagatggagacagatggtcagatgtgagaaatttggtagataagactggrtaggatttggtgattgatttgctacttggactaaaggggaaggaggaagcaaaggattctgggtgaagcctttgggtgcatgttggtacatttcctgacattgggacactggtggaacagcaggctggttcctcagaaccatctgtgtttctagagccatgcattgttcagtagaggttgatctaggggtatagtggtagacataacagatagggtcgctccctcaaatatggtggaaaaccagacattaaacagaggattattggaaagaagaaaagttgcattttcagtgatttacttacagttctgataagtgctagaaagagtttacagagtggtaggggagttggagagaagtgttctgcactcttagagtggcctctactaaaatctcgaggcagaaacaagcctagcctatccaatgaactaaaaaaggccgccatgtctggagttcagggagcaaaggggaaagtggtacaagaggaggctagtgacgtagggaccagatcatgagggaggctgtgttcagaattctggactttatgccccggcttgacaaggttttcaaagtaggagatcactctgggttccagttatttaactctgtgagattattaagtgattccaagggtcctctccctctagtgaggattctataattatttactctctgtaggacaaaaaggaacccatttctttctttctgagacatgatctcattctgttgcccaggctggagtacagtggcacaactggctcactttagcctcgactttctaggctcaagtgaacctcctgcctcagcctcctgtgcagctgggaccaccccaggcacgtgctatcactgctggctaatttttttgtagagacaggtcttgctttgttgcccaggttggtctcagattcctgagctcaagctatcttcccggttcggccttccaaagtgccgagagtacaggtgtgaaacacagtgcaaagccgagaactcactcattcttatactagctgtgctcaatcttgttcccagtggttctcaggagatgccacaagtggggaagwtgactgacatttaggcaggtcatttaaatactgtaaaaactctgtagcagctgtgaaaactcagcaaaagctctcattggaagcaaggggacagattaggtgattctctgctcttcatatcttctcctgtaatctaaaaaaacattcctatggattgtttttaagtaattggcaatccttgctcatgccttgagttttccattggatgcagagtcatcagcagtagacttaaaagagatggtgtcccatctctccctcctaactccgccaccaagagagctgctgcccagccactgaccccagtccttcctcccataatctggaagctcactctgcattcttgagcaggtcagatggtagctattaccatactggtggcagtcagccaataatttggcaacaggcacctcattctccagaaagcttggctgcttctttctctcctaacaagcccagtggatcccgtcaggttaagagtatctggaagtactagacagtggtttaataacaagcctactgtgccagttctgcattcttttcccttggakgcctctaaacaactgggcagactttgtctccatcctcttttctcaccaccatttaaacctcttcctacattgccatcaaccaagaggttttcaactcctcaccaccacctctgaaatccttctcagttcatgaaccaacagacttaatgtatggtacaaagtagtccttcaataaatggcaatggaattggacttaattgtttagtttggccagggatgttggcgaaataagaccatattcttactgcgagtagggaaaatttttaaaaagtccatggctgcttaatatttaaacaaactgttcactgtgtaaactagggtgtttttcygccaaatggggaaactgagcagaaataggtttacaatctagtgttgctcttccatatggctgaatgtgacaaatgatgtcatttgtcatagacatgctagcccccggcagaataatgaatggtttcaaaggcaggatgcaggttgaaaacatcagtttctgtctsttctagtgcttttttttttttttttttaatttcaggactagccacatgtaagttacwaggtttacaaaagccagccaaggctaaagggtgttgccctgctggggtgggaattgctagtggcatgactgtccctcattacctctggatttgacattgcttttcaggagtggccggagtggatacccttcgatgagtccmctctctccccaggatatattccarttggcttgtatggaccccrccgatgacggacagttccaagaacggcagtctctggtgaatgcatgagttatatgacctcaaaactacttccttggtttcctgatccctctcactaattttattacatagtcatggtccgtcaggaaaatccattctagtagtttagccagttgccctggaggtgtcctgccttagcccttttctagcccagtttctcatgtgctctgacaatgttccctcttcaggttttacagtcccagaggtcccttccctgcagcaggaacttaaattgctttaggccaagccctcttagtttatgcccgaatatcaagtgtaagaccggaagtcacttataaaatcttgcctttgatggggagcttgaagatgcatcaccagagaatgagtgacaccaaccctgcctcttagtgtagttaggtactgcttgtgggacacacaaatgccccatgccattccttagtgatgcccacctcctctagaacctagcagcagcatgtgccacagtgatgagctgcctgccaggaggcacagaagactgtcttacctctgctctgtgtgggttcaggcacattgtcccttttggtcacaattcaaagacattctaacaggccactaaagtcacttccctgaccccaaaatgagtttattagcataaatggtgaaattcctggctgggtgcrgtggctcacgcctgtaatcccagtactttgggaggccaaggcgggcagatcatgaggtcaggagatcgagaccatcctgggtaacacggtgaaaccccgtctctactaaaaatacaaaaaaaattatccaggcttggtggcaggcacctgtggttccagctactcaggaggctgaggcaggagaatggcatgaacctgggaggcggagcttgcaatgagccgagatggcgctgctgcactccagcctgggtgacagagcaagactccgtctcaaaaacaaacaaaaaagcaattcctgagagacctattgagtcaagtgaaagcctgaagaagagaggagagattcaagttttggcttagctaatacaaagctaaaatatggttcctaaacatcattgactttaccattattcctagttcaggagccatgagctcaaggtcccccaccccgaccttagcttagaattgaagcccaagcagtcactggactgaagagaaaaaaagacaaaacccaaccattgcaaaagtctgtacagacagcttgtactaagtgagttccatatcatttaaattctgattcatctgtggctcttctctccccttcatttctctcctgatccctccccgctgctactgtgtacctcagagccaccctgaatgatgtgtgatggaatgggcacccccacagagggcgaaaaacactcagtagctcaaacaaatgcgtgcttctatctcctgcgagtgctgagacagagaatcgtgcatggttgtgtgggggagacagttagtccagacgcccccagggctgagcaattgactgcctgagggtgttcttgatgaggcaggtaggaactagtagagtcattctctgccctcccctctgaggaacttagcaccaagacctgtggaataataaactatagatagtttgattcttaaaaagacctcgcagcattttgcctgcctggcgatgtgtctagtgggaaaaaaatctcaataatgtgtcctttctttcacagggagactttatgacatcatttctgcgggttccccagggctgagccgtagtgccaggactttttggatatgtgttcatctcattgtcagtaccagtgtctgtaattcaatttaggtgtcagcctgtgctacacactcaacactgtgtacttctgcccatccctcggggctgctgctccatgtccccaggcgtggccatgattgtgtgtgtgcatatggagtgtgtgtctcacaccacctctgatacctgtagactgcagtgttgttaccacgtctgtctggagtcagaactgtgtgctatacaaagcatgtactacaaacaaacactataactccctcaagtgcaccatagcacatgtcttgggaaagtacccctgccatacacaccagaaaccgctcagccaaatggtcacataggctaaggtgggggtcccagacactctttcctttgggcaatgccctacctgtttttagggtgtcatttcctaaatataaaatagctttttctggtacgatctccatctgcccaagatgttcttaggtctttttgttaggtagcccacgtaaacatctctcatacagctctttatgcaatgatactagctatctgtatagcgcatgcacagctgccaaacaagaatgacagaaccttagagatttccagtccaacctgataacactgtaggctggcacagtccaaaacaatagctcttagccacatgtggctagtccaaataaaatataaactatctaatttttatattgattacatgttgacatgctactatttggatatattcagctaaattaaatgttattaaatttcaccttttacaacatggttaacaacatggttacttggacatttaaaattctgcaagtggcttgcatcatccttccatgggactgtgtcactcagggcatccctgacagccacccaccacatctttggatggtttcaatcagaagaaaactcttaacgtcacgtgtcttaaggcttgagaagacgtatttgacatcagaaattgttgacttcccttagaaaactggtttctatttaattgataaaaggcttcttcagattaaaagaataaatccaatgctatcacttcttagaaagcgaacttcacatatctgaaaagtattataccaaacagtgtttgttgcagaaaacaataaaatctgaatcattgcttagtgatgaaaaagaggaatctacaccagaaaaataggtgaccttcagcactcaatcccagctagagcttcctgtccggaacatatagcacataggtgcacataaacacacacacacatatacatacaactgagaccttaaagctgcaagtctctcttttgaaagccattcttgaggaggctgaattgtccactggacgtgagaagcaatgagatrgaaccaagtcccacaagcttggctgtgtgtttatttccaggagccagaggttagtgaattaaaaagcgtgcagccctctaaccatggcatctaccttccttcggacacccaggagcatgcgggatctgggagggcatcttctatgccacgtctgactgtggatccccaggtaaaaagcaaccacctacattaatgcagtggcatccgggctgtattagctgggttatggaataatatctgatatttgcaggtgagccgttgacttgcccgcaccccttccctataaataaaacctggctcatgggtcgtctctaatagagcctgcttctccggtgttttcaatgaccccccctaaccacaacagcccagcgaacaaaattgcatacttcactccggacgggttaaacattctcaagattcaaccagccatgcaagaaatattttccaggattttctctgtgtacttctccatcctttttttgtttcctgactcctccagcacatatgcagttacttacacacacaggtctgtgtcaggactgtctgtcctaaccagtgcaggccacatctcatttctttgtctgttttcctggcttctttttcctgtctgtcggtcttacatcaggttttgacagagacaagaagtttttgtagatttgttttaatatctgtggcaaatcaaaatgccagaatttaaaacggggctaggtgggattgatggcagcagagggagagtgatacattcttagcacttgttaaattgcaagctctcctaggctctagtgctgcagggcagggccttctctggcaagggcgtttaaaaaaaaaaaagcaaagccatgcttctttcatgaatggggtggcctcttagacaattgccctcacatgtttcaaagcagcacagtatttgctgcagcctggctgcgccccatggtagagggctctatgggagcttgcacagttcctgcctgcattccgcatggctttgccttggtacactcagctacagaagaaaagatcctggaccatttccagtgactatattaacataatgtaaggatgctttcttgaacagtttccaccagctaaggtttgagcaagagagattcaagggaagttaccatttccaggggttacaatttgccttccttaacgtctcagtcttgctgcttctgtccttttagatcttttcaatcgttaatccataccttgtgtttctctgggggcttgtatttccaggtggtgacagaccctagctccatgagacgttcattttccactattcgggataagcgttcaaattcctcgtggttggaggaattctccatggagcgaagcagtgaaaatacctacaagtcccgtcgccggagttaccactcctccttgcggctgtcagcccaccgcctgaactctgattcaggtgaggaggtcttcagtgtccagctctttcatcaggcagtgggctcctgccctgatgsacttactctccaaggactgtagataaccagaaaagaattcagagacaagggctgaagaaagtgaaggatgctccttaccaaagggaattcctgtatctgacttacatcctgaaacaggccaaagccctcctctgtgttcaccggaaaagctgttgcaatcccttccttctggagcagggctatacaaatcattagaattgagggagcttttcaaatagccttctacaaaaccactggggctttttaggattgtattagagacccactgtaaggactgaactttaaccaccagttccacttcaacctaaacagtgctacctggagttatttcctgtgtttgaatttttttttttttgagacagagtttcactctgcagcacaggctagagtgcagtggtgtgatctcggctcactgcaagctctgcctcccgggttcacaccattctcctgcctcagcctcctgaatagctgggactacaggcgcccgccaccgtgcccggctaattttttgtatttttagtagagacggggtttcaccatgttagccaggatggtctcaatctcctgacctcatgatccgcccgygtaggcctcccaaagtgctgggattacaggcgtgagccgctgcacctggcctgaatttcttttaagctttttgctatatatatatatatatatatatatatattagtctggctcaactattttgttttattggataaaggaatcaaagttgaaaaagcagtgacttgtcccatgtcatagggccattaagtggcagaactgggactagcactgggatcctttcatttcaatcctggacttctcaccatagcattatgttaggtgtgttattatttagttcatagaaatttcttaattcccttctgctggtgccaccttccccccaaaaagttatgcagccatatttatgatagagttcctgagccatattgttaaccaagatcctatattstgtgtagcataaatagaaacagaatagattgcattgtttgacatatgtgtctctagtggcaccttgcaaacttacctgcttacaaaataggtaatttgctagcctgcctttctcccctgcttccctttcagatcatcttttgacatacctggagaagccaggattcttttaggggcctatcttttttcaggctgctacaacaaattaccacagactgggtagattcaataacatgtatttgtcatggttctgtaggctgggaaatccaagaccaaggtaccagcagatccctgtcttctttctattctcacatgatggagagcagagagacaggaagcaagcactctcaggcctcttcttatcagggcactaatctcatcatggaggccccaccctcatgccctgcctcctaataccataccatcaggaacaaattaggcctcaacatttgaatttggggggggacacaaacatgtggttcctctgagggcccaaccccaggctgtgatgtgatacttggagagaagtcccttcatcatcattggtcagagtggacagagttataaccaagtgcttttgtcacctctcacaggccacaagtctgacactcaccgctcagggggcagggagcggggacgatcaaaagagcgaaagcatcttctctctcctgatgtctcccgctgcaattcagaagagcgagggacccaggctgactgggagtccccagagcgccgtcaatccaggtcacccagtgagggcaggtcacagacgcccaacagacaggtgagcgcagagaggaagccagtctacagcagaaggacaggggagggtgggctgtatcattagatgcaagtcgtgagcatttcgcaaacgcattcaagtacccacaaagactggaatttcacaggaagctatacctatagtgcatagaggttagctgctcaatgcttgtgtactcagagatgatctgaattcacagaaaaccagatttcccccaaaaagatggtgtctagaggtcattccattccagccttcagaaaccagagatataaataggttgacagccagattttggaggagaggatggtcctttagccagaaagtttcctttggccatcttgtgatcctcagtatttgtgagaattgtgattcatctctcagcccaggattcacaagtcagagcagttcaccctcatttacctagcttgcagccgtcccagcaagancatgccttttgctgaaccaccagcttggtgcctaaggaataactatcagatctgtatgaaaacattcatagactctgttttactccttactayagccctatctctagtcatggcattttgacccataataggagaccccctcaacagaaacgatcagcggagaaaaggcagggctgctaatgcaaacctttagagacacagcagtcgagaggtttcccttctagaacaacagttttcaaattttagtgcagaacagcattaacccatgaggtttactagcactgcacattcctggtgcctgaaggacccaggagtctgcctttgaaaagacccctctgtaggattctcagcaggaggttcgtaggtcacacataccttaagaaatgctctcctggaggtttacttcccaaaacctgggctcagtttcccttgggaataggtgagggcaagtatggcctgagccaacaactgagtgtatcaggtacagaagctgagttcagcaaaccacagaagacatgggcaggaataagggtttcccagccagagcaactccagcatttgttcaccttccacagagttgtctttctcaagtttaaagtctctcttttagtgtgccccttgttacatatgtagagcttccttagtagtccaagtgcttgttccacagacctgccacccctagcatcacctggaagcttgttagaaatgcaaaatctcagtccttgccccagatcttctgagcctgcatctgcagtttaaccagatccccagaggtttgtatgcacaaagtctgagatgtcctggtctaaatgttcttgactccttaatctcttcaatccctttttccctgagtggatgtgaatactacagggagctccagctcaggcctctccctgacagaattcagattccaaggactctcttaacagagttgcaagtagggatcatgccaagcccaatctaacatgccatgtctctcctgctatacagggcacaggttccctaagtgagagctccatcccctctgtctctgacaccagcaccccaagaagaagtcgtcrgcagctcccacccgtcccgccaaagccccggcccctcctttcctacagctccctgattcgacacgcgggcagcatctctccacctgctgatggaagygaggagggctccccgctgacctcccaagctctggagagcaacaatgcttgcctgaccgagtcttccaactctccgcacccccagcagagccaacatgcctccccacagcgctacatctccgagccctacttggccctgcacgaagactcccacgcctcagactgtggtgaggaggagacgctcactttygaagcagccgtggctactagcctgggccgttccaacaccatcggctcagccccacccctgcggcatagctggcagatgcccaacgggcactatcggcggcggaggcgcggggggcctgggccaggcatgatgtgtggggctgtcaacaacctgctaagtgacacggaagaagatgacaaatgctagaggctgctcccccctccgatgcatgctcttctctcacatggagaaaaccaagacagaattgggaagccagtgcggcccgggggggaggaagagggaaaaggaagatggaaggacaccatgcattatcagagaagaggaagtaaaggacaatcagaacaccagtcaaacccaccaaattgctttattcccctttgcaagatgggcactgccatagtyctgcctctttgctggggaaagaaaccaggaacgtggagggttattactgcgggagaagggacacgaggatggctttgcttccccttgccccttcccacttttctaaaagctgtggagggatctagctggcctatgtctacactcagtgccctgagaagcctggaagactttctggctcttaactggggagtagtggagaccataggagaggactctcctccctcaccagctcttacgcctcagccagcaccactgccaccagggcaactgcagcagcatctcatgcataaccctgtggcttgcttcccccagggcagcacaggctaagtcaggaacatcggatgccagggagggaggagaaagccgaagcgaaaggggtcagggtgctgaggcaacagcagcaagggctggtctggacaagaaaagccatagcccggcagcccctaccatgagggagacagagaaacagaactggtggtgctggggggtatagccccccatccttgaggcctgtcacccacacagtaggtgctgagagttaggacaggtcaggaagtcccccagggtccacaaaggtgcctgaggctctggtaagggtgaagataaaagtatttaacaaccgctatggcatcaatgtaagtggagtttggtcctagtgccggagcccatgctattccaggcattggctctttagatgccagtcatgggggaaccctgagggtgtgggtagagtagcaggggccacctaagagattaaaaacagagtctgttttccaaccagtgtggaagcaattaaatatrcgtaacagtgctacggccacaccagcacctcctggctgaaggtcagcccacactctggtccatgaggcagcaaggccagtgctgtgccaagcccggtaaggccaagtgccgaggcccagccttccctgccactcctctgagagggcagaacacacatatccaagtaggctacccaccactgggtagggatttctgtaaagatgggaaaggctgatagattgaaataagcttctgtgaaagtctggatttactgaggacctcccctgaggagggaccgttgggaccgcagattctgcagctggtgtggggttcaggtcagtttgtcaggatgctttaaggtgattagtaaatatacctcagcttagacttgggctgctccttctagcaaagcaggctccagtggggcctcatcatacaggatgacaagactggggccctgttcaccttgaacatgcccctgggccaagatggggcttcacccctccccagagtaagagctggggctgacagtcccaccctgtcattcctaatagcccaaacgcagaagcactgagcaagagagccctttcttgccaagccagtgctcttttggtatatggcatacagctccattggaggggacacatcactggctttatctggtggaaatgtacctttcccttaagttcctccttagtgccatcacagcaggtgaatgggtgccctacggggccctccttcccccaccaggaacagatggaacctgccacccaggatcctgatctgccctgcactgagcactcagtggataaacactcctccagcccagacacactcctcctcttgggcaggagcaatccagagttgttatttttcttagaaggagcctcttttccctctattttttaaattgaaatataatagctgcatcagccctgaaaagccaaattcaaccacatggctggagaatcatttgtcatggccccgccttctcttctgatactaatggagcttcatgacccacggtcagcccccaaaccaaagttgtcccaacagaggaggccagtgaggcagagacagagctctcccactctcagaccctcttttgtcttcattttcctctcccacttagcacatgtgtgcttgagggtggctgggaatgtgatatacagcaccctgatcctaacaggtgtgattgttacgtaagacgctgatactgggccttgtattgcttttaaagtttcctctgctcagcatcatttcatgccaaagtgctgctatgggctgctttgtgtgcacaaaattgctttttccacctcggaaatgcagctttccctagggggaggcctacaacaggacgaccattctgagccagtgagtctattgcatggtgttttgagaaagggaattttagtgacaccttatgccatttcaagaggagaaatgcaggctggcagagcaatttccagaaatggaatttgcctgcaaatagtataaacaacactaaatttactgtgccaggaaatcttcctgaactccttgaactcatacacacaggtatttgagtcctgaataaagtgttggaaagcactgcagatgcggtcacctgactgaccacctgggttttctattaccagtgaatttcttttattcaccttcccttgaccaagaaattgggtttcttttccctcagcctgcacttactcttctattaagaccagaaaataaaataattttccgttgagtcamaaactcatcatcttgtttggtgttctgctgcctctgaacaaaagtgaatgccagccttcccttgctgggtgtcagagtctgcctcccttgaaaagaggcccctgtagaccccaacacctattcttttctctggttaattacagcagcatctgagaaattccatgcaaaagaagactacaaccagtgtttcagatataccacaagatcaaatttgggcactggtggtccacctcagaagactcttgagtcatatattcagtttctcttgctaatatatgactcgtcttcaccatctcctcaaaacaagagcaaagccaagatagaggaaggtaaaaggaggaggaaaggaaaccaaggcagggagatgttctaagtaggtttgcatttagttacccctcatttcacttaaggctccagacagactccaggtagggaatgcatgctgtctctttctctgtgtctgtctccccatctcctagaggacagagtgccagcgacctctggacaggggyagggctccagccaaggtgcccctgagccagggtcaacatagaatttcctgccccgtgaagggctggcaccagctagcatccccttggctccacatgagtcatgaacacaattgtcagtgggggtctctgctgctcttctggctgaagaatctgtttttcttctgggcttcacttgtagttcctattcaatgtctccatagggcactgagatcaccaagaacattacccagaagctgaagtccaaatgttctagattttgacctctcttgactctggggccacaaagagaaggccccataatccacctctcagccagtatctcccttctttgcacagattcctcccaaccccatagagcctatgtggtgagcatgagggtcgtcttccctctgttctcccatcccagcctctgttttgctgcatgttagcgctgatccagctcctgagatggttaattccacccaatccaagcttatttgcttgcctgactgactccaccactctctcagctatgggggaatattgcattctaatgaaatagggtttggaactcacctggtgctcctcgcaagacaactgacacaaggtgtagggtgtgggggtggacacaatgcccacctactggataaaagctcactgcaggaaaatgaggtctcctggcataatgcaacaaaaatctcatataattttgatttttaaaaagttgttctcaatttttcattacatcctacttctcagccctctggatgtttcatttttttggacaaagtgtttctttagtggttggggccagggacaggttgagggatatttctcggctcatttataagatataaatattatgaggttgtatgtaaagaaagggcaaacgtacagcagaaggggagcaaatagctacctttcaaggattttgagatttgaaggttaaggaatttttactgctatttttgttcatcagtttcatgtctgttatgttttgagatcctcagaggcctagggttagcgtataccaagaatcctggtgagaggcgttgccatgccttggggtgaattcttccccactagctctctcacycagcctacaagtccttctctcatagatcccagagcaatgggcaccgtccaggaggtacaggagaggactttatgatgcaggaaagaaggaagaagtgggtcccttgcaagtggccagacagggaatgatggtttgactccagaaatcaggaatcaggttcaggtttggataacttctctttaaaatatctccacattgagactcttattttaacaaaatccaaacaaaattaactcagggcttgtgacctaacctttgtaagaaggtgatcaaagagatcctacattaataagcactgcctgtagcaccagctttgtctttttgtcttttgttgtttctttcctgaaccaccctgtacatcatagccaggtctaccccaaatagagcagcagctgatggcttctctgctgtctgtggagggagggctcggctgcagacctatggtgttttgtcagctgttaggtgctacagcccacccagtcagagtacatagacatagcgctttaagggacaaaggacaaacagaactatctttgctttccggaggccatctttttctttccttgaatcctttctgctttaaacttctgaggtttatgcatcccagagaggtcacaccaagccaaagagaaaaaattcatagattgtcccagcctacccaaagggcctgaaaagcctctctaaacaaaactcaagatagctgagaagtatgaatggggttcacagcaaagtccaattgatggcttttgaggctgggacacccccaaactgcccttctgtttttgtagttttgctttcttccacccaccctctctccgcatgctgtaagttaggggagttagtatcttgaacttctaaatgcaaaaggagattttataataagccatgctacctgtaaatacattattgaggtttgcatttttatttttggaggtatgaaagagttgagtagaccaagtcaaaagaggtgtggggatttatgtttatttttatttgtttggggttgtttggttggtggctgggtttcttgtaacagacctattctggaatagcaaagaaggataccttggtgatctgcaatgtttctgaatctgtttctctttaggaagtgattgccatcaaatttagtgatatgatatttgagtcaaaaatctgaggttatagtaccagctgtcttttctctctggtctcctttttgtcgtctttctctttctgtctaaattggcctctgtcttttcctaaggacttaaaatataacccaaattaatgaagaactgccccaaaacttcagtgaaagccaaggaggtacagaattttttcaggacatctttaaccaatacaaaatttatgtcttaagaagataatttttacaatagtgtagtaatctgataaatgaaaactattggaagtcaatagttttttatattccagctttctgtattcaaacttgtgccttcagcaagcatctcttcactttctttcccttgtcaattgaaacatgaatgtttggctaactcatgatgtaaagtgtctgttaagttaataatacataatttaaagcacttagtctccacaaagcaatttagaaaaatcttcacttgttagatcccatgaagtacctatgaaattctcagcattgctataagcatttgattttttttaaggaaacttcctgtttaatggaatctgaatccaagatttgctttaatttcactctattcttcccattttcccttattcttcttgttgtctctctaattaaaaaaaaaaaaaacctaggcttttttttttctatccagaaagttgggttttcatgatctgagcttccttatgtctccttctctttgtgcaaacttaaaccagtcatagattgtcacccagacatattctccaacccagcattggaaatctgaacgaatcttttctctttttgtcctacaagtttgtcagagatgagaatggattgctgtgtacattctacaaccagaccctagactttataccaggctgtgccacttcctcttcacttcactcagaggatggccccaaaactgaaaaggaaatgaaatcatcaaatataccaaatccgaatttgactttatttgatgactcaatattttccttccagtactctaatttttttttatggcaatggcctatatggcacaagaaccaccacttaaagcaaatctgttgaacatttttataagggatgagcaagaaaaacacactccaaaattttaaagtgccattaatcaatttttaagaataaaggtaatatgaaatgagggctaaacaatgtaatataactgccagttaaggtagacagtagttgtggtcttagttacatttgatatggagttgtgtaatattaagcagatcccagtggagttagtaaaaacataggtattgagttttaatggctaccaattgggatatatacttagcctgcaggctgaactttagtcagtgtttttctatcatgttgttttgtgaacaagtcaaaatttatacaaagctaccctaagtgctgcaattgcagaggaacttgcctcttcgtgatattagagggcagtccaactccgctcaaactgagtccaagatttgaattcatccagaaaaacaaatggaggagaaaagcctaatgcaccacatgtgtttggcatttcatggctgggacaatggagtagagggtaggaagacaagctgtagaacaaaagcaaagtgaggtagaaagtaacaggtcccagaagaggacagacttagagatgtgtaaccttggatcctctttttcacttagaatatgggtaaacttcttagcacaagactggattaagagaagttctttctgttaaactcacctagggtagtggctttgaaggcctcagaggattaatagattcccaaaattttcttccagacctgggagatggagagaaagaggttcttgctttaaagcggctcgaagacaatctttatgacttcagcaactcttcaacatagtagcaccaataaaggagagattatgttaacttcctagtggtgagaataccatgggatgggagaagggccagtgagtgggatgggaatgagcttcatcaggaacagatttcagactctgcagggtgcaccggttctagcctcaaataacaacattgcaaggaggtggactacagggtccacaccctctgtccttcggggcccatggtcaggccattccctctttgttttgctcctagaggatgagcatgtaagatgagatcaggagggaaattgggtgctctgcctcaggctgttaaaatgctgctacctgcattctaaaacgtgcaagtcatgccccacaagacacctccttagggcagcatccactgtggtgtgccagcctgacacccctgcagtcacggtgtttgaatggcagctgatgctggcccacccagagtatcggtgcatctctcctaaagccacagttcagcactgcatgttgaccaggcggatatcctataatatagatgctcgtttggatccaaaaggaaaaccattaaaaataaaagaaagatgaaaaactttaatgttttgggggggataaaagaaaagaataaataaaaccttgttgtaaagaatgcatcggcctgatttccctcacttgatgtgtttctttgctgctaccagaaagggaaatcatgggagtgaagcctgccaggaccctcagggtaagctggcagcaggctctgcagctgcacttagttggggtctgctcagaccagtcaggaggaattcaggaggctttcaaagtcccaaggacatcctggctctgaaaggttttcttttgttaaaaaatgcactttgtgctgtgtgtggtagctcgtatgtgttaccccagctattcaggaagctagggcagaaggattgcttgaggctaggaattcaagactggcctggatgacagagtgaaaccctcatctcttaaaaaaaaaaaaaaggaataaaaatgttctctgccttggataacatttttttttaaagattccatacaaactcattccctgaaagagaaaaacagattttctaatcaggacattgtcctgatctgcaagcgaggagtttaacaaggtaggcagagaacttccttatggaacaacagggctctgtgaccagaaaaactatgaccagcctcctctgaaaaaaggtggggggattatagggcaccagctcagccgccaagttcaggaagcagctgattcccaagactcttaggagatactgtccattcttcctcctgtccacatcactccccatttaactgcaattgctcccttgccacagggaaagcagcaagccccaggcccaggcctccatttgatttgccactccgagaactgtctgcttcattctgcttgaggagatatcttcacct

SEQ ID NO: 12230 - DNA, 643250 bp, Homo sapiens
  misc_feature (1)...(643250): n = A,T,C or G, or insertion/deletion polymorphism (see Tables 1-2)
tctctttctttctttctttctttctttctttctgtctgttgtctgtctgtctgtctttccttcttttttttttttttttgagacggagtctcgctctgtcgcccaggctggagtgcagtggcgggatctcggctcactgcaagctccgcctctcgggttcacgccattctcctgcctcagcctcccaagtagctgggactacaggcgcccgccactacgcccggctaattttttgtatttttagtagagacggggtttcaccgtttcagctgggatggtctcgatctcctgacctcgtgatccgcccgcctcggcctcccaaagtgtccttcttttttaagacagaatctcactctgccacccaggctggagagcagtggtgcaatcttggctcactgcaacctccacctcctgggttcaagtgattctcctgcctcagcttcctgagtagctgggactacaggcatgcacaaccatgcccagctgatttttttttttttttttttttttttttgagacggagtctcgctctgtcgctcaggctggagtgcagtggcgggatctcggctcactgcaagctccgcctctcgggttcacgccattctcctgcctcagcctcccaagtagctgggactacaggcgcccgccactacgcccggctaattttttgtatttttagtagagacggggtttcaccgtttcagccgggatggtctcgatctcctgacctcgtgatccgcccgcctcggcctcccaaagtgctgggattacaggcgtgagccaccgcgcccggcctgatttttgtatttttagtagagacagggtttcaccacgttggccaggctggtcttgaactcctgacctcagacgatccacccacctcgccctcccaaagtgctgggattataggtgcgagccaccgtgcctggcctctcacttattctttgtttgcagtctcagattggattcagaaattgaacgctagaagcagtgtttcttcaagagataatcccctggaatgcaagctcactaaaggcaagcttcatctttcacctctgtatccctagaacatatcaccctgcctaggatacagtagatgatcaatacagatttgttgaatgaataaataagtgacagaataaatgaacaaatgaatgggctgatcattcaaaccatctttgatatttctgggacagaagacgttcactactttaaggcttggcttgctctcacagtggagttttcactcagagcttataagtgcctggaaggaccgtctcacacacacacacacacacacacacacacacacacacggctagaattcttggctctattcacagaagataaatctgcagcacattcctggtaaatgtcactgggtcccatgttgctggagaaacttccattttaattcagcaaatctttattagtcacctactatgtgcctggcatgatgagagaacagctcttaccataggagagatattgttgattaattaatttattgaacgtttgttgcattataatgctccaagccctgtgcaagagaaatatggtccttgtcttcatgacaattataatttaatggggaagctgtttgtttgccaaacatttattgggtagctactatgtgtcagctactgttatagacactggaatagaatggggagcaaaacagacaaaaattaatcctggcccttgtggagcttatgttttaatgggggacacaaaccatacacaagataaataactaaagtatatggtgagttagacgggaataagtgctaagaaaaacataaagcaagtgcattaatctcccattgctgctataacaaattagcacagatttagtggcttaaatgacaaaaatttattatcttatagttctggaggtcagaagtccaaaaatgggtcaatagggatgtgatccttctggaatctctaggagagaatctgttttcttccattttccagtttgtagaggcagcccacattccctggctggtggccccctcctgcatcttcaaagtcagcccagcggcatcttccaatctctctctctcccttgccttcctctcctctctctctctcttacacctgtcatcatatctcctctgattctgaccctcctgccttcctcgtataaggcctcctgtgattacactgggcccactcagataatctgggataatatcttcatctcaaggtccttaatttaatcagacctgtaaagtcctttgccacttagactaacatatctacttgtttcagggattaggatgtgggcatcttaggggaccattattctttctactgtggcaaggaagggggacatgaagtgttggggaacagggatgccattttagagaagatgttagggaaagtcgcattgagaaggtggctttggagcaaatacataaggaaacaaaagtcctggtgaaggggtcagggagacagagaagcagatgacaagggtgggggtgtgatgggtatatttagggggcaacaaggaggccagtgtggccgaagaggagagaacaggctagaagtagagatgctgtggcgagagagacagtcataggctgaattatgtccccaaaattcatatattaaagtcctaactcccagtaccccagaatatgactatattcagaaattggaccttgaaagagatgactaagctaagacgatgtcattaggaaggggtctaatccaatatgaatggagttcttctaagaaggggagatggggacacagacacacagaggaaagaccctgtgagaacacagtgagaaggcagcatccacaagccaaggggaaaccaaccctgcaacagcttgatcttggctctttgagcctcctgcattgtgagaaaatggatttctgttaaagccatgcagcctgtggaagttttttttgtgtgtttgttttgttttgtttttttgagaaggagtctccctctgtcacccaggctggagtgcagtggcacgatcttggctcactgcaagctccacctccacctctcgggttcacgccattctcctgcctcagcctaccgagtagctgggactacaggcacccgccactgcacccggctgatttttttgtatttttagtagagacggggtttcaccatgttagccaggatgatctcgatctcctgacctcgtgatccgcctgcctcggcctcccgaagtgctgggattacaggcgtaagacaccacgcctggcctttttttttttgagatggtcttgctctgtcctccaggctagagtgccgtggtatgatcacagcttactgcaaccttgacctcctgggctcaagccatcctccctgcacagcctccggagtagctgggactagaggctcacaccactgtgcctggctaattgttgtattttttgtagagatggggtttcaccatgttgcccaggctggtctcgaactcctgggctcaagcaatcctcccaaagtgttggattataggcatgaggcatcatgccaggcctgtggaaggtttttatggcagcccttgctgggtaacacaggtacacaggtagagacaccaggcgcctttgctctggactatattctcaaggatgtttgcagagcaaacagccttggaagacagagataatgttttctgccacagtcaagggtagacatgcttactgtccatgataaaaacagtgtctccctctggagtgaagggcagacacacttactgcccgtatgaaagatctgagctctctaagctaagggttaaaaacttataaaactcgtatagggcagctgactccaagtacaggcttcacctgggcctcatgttgcccgtgggaattgggtctcagtaaactggtgcatgaaaatgctgatattccagctaatgctactattatgaataacaaagtcctttgtttctgatctgggagtctcatgtcttctgccagcatccatgaattgtggcaggctaacttgttagcttacaagtaggggaatagctcagcccctgagcagctcttgataagagctcatgcctgtggggggaggccagatgggagtcattggagggttttgagaaaaggcatgacaagtccagacgtaggttttgtaagtttcaccaggtaggaagcagtgagctattacaattgttagatctagtgatggtccagctagatgatcctgacttcagccgagtggtgagaagtcgtgggattctggatcctctgaaggtggagctgacaccatttgggatatgagagaatgataagcaaaaaggacagcactgaatttttcgcctaagcaaatggtggcctggagttgccgatgactgggatggagaagatttttaggagatgtagccggaagggatggcaggagttcagctggcgacatgctggacttaaacaccagctaggcttcaggaaatgttgaggatgcaggtggatgtgaatttgttattcaggggtgaggtcacrgctggagatacatatgagcttcattaacctgtgtatgatattcaaagccataagacaggggcgatcacagcaaatagcaaagaaaagaggcctaaccataagccctggggccctccatatttagaggttaggggagtagaagaaaaccacaaaagggacagtgaagccagaaacacagcaggaagccctggtgagcactgggagaaggggtttccaggagcgcaagtgatcagctgctgctgataggtcaggtttggtgaggccacatgcctgcctcttggttactagagttacttatgcgtggacagcccgaggcatggagtgatgacctgtgcctaagtgtcaaggagaagacaagcaggtccggaatggtaaaaatgtcagcacatctttgggaagttgtggagcccagccagtaagccaacacggctggataccagggtgcttaggccatagcaaactgcatgtgagccggtgaaggctcagcaggctttaaacggggatgccggcccggctggctgagtttcagaaagaccacgccgatggctgggggcagggactcagccagtgtcctcaatccaggaccttgtgggaccgcccggcagccagtgcttccgcaaatctgaagggtcccatttgcctcaaagcggcgagacgagccttccaagcgctgctgcagtgcggtcccagctccgcggggggtccccggggatgacctaaatcggggattgcggtgggacagacggtccaggggctaaggaaccccgtggagcaggcagcggcgctcaggaggcagcagcttgagatccacggctcgatttttaaaaattgtaagggagaaggatgcctcgaaagcctctgtggtattttgtcgcatctcgcacccctgtctaaacttcagtccactcgtggagtgtggacccccacgccgcatgggctcaggaggcgcttcgcctttggaaagaaatcgcatgtattaagggaaagcacgtgtgctactttgagaaaggaggcagaaagttaccaaacgcgggaaggggaggctcgccaaccaagcgaggccgtgggacactggcgagtcgcagaggctcctggagccagccgcttggaaacaaacaacaacgcggcgggcgaactcccgggcagcctcccccgtgccggggcgcgggggccgccgcgagaacccgggcaggagctggcaggcgcggggcctggccggcgggagggtcccgcaccccggcccagtgtgaacaccccgcgcacccccctggcccggcccgccgggggcgcggactacaagtcccaggaagcccagaggcaggcgcggggcggggcctggcgcaattccccgggatccggcgcgctgggaagcgccgaggaggacgcagcgccggcggccggagggcggcaagcgcgcgggcaggcggggcgcgggcgcgggcgcgggcgagggcgaaggcgggggcggggccgacgtgggccggagccctgcgtgccagggagggggccggccgggcaggcggcgggcggcgctcggagcgggctccgcggcttgcaaggcgcctgcgactcggtcccaggtcggcgggcggcgcacggcgggctcgcgcgggggccccggcgcgccgggcggcgcagtacgcagcgcgcggacccacgccacggccaggagcccagagcagcgcggccacactgcccaggggtcggccctcggccccggcgctcggagcgcggcggctgcctgggctttaatggctgctccgcggagcagcgcctagggctggaaggcggctgcggctcaggaagtcacccgagcaagcctccttcggggccggccgcacccgccgcggcgcgctccatgggggcgcgctccccccgggcggcccgctgacccgggacgccggggcccgctcgctcgccggccgcgcgtcccggccatgaactgagcccgcgggccagccccgcgcctgctccgcccgcgcctttcttctcgcgcctcctccgcccgccgccggcgggcccggctccccgggggctgcggcgccccgggctcggcggcccgcgggccccggggcgcggggcggcggcggcggggggcgcgcggctccgggcgcggcgcctgcaccatgaactaccagcagcagctggccaactcggctgccatccgggccgagatccagcgcttcgagtcggtccaccccaacatctactccatctacgagctgctggagcgcgtggaggagccggtgctgcagaaccagatccgggagcacgtcatcgccatcgaaggtgagggccgggccgccttggggcctcgggaaggcacggacgcccgcggcgcggcgggggtgtgcgctgtgtgcgtgcgggtgtccacacacgccggccggggcacgcggctgmtccgccgagggagcactgcggcgctgcttgtcttgcaaggccgggcgagcgtcgcctgcgccccgccgcgccgcgagctccgccaggaagatagatcgtcagcgttaatttgatcgtggacaatagagtctctcctgcgggaaagtggctcggtgcctccgcgtcctgggctgccggagcgtcccggcccagcagacgcctgggggcagccggcggggtcggcgccacccgacccctgacaggttaccaggccaggcctgggcgtcttgctggacgttgaagacgtgttctgagaagtgctgccgctgggggcgaggcccgggccggcgtgtttgggcggtgcagggctgccctccttagtgtgtttgcttaattcaggggtgcagttgaacttagtggatgccgagagccagccctagccgcgggagcatcgtgtccaggtgcccctgtgcaaacgctggaaccggtagtgtgctttgtaccaaccaaaagtccggggttggattagaggaagaaccctaccaggagggcagggcgtcctccagcggaagggtctcgctttcatatgtctgcagttggaggccactgaagtggagggtgctgtggttttaagaggggcaggatgcttgggcagaatccccacccgcttccctctgcatgtcaggcagggccatggccttccaggagagctacagcagcagtctgccttccggggctgtgccctctggatttctggtggctctcatttctctgtttccaggctgctgatttattttcttgcttcatccctttggtccggccaagactcacctggggcaccaggtggcatgtgcgtggrcagtgtggagtcatatcttagccacagttgatcagcactttctcccttctcagcgctgttggccagtgatggtaaaaagcctgcagagtggcttgtccataatacagactggccggtaagacctctattgaggaacattgagaatggcccaaagccggcaggaatgtgcctgaaagcctggtgctggcgttgcccagcctcctccctctgtgagggagagggtatcagcccacagagaggctttgccttggcactatgtagtctgaactactaaccccgaagtgctttggtttgaaacttggccagttaggtggagaaagtggatgttgtgttgctgagcccttggcatttggcagccctgtagacttgaaccatgtcccagccaggctggatgactggcagactatacccttgggggacttgttaattccaggggaggatccgggtggagctccagccttatggggtcctagccctttgtgtgtatctgtctcccatgaggtcacctggctgccttgttggtgacttaagatgctctgtggattcctcaagagatgggctctgtctgcctctgcatgactcgtgatgagtggcggtgggacctggacccatctgctgatgatcaggtggtgttgcagcaaggttcctccagagctccagctctgcgtctgttacgggagctgtgaaggctgcacggtgctcatttcagatggttcttcctggctctctggctgcatccacagaagtctgatgaaacactgtgaaagccggcgtcaggtattgaaggcacctggctgagagcctcttttgctgcatgaagacctctggctgagtggggttcacaacacctcgtttttatttcccattcttgaagctgagctctggggctcaagcacttccagcaaagcagtttgactttctagcaagaggatgtggttgcattttcctttytcccttaaaagaaaaaaaaaatgcgtcgttcctagatgatggttttttttgacagcacgatgcctacctttgcgatttgagattttaggccccttcttggccgggatccttgtcatttttaataaggcttagaatcattgggtgaatcctgtttgggactggggtgatgctgttatttttctcttagaaatagggatgtctacattatgtggagctgtagttaatttagtgaggcttaagaaccactcagacatgctgctgttctttgcatgttcttctgttatcaataatgataccacttttcatttctgtagaactttaacagaaatatttttgcatgtatagtctcattgtgtggcttcaccaaccctgtgagggwgggtgggtagcttcctcatcctcattttatggaggagcgggtggaggttcagggagggataatgacctccttaacatttgactgaggtggtttgaagtctgatctgaaccaagggatcatttgaatggagtttctgtctccacactgcatgtggatggcaggaacccagtgctggcaactaagcctgcgctggaacatcacagtaactgcagagggctccctgcaggggcagagagctgcccctgcctgtgcgtgcaccttggaggttttaaagtctaactgtttccaatcaggacagcaggtgcacatcataacaaatggctcaaaaagtcacttgtcccaccaaatagaaagctggccacattttagaagatttccagctagggattttttccccttcctctgtatgtgcatacacagaattggggtctgacttcccaagcttctggactaccgtgatgtgggcacttctttttttgttttgagacggagtctcgctctgtcgcccaggctggagtgcagcggcgcaatctcgrctcactgcaggctccgccccgggttcacgccattctcctgcctcagcctcccgagtagctgggactacaggcgcccaccacctcgcctggctaattttttctgtttttttagtagagacggggtttcattgtgttagccggtatggtctccgtctcctaacctcgtgatccacccaccttggcctcccaaagtgctgggattacaggtgtgagccaccgtgcccggccgggcacttcttaacgttatgaagagcttttgaagatagggtttctcttgttggcacaaaattcccacatttggctgcaccctactcaaaacttcactgttttctggcatcttcaggaatttttgctgttggagtgaggtgcagccttgtccaggggaaggatgttttggctaatgcttatttcagagcgcgtggaggtgggtctgggttgtaaaatctcttaacgatggactaaacatattttagttgaaaggcccaccaaggctcccaaataaaaacasatccgtaatcctgtttgtaggcatgggatacaggtgattttgccctcagtcttgttttaaaacactagcttgtcagaagagaacagtttttttyccccaatttttgttttgtacattgagaggtttattcccccctcccttcacccccaaatcactagagtttaaggaagcattgctgattgttccagatttatctgatcaggtttctgggatgtcctatggggcatggcatgctgtgaaatgtagccacacagctgtgtcgtctctggagcctccgcagccaccatgcccagaaatgagcctgagagccatctcgcctccagtctgaacagcgtgtgttagtttcccctctggttctccttagaaaagtccatcgggggttgatggcattgaggtagatgaattaactgcctttcttgttcaataaagcttgttcttctttcaaggataaagcctctcttagcagtcacacatcgtaattcagcttgccagcagcaggaccgtgatgtgagtgatagcccagccagctcattcagccaggcggcccgattcccaggttcccacgcatcgccgggaaggttggccttcctctgaggttgagccctcakccagcccacaagcctccatccccaccaggtggccgatgagaggaaacccaggctctccactggcctggcacttggcaggagaaccctgccctgcacttcttaagggcatttccacagggagattccaggaccccttagtagtatctcagccccagtgtttgggggasctgggaagatgggtcagggttccccactttgtcccatgatacagctgctctgttgagcatgtgtgtcccacagagtgcggagtgtctgaggtgcatcatctcagttcgtcctgcagcgatcytgtacacagacgcactgctgaggccagaaagcttaggacacttgtgcgagagcggtgagctgggcccgtccgacctcacctctggccctctgtcgccgtgtgagattgcggagcccctgttattcatacttcccataggccgtgygtgcaaagcatcccaagcttgtttccgccacccaaggcaagagggtttgagaaggccccaaagaacctaaagtattctgttctctgtaaagcagctgactgtggcaaaacttccagaagcatttgttttcatgtggaaatgtatttagtccggttgatgcaggtgtgcatgtttagggaaacaaacattttcttcctgctgtggataagtgtcatgtttctttgtcaccattggccatgttcataatccttcaagttgaatgaaaggtggcaggtttgcagtcccctccttaaaaataacactcagttggcttttagttgcttccaggtgagctctcgtaccttgccggcacccgrgrcctccacaatgmgggcgttccttgtgagtscagcttactcatgcytctcagttgtggtgcaggtgctctttgagatgccgccttctctgcctgttgctcaccctgcgaggctcggtctctgttggtgtcactcatgaccagccttgcctcgccagaattaaggccctcctggtctctgcccaccgtgtttggctcatctacttaatcagctgggaggtctggaagctggttgagggcagaaatcagggcttgtttattgctgtatcctcagtggtttgatagatcacgtctggcccttgaaggatgcccaggggtttgttggctggctgacttgccagagggtcctttccaaagctccttcttggtaggataaacaatgtttatacgctgcagaagtgaggacaatttgaaacgtccccagagcacagaagttagggttagacaccttttggatttggtgggctggcttggtgggaactcagtgtcatgtggtgtttgggatggaagtgaaattttctttactgtaggtaggggaagcaaaagatttgcttgctaaatcttggcagctttttcagatcagctgtctacaacaggttggtgtttatgttgggtgtaagtgaatttcagacatagaatcaatattaagaggacaaatgggtgacagcctgtgtcactgccatgatatagtatctttggcgtcacaccgagagcaaacgtgagygtgtgtcaggtcacattgagggctgatggaaacagattgccggcccctcccatacctcccgagtttctagttctgtgggtttggagcaggacgcacgaatgtgcctctctaagaagtgtcctgaggatgcggatgccctggtccagggaccgcacttctggaagcatagctgtaaaggaaaggcagctccagttgacttggtatcatctctgggccgttgtttcttcttccttgctgtgcttgtagccagctgagaaggtttcctatcagcctgccctgcaggtttcaggtgaagacacctaaggccagctgctcagggagttgcttgtggtcacgcaggctaagtgtggtggacgagggacttaaaccagatctgaatggtttcaagctggtgttcatgtgatcttcatgatgctgtttgaaaagcagctgaatgctgggtgaggggcctgtcgtgccagacccctttaaatttcattagggatggcaccgggttcaagagactggagaggagacctagagccagcaaacaaaagacagagggtttattaggggaatttatttacagagtggtcccatggcggcctgggcaggagaagcgctgctgcttgctttcagaaagcgtgcagtttatatagcattttcgcttaacaccctcccccaaacaaccaccacccagcaaccttaacaccaatcaaagagcctcartaccctgtatggcctgctttccatgggacaggctgggggtttagatgttcctcatagataaggaatgaatctctgggttggccactcccggattccttagctcagaaccccgaacatacattcaggtgcacctgccatgtggggccattctcagttattgctgtcaggggcatctgtcagtgggctgcgtttctgcgacacggtggcatgtcggatggacattgccaagagaatctggttaggaggtagaggcagctgatgtccatttccttctagactcattctgtggttttgcggattttccttcttgtctttcggagattgttgctttttaatgtagtcttatgtatatttagattgggttcttcagtattcacttattatatgataatttggcagatgacacattttgttaccaatatttccaagctgaaagcgcgtttctgtaaaagacaggagctagatgttactagtagcttaaaagagctgttggaggagcctgaaggaagtgactcataagggagagaagcagtgggggcagctgcaggaaccttcaaaacaaaacctgcagccctgttgctaccacctcttgttttttgcctaaaccaggcgttttattttgttaagacgaaaatcccttattttgcatccgtttttccccctgtataccctgcaggtgtttatagtttgtgagtctcactctggcttgttttaaccactgatttcgtttcgtcttatgtttctctacactctagcaaacctgtgtccccctccccgcccccatcccaatcctccagccttcacgtccttagcttaagtgattgagtctggcaaagcggatgaggcttagctatttttaaaatccagggtttgaggttctgatctggtgcttagctacataattccttccctttgttaagtacctttctccgagaaacaaaatgcactctacagatgttaatctctaatctttgcagcatctgttatttttattcaggggtacaagtgctttgtgtgtgctgcggtgagccctggccttctggaagctctgtgcttctgaggggctgagggggatttgggggtcccttttcatagtgtgggctgtctttcccaagatgcagtgatgacccrtcagaggcagggttggtattgtccgtggggtccagtccctctatcttccagggcttttctggtcacaagagaccatggccagaagtgggtatcgtgcttgtgtctggggcctggggagggaaggaaaacaaataccaccccctgcagaagagatcgttaatggattctttgartaaccagccagatagcttgtttgtgtgcgaggttgggacattttccgtaaagagcagactaaatataggctcgagggtggggaccagggcccgagagggggctgccactgcttgctccagtattgtttcttccattggtaaccagaacttgccaccagtcccaaacaggtggccaccctgagctctctgggaacagattggtgtttttgtttaaccaggggctcatttgcaaatttcacacttctcccgctgtttgatggggattgtctttttttgggctgcagtgttggagtatttgtacagtgtttctacacaagcaactgtctaatctttaaaactgctcatgccgtctggttgtcattagcatcatggttagaagctttttatttgcctttttttttttttttttttttaagggtgggaaaacacttttcatggttctgggagaagaatttcaaataatgtccatgttcacaaatgatttatgtttggtcttggagaaatgtcagcattcaacaggctctagtaaatacaaccatgttgatttccagcttaggacgaagctactgttaccctgttctcactcagataatagtctgaaaggcagaaccgtacctttagaaagtacatttagcttcaattcaataagttttagttttagccaatagtgacttgtagtatggaggatacttgaaagaaagaagttaaacattttttaaaaaatttatgaacacctgcaacaaatagccacaagacctacccttttttcaggaaagagttttcacttcttaaatgtcaccttgggggcatgcccactgtgtgatggtacccttcagcaggattggtattgtcggaagtgctggctagcttatgtaatgaaaaagaaattgatttggaaagagctgattgccctgaatttccatcctgtttgtgcgttgagctgcccttttcagtgggggagaatccagcatattttccagggagggcgtttccggaagcctgtctgcaccccctttgttgttgttttcgaaggtctggggtgctgctgtgagccgggatcgcgtatctgctcctgttctgacgagactgctcctgctggaagttcagcctggtgaacctgatttgggaggggatggtgtgattggyggggaacagcattgtgttaattttagcttcaacaatcaagcctgggtctctgagtgtccatgtagtacttgaagtttgggtttggaattggtgggattgagaccacttcaaactcttttatttcttggaacttgttagtatttatttatttattttttgagacagggtctcactctgttgcttaggctgaagtgcagtggcactattggggctcatttgtagcctcaacctcccagactcaagtaatcctcccacctcagcccccgccaagtagctgggactccagatgtgcaccatgcctggctaattcattggattttcagtagagacggggtttcaccatgttgcctgggctggtcttgacattctggactcaagcaatccacctgcctcagcctcccagagtgctgggattacaggcatgagccactgtgcctggcctagtttttaatttttgagacagtctctgtcaatcaggctgaagtacagtggcacgatcgtggctcactgaagccttgctttcctgaagcgatcctcctgccttggcctcccaaatagctgggaccacaggcacgcaccaccatgcccgactaattttttaattttttttgtagagatggggtctcgctatgttgccttggcctccctaagtcttaggtttacaggcttgagccaccacgcccagcctcgaactctcttttttttttgacacataacagagaaaggtgcccaagtcataaaggagaaagttttcacaaactgatcacatgtgggaccagcatccagttcagtggccagcacagactcatctgtcgtgagggtcgttagaaattgtagcccccatttattggtctcttctgcctgtgatatgtgcbtgagkggttgcctgtttcgggggctgtcagtgtttgagtggctgcctgtttcgggggctgtcagtgtttgagtggctgcctgtttcgggggctgtcagtgtttgagtggctgcctgtttcgggggcbgtcagtgtktgagtggytgcctgtttcgggggctgtcagtgtgtgagtggctgcctgtttcgggggctgtcagtgtttgagtggctgcctgtttcgggggctgtcagtgtttgagtggctgcctgttttggggctgtcatgaatagcaccactgtgcagattctcacttgccttttggtgcccatatggcctcatttctgtcgggtgtgtgctgggctgtgtctttctctctgtgggttggacgtagctgctcgtgaagccgctcctgcagcccagcagcccctatctgggaaacctttcagtgctttcaaggttcattttatgacactcaggatggccgtttgtctccttttgctgattttcattctttcagttgtttgttcataaacaaatgtttgcatggctaatgcatttccagcacttagagattaggtttttaaacttttggattgtctgcaggctattaattccttgttagttgaataatgacggctgtgtgcatggagctgtgtgagcgaaatccctcaccaggaagagggcgcagttcctctgggactggaacaggggcccctttggctctccttggctcctggcagaagtcagttgtcaactgggggactctttctggctgagccccaagcagcctcaatccatctctgtgctgggttttagataacccactggatctgtgttggtctttgaaagggaattcactctgtatgtttggcctaaactgtgttatggccttcatagttacgtattagcattattcagtttttgttgtttgtagcarttatgctgaagacacaaaagaagaaaaaaagctaagtgttgccaactcaaggagtaattttctttgttccagcgctgtgtcctgggagctgcccatccccctccacaaaggccagtgctaaacaaggccagagccaggaaggacacgcggggccatggattgagtgagggcagtgtgtgcgtgtgtggatttctstggtggctttgcaatggcaaatatttattttgagggatggtggtgggaggaccaagtttatactcactttgtttagtaggggaagtggctaatgtgagaatcaatagacaagattttatcaagcctctgcactgggcagagcgcagtttttgaagctgggagaacaggcagatgtgtgggacactcagggcccttcagatctcccccaggagccactgatacaggtagagatcgcagccacacaaggctgtgtgggaggggcctgggagatggggcggagtccagggagagatcctggaagccaggtagcagtcaggagggctttccaggctagtgggtactaggattggagcatccagaacagagtcacttcagcctgggaagagcggggtaggcggccgaatgataagtgatccttgacagcccccgagagcaggctgggagaccttttgttggacggtctactactgattatggatcctgcttggagaggggagtgctttttttaaaattcttttctttttttttttttttttttaagacggaatcttgctctgtcgcccaggctggagtgcagtggtgtgatctyagctcactgcagcctttgcctcccaggttcaagtgattcgcctgcctcagcctcctgagtagcggggactacaggcatgcaccaccacacccaactaatttttatgtttttagtagagatagggtttcaccacgttggccaggccggtctcaaactcctgacctcaggtgatctacccgcctyggcctcccaaagtgctgggattacaggcatgagccactgtgcccggccctrttttatttatttatttatttagctcgggtttcaatattttaaaaaatttgaagccaggtgcggtggctaatgcttgtaatctcagcgcttcgggaggccgaagtgggaggattgcttgaggccaggagtttgagaccagcctaggcacagtggcaagtgcctttagtcctagctacttgagtggctgaggcaggaggatcacttgagccaaggagttgcaggctgcagtgagctatgattgcatcactgcgctccaccctgggtgccagagtgagatcttgtctcaaaaaaaaaaaaaattgaactgtgatgactatgatattgtcttttggggggttttctggacataaaattcagaattttacatagaaacttgaatttatttgtccaagagtttcttgttttgaaaataggatgccactgggaacattcttggttaggagccaccggaagccgggtctrtatgggcagggccagtgagatgcaaagccacacacgaaagctaagcacacactcttgttttcctcactcacatccatgttcatcctctttcctgtgctgacggtttgcaaagctgggagagaatgagggcggrgcctcgggaagtgaatggcagagcaggtggcatagacacctcagccgtctgcccacagggtatgggcaaggtttgttttggtgactttttcttccagtcttgtgtacattatcgtctctcacaggacttgagcttggagggagctggagtggccgcttgctgagtctttctccctggagcycgtgggcagctggttacctcgcgctggggcgaccctgacttaggacctcctgccgtttctctgggtgactgctctgtagtcgtgagtcgtctctttaatgctgagcatcagtacctgcacagccctgaatggagcagctgcccagaatctgtcttgtcatcgatagatggacagttgccgagtgtcctgcgtgccgactgactaaggagtttttgtctctgtcaccctgtcccctgtggttttatgaagacgttagttatgaatcygtgtttaggatgagaagatgtaaacagtgaggaggataagtgagaagctagcaagagtctggatggtgatggcgggggagcgctggtggaggagtcgggggcgtcccgctggactggggcacagctctgcagcagcagccggtgcggttttgccttgtaagtgacaccgttgcctgcaggcatctctgacagctgctcctgctccagattccagaaatttctatggaacatttcctgaaccatcctcctggtttcttcccttcccctcactgaataaaatccgtaatagcacctgccgcttgagtgtttgtctctgcaggacgccrtgttcagggctgggtgccctttgtgtcattttgttatcctggtcactgccagacagaggtggtaggaccctcatttgtcaggtcaggagcctgcagcctggagagtttaaagccttgcctgaatccacccacttctgaaggtggcagagtcaggattcgaactcgggacccgtggacaccagccacctatgggcctttatttttatatttttaaaaacttttagtttcaggggtacacatgcaggtgtgttatataggtaagttgggtgtcatggtggtctggtgtacagattattacaacgcatagtaagtacagtacctgataggtagtttttcagtcctttccctcccaccctccaccctcaagcaggccttggtggccgttgttccattctttgtgtcaatgttgagctcaagtgagaccatgagatatttggttttctgttcctccgctggttcgcttatgatattggcctccagctccatccattttgctgcacagggcgtgatctcattctttttattatggctgcatagtactccacagtgtacatgtaccacattttctttattcagcccatcgatgggcattttggttgattccatgtctttgctattgtgaatagtgccacagtgaacacacaactaactgcgtgtgtctttatatagacacaatagaacaattatattccttcaggtgtgtaccaagtaatgycacctacagttttgatgttttagtaaagtagaaaaggaaacttcagaaatcagcccataagtctgcagaagtacttggggaattctctccgcagttcgcagctctcctgcagatctcggtttgtgatttgaaactcacattcacgctcggttttttactcatcaaggttataaagaaaataacagctgttggttcacttttattccctcgctgagagttggtggcggctgggatgctgactgacggttttgattacatgaggaggaggcacggaggcaagctgactgcctgcgattacaggtcccgaagtccgggaggagggaggatttccaaacggcatgcctttgaaaattcacctgcgtttaggaaatctgcagcacctttaatcctggctagctgaaaatacagcttacatttaagccacacaaattctgtgacattttaataatggagatgttagtgggcagttaactttttatacatgtaaatagaagttactttccccctgtgctgtaattagcaaaagagggagaaagggatgctctgtgcatcaaagcgatttgcccagggttacacagaggaaggtggcagagccggaagtggcagaatccagtgcacgggcgggatgccgagtgtgtcgccaaactccaccactttagtcgggggcgtggtggtkgctgcgctatctgcttcccactcactggcatcctagccgtgtggggtgtgtgctcacctgcagccaccctcacctgcttgaaccagatttacctagagggtggtgtgaactcatgtgatgtgaacgattacttatagttaccgtgaaaattaatggtgggttttatagttggaatgctttttctacacttayttgatttttgtctatctgtttagagaagtgttttttctgttgttgttgttttttaaacttgagatggagtctggctctgtcacccaggctggagtgcagtggtgygatctctgctcactgtaacctctgcctcccaggttcctgggttcaagcaattctccttcctcagcctcttgagtaactgggattacagacatccacaaccacgcccggctaatttttgtatttttagtagagacggtttcaccatgttggccaggctggtctcgaactcctgacctcaagtgatccaccctcctcagcctcccaaaatgttgggattacaggtgtgagccaccacgcccggccagaggtgtggtttacataaagtaaactccaactcttgaaagtttaccatttgatgagttttgacccctgtagctacaactgaggtatggaaggcaaccattccccgaccccaacacttcctcatgcccgtttgcaacctgcatcacctctgtccgtctgcttgcacccatctgctgtctgtcactgtggattagtttgcattttccagaataaaatagaaataagatcatgcattaaaaagggggtccccagcctctgggccatggaccagtactgggcctattaggaaccaggccacacagcaggaggtgagtgacgggccagcaagtgaagcttcatctgtatttacagccactccctttgccttgtgttaccccctgagctccacttcctgtcagatcagcggcggcattagattctcataagcgcacaaaccctgctgtgaacagcacatatgagggatctagatttggcgctccttatgagactctaatgcctgatgatctgtcactgtctcctgtcccccccagctgggaccctctagttgcaggaaaacaagctcagggctcccactgattctacgttatggtgagttgtagaatttttttcattatatattacaatgcagtaatgatagaaataaggtgcacaataaatgtaatgcatttgaatcatcatgaaaccatccccctgcctcccttcagtgggaaaattgtcttycacgaaaccggtccctgatgccaagaaggttagggaccactgcagtaaaggaccccttctttgactggcttcattcagtcagcatgatgatttttagggtcattcaagttgttacatatatccatagctttttctttttcattgctgagtaatgttccattgtatggatttactacagtgtttttatcctgtggatggatattgatggagttgtttccagttcttggcttttacaaatagaggtgctgtgaacattcacgtgcaagtcttcatatgggcaygtgctttcatttctcttgggtagatacstaggagtggagtggctgggagatgtgctgggtatataattaacttttatgtaaactgcctgctgttttccaaattggttgattttactctcccgccggcagtgtgagagtgtccactttgggcttaagttcagcaggcttctggcagtgatgggatagcagctgtccttaagaaagagcatttgccctctgtgtctcttgggctgtgaagtgtcttgtactgatgaggggggtgggaggctataggagtgaggctgaggagggaaaggagaagcctcagaaagaggtgcagactgaagaccaccttagaaggtcgcaaaatccaagggagcagagccagtgtgcctctccttgtgacctctggcctcagtttccctgtctgtaaatccggatgtttggccaagatcagttttcaacaaggtgctgggtgggggggcggggggcggcggtgtatggcgtgcaagcattgtagcccccaagaggacatttggccatgtctggggcaattttcggtttgttacaactttggggtgtcatggttgttactggcacgtggcaggtggaggtgagggatgctgcccaagatcccgcaatgcctggggcagccctgagtcttcgtcatcccgagactgagagccccaggtcagatgagctctgtgaccccctcagcctctgatccacactcaccaaggattactctggtgcacgattctgtttcggtgggagctggtgtaattatctagaggtgtgtctacctgtgtgcccagaggggcccgccctctcggtgagcaaggacacctggttccctggggtctgagccaggccctcagggaggggggcagccaggagccgcagggggctcagccagctcctggccctcaagtgttctaggaaaccggcttctctgtggggatgtgactctccctcactcctcccattgcctgagtaggcaaattccacctagctctttatgactaactgcctggcagcctgagctcagggcagttcctaacgaacttctttgattattaacctatgctgggcccagggaaattactcacttgttttctggccaagagaaaatctcctggaaacttctatatataaatctttttgacaattccgcattcaagagagttcccctggcagttcttctatttgtagggtggggagaaaaacccatgtaatttccccaaactgtggattttgttcctatagaacatgcttgtgagattcagtgtgcgtatttgtgtgagtgtgtgtgaatgtgtgtgtgaatgtatgagtgtggatgtgtgtgaatgtgtgtgtgtatgtggatgtgtgtgaatgtgtgtgtgaatgtgagtgtgaatgagtatgtggatgtgtgtgaatgtgtgaatgtgtatgtgtgggtgtgaatgtgtgtgtaaaggtgattgtgagtgtgtgaatgcgtgtgtgaatgcgtgwgtgwstgwstgaatgtgtgaggtgtgaatgtgtgtgtgaatggatgtgtgtgtgaatgcgtatgtgtgaatgtgaatgcgtgtgtgaakgtgtgtgtgagtatgtgtgtgaatgtgtgtgtgtgtggtgatggtcattgtccacattggtggtcttgtcactcacttcttgatctgttgctgcatcagcagaatgctgggcagatggctgcatcttgtttgggagtttgggagttttctttgagtatctgttttttaactttcaggrgagaataccaaggttgggaaacactggttttgctgacataagaataagaaaattggccaggtgcattggctcacacctgtgatcccaacactttgggagaccgaagtgggaggattgcttgaagctaggagttcaagaccagcctgggtaacatagggagacccccatctctacgaaaaaacaaaacacccaggtgtgttggtgctgcctatggtcccagctgctcaggaggctgaggtgagaggattgcttgagcctaggaggttgaggctgcagtgagccatgattgcaccactaccctccaacctgggcaacagagtgagaccctatcattaaaaatcagtcaatcaatcaatcagtcaatccatgcgygtcctcccccattcctgccttgatttccctgttaggatttgccatggggtgggcagctgggcaaaggcatctgagctggaggtaggtgataagctccctgggcctcccaccctgcctgcctctgctcagtggctcctgggtccctcctgaccatgtaacctttgcgccagccagagaatctgccctttgccttcctctccaggaagttgttgagatacatgagtgaaaatattattcttttaagtgctttggatgttataaaaaatacactgtgccattaatgctcgtgcagggctcccggccggcctaggccctctgcacttgagattcctctgkcagcatctgtttagaastgggcactcctggttctggtcaagtttatcctgaccagttcatttcatggcagttctggtcatttttgagaaaatctagtttgcactttcattgggcccctttgtgttttctagttcagatgtggcttctctagctttttcttgctgctaaatggtcttaaaggtttgagatcagtgtctcagamtttagcctgygtcaggatcacctcaggtcacgttttaactgagggtgggttaaaatgcagatcactgtgccgggcgcgggtggckcatgcctgtaatcccaacactttgggaggctgaggcgggcagattgcttgaagtcaggagttagagaccagcatggccaacatggtgaaaccccgtctctactaaaaatacaaaaattagccagtagtggtggcaggcgcctataatcccagctatttgggaggttgaggcaggagaatcccttgaacccaggaggcagaggtcgcagcgaactgagatcgcgccactgcactccagcctgggcrgcagagcaagactccgtctcagaaaaaaaaaaaaaaaaaaaaaaaagaaatgcagatcactgggctccacccccagaagttctgattcagtgggtggcgggtgaggcctgggaacttcatgacgagccccctggcaaggctgctgctgccattttggtgccacactttgggtactatggctttgggcactcccaatccaggtgccatggcatggggagcagtgggtgaaccaaatcctggagcctggactgttccattgggtgcattyctggctggcagatagaggaccacccagctgtgcttgatggggtctagaagcattgaaactggtttgccgttatgatgtccatgaggttggagtmctttcttagttaaaaaatctgaagacccaacaacacacagcacccccacgctgaaccctcccgagaatsattgagctcttccaaataaagggcgattttgtagcttttcaagttttaacagtttgataactcccaggctcctgttgagatgctttgtgatgaggttgtgcgttcccctgtatctttcctgtgggtgtttatgtgtacagaacacatgtatctgtatttacgtgactgagcacaggcgatttccccgagtctcaccttggtgtgtgccagtgcatgcgcgtgcgcgcgcgcacrcacacacacacacacacatacctcctctcagagaatgttgatgtggcaattcatgtttgacagctgggttaacccataaatagatcccaaaatataaatttacccagacctcaacctgcttaagcctttaaatagctcactagggcttttagaatgaagttgaaattccttggcctcacccttaagcctttttagaaggagtcatggaggaagtaaagaaatggaaatggagttgcctcgctgggctcccaggccctttgccgtggccctgcctgctctccagcctggtctcaccccacctgtggcaccttcgctgtggaggataccgtcagccaggctcacagttcctggcaggccacttcctctgtctggggccctgcctgggggtttggatcacctgagtcctgccccttggcaagcctcttttaacccacctgatgccttcacaacccagctcaggagtcctgcttccccaaggccattccgatggctcctgctggcgattccagggcctgccacctggtggcctgtgcactttgctgtgacgtgggctgcacgtctctccccagcatgggctcaaggtgctcaggaaccaaaccccggtgtctcatccaggmctggacacgtggtgagagctccatggagcttaactgcatgagggaggcgggatggactctggcttgtagggcacagtctgtgtagcaacaaggaacatacctggtgtttagatcagatgttcaatgactcatgtcccagagaaggggcctgcagccgtattggtcagttggggagcttgtatactcaggccattgaggttgccatggccaccattttgggaatcttttctttgggagttgccatcagaatttagggcattaaaaaagtccttaaatttaggtaatgtttgccttaagcagatggtctttgccttttagaactgtcagaacttgtttacccttcaagctgggcactgtggtaagttgactctttgggtccttggttggaaacatgagaatcccattctggctgactcaagcagacatggattttattcgaaggatgtgggggtggctttgagcatagaggcgttgggatggactgaaccatgggcccaggggacaggcacaggctgcctgkgtatttagggcactgcttgggttgcctggagagtggtttattggcccagattctgccacttcttggccaggggaggcctttcatggacagcctcatcagagtggcagcagagagaagagcagggcaggtcctcaaaggaacactgaaaaggttctctgaaagacaggggcgtagatactgagctggcaataacagcgctgatccactggaatggggaagggcctcgagctgttctgtcaacacggagttgtttgtcaggcgtcatgggtatcattttgtgcatctgcccttgttcagtgtttccttgtaattttgcggaaaaaagtctgcttagtgttgaaccagacattctgcagccyttraaagagaatggaaatggagagattgtratgtgttcattggtgacttttgacacggatgctaacctgtaagatrtgcagatatatcatgtgcaaactgttaagatgctgtcaacattttgaatgacttcttgcaaatagtaaggaaattaaacacgcacagagctgggcaaatgctagaggatggtgttgccttttgcatcttggtgggaaagagatatttaagggggtgaggggagctcagcaacagcgacttaagggcctgctaggagcggggagaagttggttgctggggtgtgcggcctctgtagcccagtcctccgagtatcgtgacaggtggctgggtgcctcagtgctcaggtatgggctcctgttcctgccgcatgggctcctctgctgctgctgctgctgctgctgctgctgctgctgctggcccgccagttcccatggactctccctcacctgtgcttccttctgctccccgacttcatggttggaacgtgctgtcttcccatccctctgggcacgtggctcctcttttacatgcatgcctggcgaatagtatatccccagtaaatgcttgcagaatgaatgtctttcctgaatgttctgctctgctccccagcccccagaaataaaacagaaatgctgtactccttccctgtctcaggcccaggagcattattattattttttttaaatctcttgtggcacttttctactttctcctccacagkacagctgcttgttgagaggcagtatatgtcatgtctaagaagagtcctcaagtgaagtctggtgcagcttctttctagctgtgtgctttcaggaaagccttttgaatttggagcctctgtttcctctagctttactccaaaggaaacaagtgtaagtgcttggcacctgcagcctgagcgtagttcatgccgcccgtattcctggccagcctccgttctctgggacccggcaggaatgtgtttgtcgcctctggccctgtgcaccctggcttcccatcatacctggagaccctgggacaaatgcctgtggagtggatgagtgagtgcatgcgggtccactcagctccccggcaggcttcagaatcttccctgtattctggaagtaagtggcgtcgctgcccagtttaggagagtgccatgtgggactctgttccatcagctgggttggtgcagtgggactgaactttcttctttggttgccctctgcaaacagccatgcagatgttattgatgggcagttgcaggtagaagcatttttggccctacagggtagatctgccagcatggcaggctgatcagccacgggtgccacgtggctctggaggggcttggcgcctacgttagtcagctcgggctgccacgacaaaataccacagactgggaggcccaaacgtrttttctcacagttctggaggttgagagtccatgatcaaggcactggcaggtttggcttcttcccattctgtgcctcacctggtcttttccgtgtgtgtggtcttcagtgtttttccgttstcaggaggacaccagtcttgttggatgagggtcccacccttaagctgccatattaccatgattgcctccttaaagaccttatctccagcgacagtcaccwtggggtgtgagcctctgcagaggaatttgggggatactgcgcagtccgtacagcatccctccctccctggtggtttctgaggatttgtcactgatgtagtagcatcacgagtgtttcgtcacttaacccagagcagggctttgacgacatagctgtgcccaacgtagatctttatggtaattttattttaattgaggtcgcagggactaatttttactggaaagaagtagcagccatgaggcaggagatcctctttactttgtaaaaaaatgtaaaagaacttgtttagatcaaagtcatgtttttaaaatataaactagattatgaaaaaaattaaaacttgatttaaaaagaagcctgggccagatgcagtggctcacacctgtaatcccagcactctgggaggccgaggcagacagatcacttgaggtcaggagttcgagaccagcctggccaacatggtgaaaccccgtttctactaaaaatacaaaaattagtcagacatggtggcgtgtgcctgtaaccccagctacacgggaggctgaggcaggagaatctcttgaacccgggaagtgttggagtgagccaagattgtgcctctgcactccagcctgggtgacagagtgagactccgtttcaaaaaaaaaaaaaaagaaagaaaaaaaaaaggtagaactcgtagttgccattgaggtctgagtcccggcttgcctcagttggggttcttgcccccatttgcaggtgagaggtggaagctcaggcaggcccagcctccgaaggtgcagcgcagggaccctaacctgagagctggaaatgctttcttagagaaagtgcataagggctgtgcccatctctcctttgcccgaagacgactgttctgctgcattggtttcactgtgttgtttctgtaactctggtgtttaatccacgtgaagacagtggagctgtttacactgtttgattgattggatgcttatcaggaatctcaaaacccagctttgggcaaccagatgcctttgacttctctttctcctccactgacagtgatctctgaatgcttttataaaggtttttcataaagaatataaaaagtgacagaaataaaattggcaatcaaccaaattccttacctctcaaattgcctcttctgagactttttgtgatgatgcgtgtgccccaccctgcaattggtttcatagaaattccttggatttcctctgtttctgacaaagagccagggcggaagctgcaggtcactgggtgccagctgtttcccaccgtcagccttgggaggggcacggagctttgcaaatgtctcttcagctggtgttttctgccataggacaaagagaaaggagagtgacatggtgttttgaatattttagtaagaaaacagtctccacctgcacacaaacaaaaaaaattaatgcttggatataacttttttaatcctcaaagtaataataactttctatctcataagccagagggatggtggcatagctaacagcagctgcatgtcctcaggttaaacttcacatcttgactggcaggcttgcctcgcgggtgcacttcgtgaatgcccgctgctcctgcagcggaagagtctcctgtccttgggcctcagtggcaggggcagcaacaggaggctgcggccagttggcttcacactgtttgggaacagcagaagggtcagagcagacctcaacattatctgaaacgagtactattcacaacagcaatttgcaggttatgtgacaagaatcatatcatttggtgtgtgtgtatgtgtttatttatgagacagggtctcactctgttgcccagggtggagtacagtgccrcaatcgtagctcaccataacctcaaactcctgggctcaagcaatcctcccacctcagcctcccaggtagctaggactacaggcgcacaccaccacacctggctaattctttattatttttgtagagacaggcagggtcttgctgtgttgcccaggctggtcttgaatgcctcaagtgatcctcccactatggcctcccgagttgctggggttacagtcatgagccaccgcacatggccctagtttatatttattaattggtttaatcctcccaggaatttgaagatataattcctgatatataggtgtcagaatttgagactaagagtattgagtgataattcatttctcacctctctggaagaaggtgtaataagcatagaaaatacagaattttctatatactsatataacacatattttcttgtgtgtatgtgtatatgtgttgtgtgtgcatagtgaacaaaggcagaagaaacatttaggcttgaattttttgagctaagtattattttctagagcttaccaaaaaatccaaacacacatatatgtatgtagaataagcgtaatgatctcctgtgtaccctcaaccagcttcagtaattagttcatcctgtatataccctgccacctaccaatattattattatcattatttatttttttgagacggagtcttgctcttgtggcccaggctcgagtgcaatggcatgatctcagttcactgcaacctccacctcctgggttcaagcgattctcctgcctcagcctcctgagtagctgggattacaggtgcccaccaccacacctggctaatttttttgtatttttaatagggatggggtttcaccatgtccaggctggtttcgaactactgacctcaggtgattcgcctgcctcggcctcccaatgtgctgggattataggcatgagccaccaggcccggcctcaatattattttgaagtgaattccagacaccctgccatttcatccgtaaatacttcagtatctatctctaaaagatgaaaacttaaagcacacatgaccacattaccacactttagaaaatgaacagttccttaatatggtcaaatatccagtctgtgcccacatttccagttgtctcatgattaccataacttttcccttcagtttgcctgttggaatcaggatcaaatactgtgtgcaygttgcagttggtggagacttcttctgaaactcctccaatgagtaggttccatgaccgtctttctctccttcccggggcctgtgtttgtttcgaatgcctccccttggagtcagtyagcgtgctcctttgtctcctgtattttcctataaattagtgggtgtttggaggcttgtttaggtttttagcttttgtttggtttggttggactcctttctgggcgggtctgtgtggttcatcaggaggatcccaccttctatttgtccttttgcccacgttagcagtcgggaccagttagctcgtcagaggttgcaaaatgatgattttataattctctcattattttttttgctgttatttgtttaagatgagataattctatgaagagtacctttcgggtcatgtaggaaaggcaagataaccctctttatttactaatcgtaaaaataacaagttttggtttagtagactccgtttaaaattgactaattagttttagatcattgtgaactctctggattaaatgtacatggtgcattgcggtgraagctgttayggatgctccagtgatcccatcttctgcgtgtggaagcatttcaggaagccttctgtgttctcttgacatgacattgaccacttcctggatttctgatgtcacaggaaagataaagatggacagatgccccaggctcatgtggtacattggtcatctctctagcagtcacggttctcagggacacgaacataattcctcatttgctttgggcttccccatacaattctcagaagacagctccagcagagcttccaacagtgtgaccaccagaacgagttcaacgtgctgcaaattgcttttcctctttagggtgtatctcactttcggtgataaactccagttattgtgttttaaatcacatggaattggtcttctctgtgactcttctatcctggtggaggtgtacttagatacatttctttattttcaatttttagggaaatagttatataactagttaacatatttgtgtggaaccaatgtcacatcatcaaaataaattctaagagtcctggctttgattcttaaagataaattcaaagactctctctgtcactttttcaccttgtcgtcttctcttcacctataactattttttaataagtattgtttatacttgtctcttttaaatataagcaaatacatgcgaatgggtacttatataacctcctgcttggatacaggtagcttcccatgcactgtttttcgtttgcctttttaacttaggaacatgttctggaaaccactccatagtgtgggctccagaacaggcctcattgtgaaactgttcccaatttattaacaggtctcttattaatagacgttgggatcgatccagtttcttgtttttgtttgttttatgtatgtatgtgtgtgtgtgtgtgtgtgtgtgtgtgtgtgtgtgtgttgctattgaaaaatagtgctgtatagtctacgtctatctttttcttatttcttgtcaatgtatttttgggatagatgcctagaaaggaggattgctaagtcaaaagggtaatgtgcatgtagtttcgctaaaggttgccaaattcccatccataataagtgtgccaccagcaatatacgtgagtgcctctttcccaacagggtgttgtcaaactattggatgtttgccagagaggcacagcttggtttttgaatacatcggatgtaatcaggatgtgcagtctttttggttcctagaggctgactgggctctgagaagcatagaacatttcctcaagaggcttagagtctgtttaggggtgatgaggcttcctggcagttccttaaacgtcagtaaacattgttcgtgtgcccgacctggtccaggctctgttagaagctggagctgtggacagggagtccagatggactggtgagaatgtcacatcggttgaggatttgaataggccactggttttggtaaaaaggtggtaaggagtgggcacattggacttagacctcctgggcttctgtctgtaccagctctgaggtacctctcctccgtaagacgctcagcctctctgtatctgtggggtcttgataataccaatctcatggttcataggaggcgtgatggtggtgatggtggaagtgaggaaggagaggacgcaagagaatgggagacaccctggagaagccaagctggggagggaaggaagacggctcatgaggaaggccaggtttttggttgggagagacttgagcttgatgagtgtttggacaatactggccctgatgaggsagcgattgcagggacggggtgatgccgatgaagaggctggccacaaggcagaggggaggctgaaagttgtgtgaagatggctgagtgggaaagacaagcaagatgggagtaagggaggatgtcttggcctttgtgcctgagcctgttttctctgcaaggctggaaagctgacctttatggtgatatctgtttggtactgttagagcgatttgtcctgcatttctgggcaacctgtgggcagaagaggagaaggatagatccttctgatatctcctgggtttggcagttggcatggtggatgtcatgtgggtgacatgccaccaggatgtcttagctggggctactgtagcaaaacacctaagactgagtggcttcaacaatagtcgtttatgtctcgcagttctggcggttgggagtccaagatgagggagccagtgagggcaggctccggtgagggctctcttcctggcttacacacggctgccttctcgctgtggcctctcatggtggagagagagagagaaaggctgstctcttcctcttcctgtaaggacactgatcccatcatgctcctcacggccatgacctcatctaaacctgatcacctcccagaggccccacttcctcatgacatcacagtggggtttagggcttcagcatacagattcagggggacacatgcattcagcccataacagggtgagggtgcagttcttcagctggagccccaggaggctcttggggagaaaatgtttccttccctgtggggatctaggctttgctcacctgtgctgcatggtgattgttgtgaattttgaaagggactgcttcccatcggtgcctgagtcaaggcctaggacttgayggatggtgcctggcagggtcagctgcttggtgcaggttcctgtgcccatgtcatggtacgtgctgtccgctaagctccctcccagcccttagtggtcctcactgtgaaaagctgattttgagtaaggctttatcccacccagggatgaaatggcaggtgttaccagtcagggagtggggtggaaatgggtgtctgcaggggaggctgcacagacatggcggggggtggtggccagtggtcaggtggccttgggtcgaaaggccgactgaccaccgtgtgacctggccagggtgtgggattgcatctgcttccctgcccttccagtgggagtgaccctgcttggacgtagcagggggacggtggtcttggattgaatggctcactcaccaccctgtgacctgaccagggtatgggattgcagcgtgcctcctcatccctccagtagggatgaccctgcacggatgaggccgggggcggtggccttgggttgaatggcccactcaccaccctgtgacctggccagggtgtgggattgtgcccggcttccccatccttccagtggggatgaygacaggcatttgctgagttccatgggactgtggaaagggctgtgtcactrtagacgctccatcggaaatgctgatgtgtattcttaccacgggcgtccgtgggccaccattgtctcctggcatctggctgtccttggaacccagcaacacccagggacttgggctgtgatcagaagtcctgcccagagcgagtagggtcacgccagagtgaggctggggacagcatggtccactgtggcccagatgtaacttttagtcctgccttcttatccggtttggcaggaacaggacagggtggttagcaggccacagtgtggtgggagtgaaagtgtactgtcctgtgtgatatttttgcacagcctgacagtgggggcaagtttagagcctttgagctgagaatctggagagagcagtggatgcgatgggcagttgcttgtccttgctgtgagaagacaggccacggggctgcacccagcccccatgggtaagtataacccccaccccactactgcccgcccaccatgccttccccacatggatgagttgctccctcctataaagtaggaaaacatgcttaccgctggagaggatgcctaacaacagctcctgctgcccagcgaggaagggacccygtgtccaagagaaaacctgatggcaggtaacacatcacccctctcttttagggacctcatccctttcttttagggaactcattggcttgtcttggacccaaacataattagtgggggtaggggtgaggagagaaactcttcagtgaacagatgtcttcttgggccgattgttggatattgctcaccagctagttattaaattctagaaaaactaattctttgtgcagattctargtaaaatgtctctgttgcaaaataggatttttcaattaagaaaagctttaaaatatatcatgtgttcctccttagtctgcagaatctgaatgtcaccttaaaatgtcagggttaaatttcttacggttagtacatgaggcaggcgtgaaatttacaacagaaaattgagattgattactttcatttactttctcttttttggggcagtaactgtttaatgttaaatttgtattgtatgtcggtgcctcttttgaaactggagatattgatatgatcttaagcaaatgtctccaatacgagaaaaagaggactgatttataaagtggaggactgayacataatgtggaggactgatacataatgtggaggactgatacataatgtggaggactgatacataatgtggaggactgatttataaagtagaggactgacacataatgtggaggactgatttataaagtagaggactgatttataaagtagaggactgacacataatgtggaggactgatttataaagtagaggactgatgcataatgtggaggactgatacataatgtggaggactgatacataatgtggaggactgatacataatgtggaggactgatttataaagtagaggactgatttataaagtagaggactgacacataatgtggaggactgatttataaagtagaggactgatgcataatgtggaggactgatacataatgtggaggactgatttataaagtagaggactgatttataatgtggaggactgagaggcagttggatctggatggctatttttcaaagtcaaggccactcagccagatgaatccagaggcatatctaggttctcttgattgacaggaacctgcagaccagctgtgctcttggtcctgtggccttccatgggagagggtatgggaagggctttggtgcaccacagatgtcttggyctgtctcttccgatgacttccctttgcttataactcacacctgtttacttggagactgtgaattagatttttagttttgcagcaggaaaatcatttgaaattatagactatccctcttgaaatctcattacataaaaagatttaacaagcctcttgtgaataagttagggtgacaaggaatgaattatttggagaagtaaaaaaaccttaaaaattaaaaaaagtttttacaagtaataagaactttacaaaattactgtgtgtgtattaatatcaaagggagatactgatgaggacctgaacaacatgggtgatgggtaaaaggtcattgccaccctgagtttggaaatttgaggtgctcgttgctactttgggttcagaatagttatgatttatgataaacctaaaaattaaaagtaccacagttttctctcaaatcgtatgtgggtgggttgtgtccagaaacaaataggaaagcttccacagatggaatgaaatagtggaacagatatggtgrttttgttttggaaaggatttgtctccaaagttttggggtggaggcattctagtcttgtttttcttctgagatggaaacactggcaaacttggagtcttctgcaaaactgtatcaagcaaaagtgaaacagtagttgctgtgtgacaagttagtattttgtccatgacatgyagcaatcagtagaaatagataaaggatgggatattggaaaatcccctggagatgagaaayggtgggtgacatctgatgagaggaggaggattcagggagcagaatgaagacattggccaggcaagcatctcagtgtggaggtggggctgcttagacatttaaattgacctaaatcaagcagttattaataagtgggcaaaacaccrgaaaaattgcactccattcctgtgcctgtcagggctgttctattatttggaaacagactttacttacttaccttattgattgagacagggtctcactctgttgcttaggctagagtgcagtggcacgatcatggctctctgtagcctcgacctcctaggttcaggtgatmcccccaccatagcctcctgaatagctgggactacaggtgtgcaccatcatgcctggccaatttttattttattttattttttgcgtttttttgtagagacgaggtctcgctctgttgtcaggctggttttgaactcttttgcccaaaccatctgcctatcttagcgtcccgaagtgctggaattaccgtagtgakctgccgctcctggcctactttaaacatctataatttgtgttcgttgtaggattattcacggtagaaacagggtggaaaaaaatgcccacagcctagcatttcaaggtgcagtgttttagttcttgtgtctgtcattacagatgtgctttacctgctcccattcacaccttagaacagagaggctcctgtgtataaaggtatcygtaaagcctcatgccctgcatttcacatctagcaayatcataagtagagcatcttcaccaaattctgtctgtatcatcttgagtacacagatgtgtcataactagccacacttctttggacatgtaagtygcttctcagttttcactattctcagcaatgcagtgaggatattttcatgataacctcattaggctctttgtgatgttgtcctggatctgtcaaaaattggtctgtcagaaatttgtttttaacaataatagctatwttgttgcattaactccagaaagttttaccaatttaccctctaaggagaatagacctccttccccatcccccccacattcaggactttgcatctgagggggaacctggccacgtggttggcattcctgagccatgccaggctgmtggagcgcacaaattctttcaccccagcaagcccggctccatccaccatctgtgcactcaggccccctccccctcccccgccccctcccctcccactggcggtttcatttttatttcttaggctttataaggatattgattatggacttttggctgatttcagatctagaattacagagtgagatggaaaaatgacagaaatgcagggaaaagtcgaagcacagtgtgtgggagttgcatatggcgagatgctcgagagattgtcattttccttaagtcagtgaaagattgtcttctcaataaatgatgtttgctccgcttgtttcatatagtagctgtaggagaccatacctctccagccttctcttgtgtgcatttgtatgtggggttaattttttgtttgttttgagaagacggagtttcgctctgtcgcccaggctggagtgcagtggcgtgatcttggctcactgaaacctccgcctcccgggttgcaagcaattctcctgcctcagcctccctagtagctgggattacagtcatgtgccaccatgcccggctaatcttgtatttttagtacagatgggattttactgtgttggtcaggctggtctcaaactcctgacctcaggtgatcagctcacctcggcttcccaaagtgctgggattacatgcatgagccactgcgcccagccagtggggttaatttttgtgatcrttgtctggctgttgattattacttgattctcctgctgtgtgtcttctctctttctgagagccacaaaacaccacgtccccttgcctgagtctctagctagctctgtggcccctaggccacacctctgctgcctggtaactttccttgctgcgttgtgacagagcccctgtggccaggcaagtgttgccttggcgctggtcctttctgtgaatatggtggaaagttgatctcagtccttccagggaactagtcttacagtatatgctggaggctactttgtgctgatggttgtaatagccacaatttagtggacagccactgttgccaagtatcttatgtacattggtgacctcttataataatttacaaaatccatgctgtcattgccattgtaaggattaaagtggcaaatagtgaatccaggtttggtgtccaggggtgcctgatcttagagcctgtgtgtggggattgaactggcaggaggtgcagatctctcaagcaggtggggtgtctgtgggacaggggacagctgtgcagtcagcatcagactccagttaatacagaatgcttgacagctcacgctccccacatcacaaaatccaggacctggaagggagcagtgagcacccacattgaggttatttcatgactgtattcacctgacccccactgatgacctcccatgtgaggtgcacacatttgtctacatgtgaatcctcagctctggactgttgggaattttggaagtagtggctgggcagccgaggaaagaagtgaagctgggtgggcagaaatcgaggccccaggcccatcagcctgagtggttgggaggagagcttggagctggggttgtacgagaattgggctgggcaaaggcagtgtccaccttgttgggtgatgaggatgggattcaacaactacctgtcctctggagattgaaaggttaaaataaggcttgttggagcctttgccatctgaagcttctgtatggttttggggtcaaagtaggtttggggaggcaaaaatgagcccccagacactaagaagagaaggcacaggacaggccaccatccatcccctgctgtcccaaaactgacaagtctcgtacctctgacagtaaaactccccgtargactacaagacgtgggtcttggagctgcagttggcctcaaatgcaggttcacgaactgaccagagccagctgctgcagaggctgagctcattcgcagtcttggtgtatctgaactcatgattgaaagattttgatgtacagtcgacttgccatatgcctaatgtgatatcccgttagactgtgcttccgctttagataggtagtagttacaagggctttcacgggagcccttgtgccttagtccctgtgtccgtttcccattgcagctgtacaaggttaccccagatgcagtggcttcaaacaacacacatttattctgttatagttctggaggtcagatcctaatatcaaggtgttggcagggccgcgttccttctgcaggctctagggaagaatttgtttccttgctttttccagcttctagaggctgcccacactccttggctcatggccccttcctctgtcttcaaaaccagctgtgtagcatcttccgatctcttcttccattccactccatcctgacgtccccttctccggctcctctgctttcttttttcatttgataaggacccttgtgattacgttggacccatctggataatcttgaatgatttccctgtcttaaaatccttgacttaatcacagcgacagtgcctctttatcatgtaaagtcacagttgcaggttctggggattaggacttgggcatctttggggagggtggtgtctgcccacctcagtgtccttcctctgtgtttctcctgagggctgactcttccctcactgtgggagaccctgcacacctgctgtcattggggctgagccagtcaacaccggttgagggtagggggacactggccaacccaaaggctcttggcggtctccacagacttccacttcagtttagaaagtacagtgagaaaaccagtagctgaataaagatttagggtatttggcacagatctgctaatgcacgtgtccgcaaatctagactcagcacaaggagtcttagtttgggatcacaactgattctcctggtccagtgatacctctgggctcttgttcattggctggagctctcctttttgctgggaggcagtgcttcatcttgcagttcatgagatgactggcacttttgcagccggcctcacactgctggttatgtgcatggaagaggtctcatctcactccttcctatggcttttctagctgggcagactctggttcctgtattctccccctcaactgtagtgttgaatgttcactgcccatcctttctgccctgctctgtggctgcctgtcctcatctctgcatcggtcttctcttttcatgtcctgtagctcatgagtgacccgctcccatgtcacctgccattttggccttgaaatttggtaatgattcatacatgtgtcctcgcttgtgccatatccagtgggacaagggaattgggacacctttggttctctggtagctttgcctttttttttttttttttgagacagagtcttgctgtggcacccaggctggagtgcagtggcgcgatctcggctcaatgcaacctccgcctcccgggttcaagcaattctcccgtctcagcctcccagagtagctgggattacaggcgcctgccaccacgcccagctaatttttttgtatttttagtagagacgggggtttcactgtgttggtcaggctggtctcgaactcctgaccttcgttgatccatgtgccttggcctcccaaaatgctgggattacagacgtgaacccctgcacccggcctagctttgcttttaaattgcaagctgggactccagccctgtgaagtggctgtccgcattagatcggacacctggcagacacttgtttaagttttagaattttaaaaaggaaaatacaggagaaaaagtagagttgatcacaaaaagtagattttgcaggaaatagtttaacttttaaaaaagttatcaatgtgttatatgcaaatatggaaaactataaagaagaagaaaacagttgcctataattcttctagctggaggtacctgctgttactcttggggatgctttttgtttttctacctttgtagctttttagtttttttctaagacaaagtctctctcttgcccaggctgcagtgcaacggtgtgatctcagctcactgcaacctctgccygcccagctcaagtgatcctctcacctccacctcccaaatacctgggactgcaggcccacgccatcacacctagctaatttttgtatttttgtagagatggggtttcacccagaatggtgtcagacttgggtttaagcgatcctcctgcctcgggctcccagaatgctaggattacaggtgtgagccactgcacctgccctacctttgtgttttacgagggttgtatatgtatcacatatgcagtggtttgtccagcttttctcctacagtgacatttttctttgtcctcgccttttcataaactgtctttttaaatgtttgcttgatatttaatcatggatgtattgagatggactcatctcaaactatattaaaaacactctggatgctttaaataaaaaatggcaaaagttaatgttgtaagagaagtgaaaagaaaaccaagagctcctacctgcctcagcttaccctttgtttggtgcgtgggtgcagtgggcagtgagccgtgccattccctcctggcagcyggtgcatggctggccatggtccttagcagtgactgtgaacagccgtgggctactttgttacccacccagtgctgcttttgtatgttggcaaatggggctttcgctttccttgrtttgattctgtcattgatgcttcagactagtcatgcttttgtttgaagggaaaaaaaaatcaatcaatcaatatcagtaacttgctatagatttttataaaggaaaaaaccccaccacatgtatggtggggagtgagttgatgtggaatcagtcatgaccgcgttgagttaggagcatcgcggatgtggagttacagctctgctgtggatgtttttgttttaagaaaacatcttttaaaaatctaataatggttcattaaaaaccagaaatggtcaagctcactagaaaccgtcatcagccacattctgatgaaagaggttttgactttcttttttaaaaaattaatgaagatacatccaaatatttgtggcaggcaggaaatcaagcggattttaatgggaaattatgtaagaaagcttaatgactaatttttctggatcagacaagtggagaacggtcttagggaaatgtgtacatccattactcattagtttgctgtattataattactgttgtataggaagaagcatgtcagataattaggaactgggtggcattttatgctaaggatcaaaacaaagattttgcttggaatgttgagcaaaattatactctggctgagattaaacacatggcaagcatcctactccagtatttaaaatcatcaggcaggctttattctatttttttgggtctttgttctttcatgttttcctctaatgaaaaggaatgcttagaaaatagcactgggaggccagcaagaaatcagtgttgggattttctcatgtgtgaggagctgttactgctcctgtcgcctggtttcacccctcggttctgctcccaggagctggacccctccccgctggcccctctgtgctgcaagcatccattttgggcttggggataatggtcaagagagttggttggtttgggctgtgggctggacaagcgcttgctgcttaaaccatgttgattgtggcttaactgctgaaccaaaccaatacttcatccaaagaacttctccagggagggagtgggcttcaggggagccacatgggaagccccctaaccaacatttctgtagcacttgattggagcctccaaacaccgtcgctgtcgatgctacagcagtcctgtgggccgcagaaggagtactcactgtgtgttctccatgcccttctgtctctgagaagcagcgtggcgtgttcggattgtgccctcctgccgaccccggtggctcaggcaaagggcttgccagatggtcggtgttctttgccaaatgggaccgatagcgtgcgcatggtggggatgaggggaggactagggaagtaaatacagtgcctgctgccacgtcaccttcacacagtccatgtttaataagaggtcgctgctgtgatgatagggggtcggccagacatgtccactgtttaaaaagcagcatccatctgaggactcattggattaaatgtacacctaaaaaaaatacagtggcacctgcatgcagtgcccgaggatgggtgtgctgttttactagatctggtgttttttggaggtgcacatttggtagttcattgttgggttggtatttgtctccataacctgtttcagcctcaaggtcatttacctttgatcagtgcttsaagcttagcggtttgtttatatacatgttcatgtataaattatattactcagtctgatcataatatatgcccagtgcaaatcatttcattaaagcctcagggatacacggtgccaccgtttcctcattcagggacacgrggatagtggtagtgtgtcttcagcacgacatggggaaattcaaaggcagccatccgtggaagagccaacggcagcccgtgcaggcgtcagcgcctggggaatagtagcagtctacatctttagctgtcagggtatctcgttgtagcctcatcctgccctctttaggggtccttggatgagttatcagttgyagtattgacattttctgtaaatagtgtcactcaagcgagtgacagtgggaagcagacaccagcccttagggagcagcccaggatgcttttttcctccaaatgcctctcacctattcccagatactcgctggagttggagcacacatgtcwgcagatgtaaaacgacctgctcccccaggtgaatggattctcgccagggccaatacttatccgcaggggtgtgtgccaggcagcccaggtcagcctccctccaccgggccacccgcaccaggttgcctcccatcgtttgcaggagcggaagacccgatggagcaggtttcacagtgccctcgctgctgcctcccgtttcatctgcacgtctctttcaatgcgggcgtgcgaacttccaggtagagccgagttcaagaaaatgaagtactgcatgcgacgagcaagtttattgaagagggtgtgaggtcgcggcgcctgaccctcattatgtcagttactactaaatgaaattagaacttcactgccctttttctttttcccatcgaggtgcaggaggaattgatcttagggtagtattttggatttaaaaaaaaaaaaacatgaaatgaaatccgtgtcctctttatcctcccctctctctgttctgcgcggcaggtagcaaggaacggtggcggggccaaaggtttcctcaaagaccctgggggccgggcggggctgtgccaggcacccgcgtcgcgctccagctccagccctttaatgctctttgccattcaagccactcactttcattttctatagaaaagcctttctgccgcctttcacaaaacttgtattttcatgcctaataagtgagcgtgtgacatgcagtgggctcagtctctgcatagcccggcaggcagcggctctgctttccagaaccttctgggagtggcagacacacattaggagtccacgcgcaggtagcctggcctttgaagctctccaggctctggccacagtggctttcctgccctccttggctggtggacgtaaggcccctcgccccatctgcttcctgctctcccagagccggcctcaccttcgagactcatgctactaagttgtctttcagttcccctggtggtgcctcctctagacccctgaggagatggagggggctgccttctttgcggctttctcacgatttcctcacagtacacacagcaggaccccggggtttgtgtgtggcatcctacacacacacacacacacacacacacacacacacacagcaggaccccggggtttgtgtgtggcatcctacacacacacacagcaggaccctggggtttgtgtgtggcatcctacacacacacacacacacacacagcaggaccccggggtttgtgtgtggcatcctacacacacacacagcaggaccctggggtttgtgtgtggcatcctacacacacacacacacacacacagcaggaccccggggtttgtgtgtggcatcctacacacacacacacacacacacacacacacagcaggaccctggggtttgtttgtggcatcctacacacacacacacacacacacacacagagcaggactctggggtttgtgtgtggcatcctacacacatacacatacagcaggacccccgggtttgtgtgtggcatcctgcacacacacacatacacagcaggacccctgggtttgtgtgtcgcatccttcacacacacacacacacacacacacacacacacacacacacacacacacaccccttgcttatgtcctccacccgtccctgaaaacatgaggtctgcgaagacgtctttgagtctgtttggcatccccaagtgcagcggtgaaccagagagagagggagcattcacttgattcttcacgcgtcagtgtttttaatctctgtggctggaggacagtgtgtgtcaccttttcttagtttccagggactgcggcttccttccacctctcccttccctctgtagttggacaggccatggctccccagttctctgctgtgggcaggtgcaggagcctgaccaactcctccgtgagtccatctatctgtgcgtgcatttattcattcctccctagtgaggcaggtccctgatgagcagctcctctgcgcctgcccaggtccagcgttgggcatgcagtggtgaacaaaacagactcaaacgcatcttcacagagctcatgttttggtggacaagtggaggatataaacaataagcacaatttagtaaaacatacggtaccacagctagcaaaggtggcaaggaaaacaatgagagcgggggtggtgtgaatgtgtgtgggtgcaggggcacctcgggagcctggccgggaaggtggcatccgctgcaggcccaggtggggagatggtgggtgctgcttccaggcccaaggaagagaaaggcagaggccctgaggaagcacagagcttgagggagagggctggcgtcagctcagggaagcagggaggccaggcggggaggccaggtggtgtggggcctcatggaggctggggagtcatgaggatgtgggaggatgggggagctctggttgctcaggcagtggggagaggacagcaccatggtaacatgcacttgtgttcatgtcttggctgccccattgctgggcacgtgtaaaataggagaaatcttaaagcttgcagctctccatgtgaaaatgatctgtttgtttcttcttattactatcaatattaatattgatcctgtagtgctttcacacttaaattgttgagttccmagtcttgtctaataattatctcagcaattgcgataccattggctgaggttcatggaggttttcaggctratgtcactgaatgatcggaaggactcactgctggcagtcacttgtgtgttttgtgtttttttttcctctgtctctcgccctccatttttctgcacggcattaagtcagccacattttagattgtgtgcttctgtcatcagaatatctggcatgctttcccctgaatagcaggcttgacatctttttctgatattttgtaccaaccgtactaagaggcttcttgttagctgttaattcatattttctgaggctgctaatatgcgtggtagagccattactgttgcatgttcaagataaaagccaaatctcagcttataccctgttctcccaggataaattcagagaaccactatgaagtctaatccatactgtgatgttgctgaaaagaaaatagggttataggcttatttggagcctttcactgtttatggttgtacaagttgggtgttactgacttataatgtaaaatctgaatttccagggcagggacaagattcgtttttggctaaggcatattgtgtctgtggggctgctgaaggaaaaagagcatcttatttttatgtgattagcattattcaatcacaaaatgcattgsattctactcagactgtcggagaatatgcttgctcctctcctaggctctggaggaagaacctcagccactatgtgtgtgtgtgtgtgtgtgtgtgtgtgtgtgtgtgtgtgtgtgygcatgcttgtacgcctgtgcacagagggtgggaagagggcttgcacctaagtcctagggtcctgttctctgcacagttctctgcataggtttccgcacgccttgctgtctcctccttgttgcaggcatggagcaaattatcacctggtggtaactccagtctccgccacggagactgcttaccctcttcctctttggttcaggctgaaccatcctcactcatcttgtagagcctcccgttcccatctcckcatcagagtttcctactttccttgaactttcctttttgaggagatttgagaagtgtgttgtccaagataggatttagtatcctggagccaggcttggaattctagtgtgggaaagcttacttactattactttattatggcattttaaaagtttttaaaagtaagtggaaaaaggatttttgaacctgttattactttcttatagcattttaaagccattttttttcctagtgggaggcagaaggaaaaactcggtcatgtttcactcactcctttcttaaagggagagttttatattgtaccttcttgttcacagccaggtggcagctacattgctaattgcaagctttcagggtgagaaagagaacccgtgcctacctgccttttcctgatttgaaatggtgatctgcgttggtctcaagaccttgtgcagcctcgcagagattgctctgcacacatgtgattgcatctaatcaggactttttctgaaactgctgccaggaaaatgtgtgctaggaaggttaccttctgcagctggacttttatgatgcactggattatcatggccttagatataccatcagggcatggagtggcaacagtgctttgctgtcttgacgcatctcaggtagaggatctcttagggagctttctgattgaatcccacgcccattttgagggaagggaatgggccatgggtctcatccctgcctagcgctgccttgtgaggggtgctggcctgtcacctccagttcttgctcctttttaggaagccatgctgcctccttccttgttgtgcgattattttttgggttgtgtctattttggtatttttttctctttcacctcctctcccatatttcccctctagggtgggaggaaggagacccaggtgtgaggtggtgcaggtggctgcagtgtcctcagagatactgagctgtggggtagaggtagctggaatctagatcaactcacctctcttttatcagccatttgttctgagaagagaggcttcgaggagagacgcttcggtaaggggttgctgtgggtcctggggtcacgggtgttagttctgggtgccactgggggacacgagagacagaaaggataggaatgaaaatgaagagcaactaagggatgtgaagatttctcttgcacttgttttcgggataggaaaacaagcccttttagtctggggcaaggaagtgtctagtgcctccacctggtcatccaccgcggtcctcctggtctccgttcaggcccacaggactctggaccgccccatccctcccagggaactgtcccatgtcctgctcaggaaggtggtggggaaggggtaggcaggatggacagatggacagtggcaggtggggacacctccatctcattttgttcctctcaatccgtttgtttttttctctccctccctctctcctcttttttttttttttttttttgagacagagtcttactctgttgcccaggctggagtgcagtggtgcagtctcagctcactgcaacctctgcctcctgagttcaggcaattctcgtgcctcagcttcccaagtagctgggattacaggcacacgccaccaacgcctggctaatttttgtatttttagtcaagacggggttttgccattgttgaccaggctggtctcaaactcctgatctcaggtgatccaactgcctcggcctcccaaaatgttgggattacaggcgtgagccatcgtacccaacctcaatccatttctttatcctaattgagagaatttgaaaagaaattaatagaatcaaaaaagagaaaagggcctggttatcagagatgcaaaataaatgatgattttaaagatgctagaaagctgtgctccctccctgggtgctttctctttggaggggaatgctggagaaaatctctacaaaatcttccccttgcagtgctgggagagagtaatggtgagcaaatccttgtagaattaaaatgggatgaagagacccttatgaagggagaaagcaggtgaagatggtggggataggggcgggacrtgcasccccttcactttccatgccgggcagtataaaaagtgagaagaaacacttcagggctggtgtgtaaacttcatgttggataaatacgtgacttctggtattttgggggcatggaatcaaaaagttgcagatttggagggatgtttgcagccactttttacccaacatggctctctatgtggtcattcagttgcttaaacaaagtctgggtagasttacaatttttttttaatacaagtaatatttgcttatagttttaaaaaagggagtataaccatcaaaagtaactctagcgaatgattttggaatattccagaaattttctatccttatataagctctaaaacagttaaacgcagtagctctatttaataatcaccattgggcacgtggactttcatcagtacacatagatttgcctcacacaaacaagaatgaacttgaatgtacagattaagggataataaaaatgccagcctggctgccatctggctgaggagacgttttacaagaacctttgaagcatcttgtgggcctcttctccatttactttgcttccactcccaacccccttcctaaatcttctgtccattatttcctttttccattcttattctttttttttttttttttttttttttttttgagacgaagtctcactctctcgcccaggctggagtgcagtggcgcgatctcggctcactgcaagctccacctcccgggttcacaccattctcctgcctcagcctcctgagtagctgggactacaggcgcccgccaccgtgcccggctaattttttgtattattttagtagagacagggtttcactgtgttagccaggatggtctcgatctcctgacctcgtgatctgcccgcctccgcctcccaaagtgctgagattacaggcgtgagccaccgtgcccggcctccattcttaattttatcacttaacatatttgtatctatatctgaatctctatctcattatgtatataatgtccctaaagtatatattgctcaattttacctgtttctataaactttatatagatgtaatttacctgtatgtggttctgtgacttgctttgttggctaaacatgatttctggtaatgagtcatgataatgcacgtcgctatagttcatccattttcactgctgtataatattctacttaatgaattgcatggtatgacctccattggttcttctaacggctgcattatttatttttttctgcccacactggatattatcttgacatattaaatgggtaaggacctaagttgtgaatgatcaggttgttccaggatggaagttgttatcctttgtgcaaacagggttattgctctcaaggctagaactgtttgtgtgctttgtattttcactttcattttttgcagctggacttcagagcaagacctaggaagcaaagtgcagttcagacagtgggtcccgggggaggggscagttgtcagagagcccggagttaggtgtttgaagcctagtgagcagagacccatcctgagcataagggccagggccagggacttggccttggccttcagggagcccgcccttgtgtggataagcgggattgaatcctcagatgaaaaggaagcaatcaatggagctgtttgctcctgcagcttcagacagcgccatctctaccggatcaaaagagctcatcaactcccagcctccatcaccgaaaaagaaagtctcatctctgtctgataatacctattcattgttaaaaaggaaaaatcccaaatccgtacatcctcctgacccatgtgatactgatacatacctttgatgtgtccattcagattaaaaattcttaacaaaatgatacatattttacatgtacaatcatttcaaaatatagactgttctgagaattgtttgcaaatatgatcataaaaagttgattttcttggagactttaaaaaactagtttgttgtatttgctttgtcaatctctatgtaagtaatatatgtgtatttttgtgccaagccatttgagatgscctgcaggccccatggtgcttcagcctccagcactgctccctgtgtttctcagaccgaggcccctcctgtaaaaggctctgaatctcgctttcacctgtgtgaattgcaccacccaaggggaggggtccagttgcattgggcttttgtccttcgttttcctgacctggggacggtctcctggaagcctgacttcctgtttgctgagggtggacttttctttgggacctgtttgtcgagttgagccgggagccacagtcattccctccctgggtattgtgcgaccctgctcccgcctcctccccctcccccccccccgccccctgcccctcgttgggtgttgggtgttgggtgttgggtgttgggtgttgagtagcccagggcttctcyttcctggctgggatgcaggcagtagtcatatcatcacagtcatcaacagccaaagtgactcagtgtcgcccacaggttctgagtgggggcttgactgagccaggcagcatcagtgagaaatgcctagtcggaaggtacccgttgttcaggatgaagttagtggcttccctgccattcggtttccactccaggagagagttgaatcagagcctggaattctggctgatgggctgtgtccccgtgtacggggagaactgctggtttcagtcttaaccaggggacgaaggacatggcagagcatccagagaagaagctggggctcggcctggtctacctggctgggaagaaccgtgctggattgagctctgcagcaagggctgtggctggccggggktgtttccccggcctctccccagcctggagctgtggcgcaggtgcctgattacagtgcttgggagagcagtgagggcaggtggggggttgacctcactctccaaggatctgtgtttcctggagcccttcttccctgcaggcctaggaggctgggctgaaaccacctcgggcctgtgcatctgtaggaacagcacragagctccttggagtggtagtgtcagggcggtagccatctgagctcacactggccctaggggctgtactttggggtatccaggggcaacacgtgccctctaaaagcatagacctgtcagggaatcacgggatggttccagggtaatatctggtcaagggcttgcggcagataggaagagttctctctctgccgcctgtgcccaggccactgctgtggcctagatcgggttggctctggcygtgccccattcctcatgtgctggctattgagtcaccccctgcccccactttaaacaagcatgtttgaatgcagagcgattcgtggtgacagtttcataaggctaacgttgaatatgctcaaatgcttaaaaggcatttcatttgtgaatggcagcatgtctttatgrggggtgacagattgctcagatatgactttccctggttttcaggaggggtctctycctgtccagtggtccagggctggtcaggcggtgtggcaggaacggagccagcrgactccctcttggtaaaattgtgcaagaaacgcaccacctaggtttgtgcctcctgccgttgcttacgaggttctgagtcccgcagggactggctttcttcctctgtaggagtttcctaccatgtaagttttagaaggaaaggatactctttggggcctcagcggtccccttaggctgagcatctgaaccttcccgtggtccgtgtggctggaaggaggcttccatcgctggaaatccatttctcaaggcgaggagccagccgggccgaccacggagccccttcctctattatgcacgaagtcatccaggtgtcatcccatcagtggtccaccaaggtgggacagtgcagcttgggccgggcagaggtggggaggcctgctgggtacccctgctggattgtagatggcccccaaaaccaatgctgcctctcacaggaagcccttcgcctgaggctctcccacactgcaactgtcaaactcgaatttccagttgatgtaaaatctgtcttcctactggaatgttgacttgaggggacctttcatctcagatttcagacttgctttgtttctgttgggtcacgttgctgtcttctcaatactcgagtattcttggtgtggtggggaagtttttgagttaaatttgaatagttttaaaatttaggtttgagtttagcagtattctaacggggtaaggcgtcacttgacatactgataaatcttttacattctatatagtggaattagacaattttctgaaccttccgtcccaaccttccatcccttaccctggttcttgctactttgttgtttagatcatggtctgttagcggaaatatgactccatgtggtccatgatatgggcaccttacaagttattctaaataatggcacttaggttcaaagggcttgttaataatagtgccattgaggaaaatcatttgggccatcacccccttctcatgttgaaaatagcgttaagtgttcaagagtgtgatcggtgaaacacagcttaattcagctctacaggtgtgagtatttagccctggaaaggaaggaatgattattgcagggttagaaggttcaggagaacagtgcctccctcctagtcacagttctgcagggctggcgtgtgagcccttacttagaggtttacttataggaagtttgagactgagccagaacctttctgggtctcttgcacctgcgggggaagtagtagcagctggggttttctgctttagcacattgttagttttactccgactccgttgctgtttcccagagtcatttgctctttctgaagacactggcccgtgggcrtcactgcccttagtggagttccttcctggaggctctccctgcagattctgcctctggaaatcaacacgtattgcccctgtgctcccccggattacttggctggagtcctctttccctcctgtcacctgcagtggcattcttcttccagcctgtgggatgttgctttatgctggacagagctggattctgtcttggctctgctggtgctgaaagttccccaggcccaggaccaccatccacacacctccgatatctggtgaagcaccaggcatcgtaggcattgctgagtatttgggygactgacttctgagcatgaaggcagggagggtcccctctgtctggatggtaccccacccttcgcccctaggcaccttggccagaccctcctcattcttcaagattcagcagcccttgccttctgtgaggagtgagttaggttycatctgtgcccagctgtgctgtgtgctttgcaaatgaactggaacagtctgtctgtgaaggggatgtcagaaattcaaggatgggggacagctgtcatcaaagcaggccacaccaatctgggctgttctgctagaattcagttgatttcttattttgtgtgactgttgttcatccgagcccaaggtagagctgcaggaaccccatgtctgagtgtccagcaggcccgcaggccctcgggtgccacctgatggggccatcctgccttttcaggtccttgattatatcccacaaagagaaatagatggcttaaaagtctttttcagaggcagaagggacaagaaaagtggaagtgtagtctggaagtagccaggttttaagttaaccaggttacactcttggtggttcctggcgtcctatcaagagaaggaattatggccccagagctgtgcctgggacccgcatgtctgtcacagatctctgctgggaagccaggctgtggcccttccaaggtgaatggtggtttccatccagggttcaggtttcttagcagctagtggtgacggtcagggtgtgagtgtggggacgtggctggcgtggtgacgggtgtgtgggggcatcattgggagtgatggcgatggcttgtcttctcaccrgccggtttggagtccagaaccacatgaatgacctcagggtgggtcagaacaaggagctgtcagtctgagacctctcagtgtgctctttcttggctagcaagttactttaccttggtagtcattagtttcttctttgactaaatgaaaaggtttttatctagatgctgctgtgcatcttgaagcatgttaaaagaaggttaaggaaaaccagtttgtggaagctgactgagcaggcggctcactggccgtattcagctctccacccgtagggacctgctgtggcagccataaaactgtgcagaggtgaaccacttcagcagaaagatgcttccccacagagatctgggagcctttgactgttgaacagggaaaaattccccatgcttttaggatcgtggtgtaagaccccactgtggagagatgctttctatgctgcaacacagaccagggaggtgacgggcagtggctttgggacaccatcaactccaaggagatggcctagctgcttgaggcccacgtccagagttacacactttattcttctgattcttgaaggctttaagaaatctctttagcaagtctctacttctttttaaattttactctttcctcctatcacctgaataaaactccaggcagtaatatgctgcttacattgacttttttttttttttttttctgagatggagtctcgctctgtcacccagactggagtgcagtggtgcgatctcggctcactgcaacctctgcctcccgggttcaagcgattctcctgccttagcctccagagtagctgggattacagacatgcaccaccacgcctggctaatttttgtatttttagtaaagatggggtttcaccatattggccagattggtctcaaactcctgacctctggtgatctgcctgcctcggcctcccaaaatactgggattacaggcacataccaccacgctcaactaatttttgtattttagtagagacggggttttgccatgttggccaggctggtctcgaactcctgacctcaaatggtctgccctcctcagcctcccacagtgctgggattacaggcgtgagccaccatgcccggccatgagtcctttctactgtggggttggtcttatttccccttgctcccgtgagaagctgaatttgcaaatgccagggtgaacttggtaatggaggcaacaggcagatgcttggtgtctgtgcgttgaacagaaaagagcccggtgaaattccacgmctgtttgtgtttagcacacggttcctgaattatttcatgagaatgcaggtatagcggtgacagctacaatatttgttagccaagctgyggacagagggttggcctcaggctgctgtttctgccccagggtcgtgagaaatagctgtgtccattttaaagcaagaaaacaaatggcacgattgctctgctgttcctgtcctagggcagagagctaagtcaagcactcagtggactgcgtctcgtctcccttggactggtagtgacagggctgccctgcacgccacactgctctcctgttcctgtagtgtcgctcatgtaaaatgcactgcaggctggtgctgctgaatcggctcactttctcccatttccttctcctccactttcagatttctttcagcactctccaacttaccttcagaaatgcaacaatgggccaggcgcagtggctcacacctgtaatcccagcactttgggaggtgggtggatcacctgaggtcaggagttcgaggccagcctggccaacatggtgaaaccccgtctctactaaaaatacagaattagccaggcgtggtggcatgcacctgtaatcctagctcctcgggaggctgaggcaggagaatcacttgaacccaggaggtggaggttgcagtgagccaagattgcgccattgcactccagcctgggcaaaaagtgcgaaactccgtcttcaaaaaaaaaaaaaaaaatgccacgatgtatgaagacctgcagccccttatctggaattcaaaaaccccaaagcactgatttttgcagcccactcatttggcagcagaacctgagttatctgctcatgtgagagtgcacctttcattacaaaagtacccatgcgtttgactaggggtgctctgggacgtgggttagccaactcaggccactgccccrtttttgaacataaagggttattggaacacagccatagcctttcgcttatattgcctttggctgtgtttgtacctggtccttacagaaaaagcatctgtacccctgctctggagcggacctgccctgctttgcttgcaaggtggtccgagcctgggtggaaagcactgcagggcagcttgtgcagaaactgggacctgctctccttgtagagacacaaccccagggtacttggagctcatgctaatgactaaatcattcaagccttcttcttcctggattttatacctcctagttctttgaggacagtttgccacgttcagcaggattttccagaccttttatttctaaggaatacaaactagaagggcctggttyctgtaggtgacaaagctggggggaacgtggaggacagggatgactggagagagctggcgagtgcagcctgctgggatgccagctctcacctgggaaggtcagcgtgcagggttgcagactgcttaagcctcctcctgtcagaggaccccagagagctcccccagctacttggagagatgctgttgaggttgggaggcaatgcagggtgttcatcagccagcatgagaccctcgcttccagcctgtgcctttagcccagccttgctgttctagatggtgttggcagcctttttcacgtacagagttgcattgctcstccgtcttccgcgtgcctgtgggcagcttttgttcctttggattacttttgtttctttaaaactccttggcaccatctaattttttaaaaatgagcctaatactgttcacgttttagcacctggcaaatgtattgatactttacgagcattcacatgcrtttaagagtgcycttagcagttcgcgttctatatagaactgtttacacctctcaggattcttactctaacaaacaggtatagacaacatcctagttgcatctcaccgcggcctaacatccccgggagcatggggattagtggagtgagtgggaggactygccctgcgcaggtggagggtgatgagaggctggggacgttttcggatgaccacaggtgtgaagctgtcttcagtggtgggggaaccacctgggccttgggccttggctctggtagtctcacataactctttggtgtctgcagctgtataatatgatggatgtccttgtattgtacatttttaggaaggacgggtagggttgctgcttcagagatcaagtggcatgtccacatctggagtagaccctgagtggggcagaaccatcatcctgcgtgcagcctgcacactcccagcacccgtggcagtctyagcaggtggattatcaccgagcacacaggcagcccgaggcacctcctcgtcacagtgttctccgcagccctgactggcgaggagggcacgtccccacgttcatgccctgtactagggtcccctctggcactctttctctggggctctgtgttccctttgccttttgagctcttcataaaatcactgccagtgacttctcatagctgttcgtcattgggagtcactgagcatgcacacgggctgtcaggtcctggtcccagctctgccttcctctcctcaaatgccattcacagcagtgtcagtgcctgcccagagtgtgctagaatgccagttcttgggccccaccccacacctgcgactccagactcagagttgatgagggtctgcaggcgtcggtctgggagccacagacaggtgtgtttgccgcagaggtgccgagggcccagcaggactgtagcacaggatcagcaccatccacacctgaggcgtggggatctccgggcatgatgcggaatgtagtgacgatcgcaaatccttcctgtggccaaagagtgagctctttgatgctgatgagatagtgtttatttatttttatcttattttttttgagatagagtctcactctgttgcccaggctggagtgcagtggcactgtctcggctcactacaacctccacctcctgggtccaagcaattctcctgcctcagcctcctgagtagctgggactacaggcgtgcaccaccacacccagctaatttttgtattttagtagaaatggggtttcaccatgttgggcaggctggtctcgaactcctggcctcaagtgatccacccacctcggcctctgaaagtgctgggattacaggcgtgagccaccgcgctcggccatagatagtgtttcttaagagtgagtttgcttctgaggaagagaagtggggggtcgggggcatcccacctccctggccacctccagtggtgtgagttggttgcttgatgtcatctgaggtggggccacccgggaaaggtcttcatgtctcacttgtatgccttcttggatcaggatttccaggcctctgcatctcttgagttgattctgaaagggtgaggagagaggggctagacagatttttttttttgagacaaggtctcactctgtcactcaggttggagtgcagtggcttgatcatagctcactgcagcctcaacctccccaggctcaggtcgtcctcccagctcagcctcccaagtagctgggactacaggtgcgcagcaccacacctggctgattttttttgtagagacgggtcgtccagtgatactcagattggtctctaactcctgggctcaagggatacacctacctcagcctcccaaagtgctgggattataggcatcaactaccattgccagcctgagctgcatgcattctaaggacactttgtgagactaattaaaacgtttttctttccaaggcacgtggcaggtgggtgctgtttctttcctgcaggatgtttgctgagcatttgtgagtggagcatctttagggaaagcaggacaaaccctaaaagactttctctgaatgttacctttgctcttcaccttgactggtagatcctgaaggcgtagaaagagggtcctctggagaacacaaactgagcgttgctgggcctcaggagcttctagtgatgctggaggcggccactgctgtctttcagctgtgaggagccaggagggcgatcccagctttctcctggttaattttaccgtcttytaaaaaggaagttcacaagatttcttgaaagaactctagttggagttgtagagctaatgtttttttctctggtccctgccacctgctggaaggagcctgcagggaactgtttgttgtgtgcttggctgttcagtgccccataactggccgcggtactgccacccgctggaaggggcctgcagggaagtgtttgttgtgtgcttggtgttcattgccccgtaactctggccgcggtagtctggacagggcttctgagaaccacctgcagttctgcttattgctggtgttgagaaatacagtttctgcaggaaagagagagacattggtgccaagaaatcctatcggggacatttaataactggaagtagcttaggaagccaggtttggagtgctgccttggtgtcgttataatgcaagtgggatttcattatgtgtttaaggcttggcattgttggaggtcaggaagaccaactaagtcaagtagagccattggctgcttgagtgcagtgcagagcactgggaaatggacttcctgggaagtgtgggattttttctgctactccttcattcacacctggattcagttgccctcatgagctcacccgcaatgtgtgtagggggatgctgctcccattggccaggcactggggatgcggcgtatgggcaggtgcacacacacctggcagaggtttggagctgggttgtgggtgagggatgcagagaggcttaacccagagaatggaggaaaaggagaccaggagagttcagagaggtgaagagtkaggagagagcagtggccaaagtggagagagttgagtttcagaaagccagctgcagaatgcagtgcctgacagagtgtgatgggccccatctctctctgctgagccgggttctgactctgcagagcattggaggccttgttgtgggctcaaggagtgcagagaggcagcgcctgccttggtcgtaacttctcacacacatacatccacacatgtgcatctgattgtgtgtgtgacacagtgaagggtatggggacagccacatctgggtttcagttttcagtcagctccctagctgggtggttcctctgagcctctgctttatttcatctgcaagtagcattaatactataactgaatatacagtcagctactcaccactcgaaagccagacttgagagacaagggttggtgggagaaacagcaggtatatttgaaaaccaagaagatggtgaactaacattctcaagtactgtcttaagtcagtacagattttaggctttttatattaagggctgggggaagaggagggggttgagatcaagagatgaccaacgactggacatctgggaggcagtgggggtcagaggaagttgggtttttttttgtcttggtcaggtcacgatgttcctktgaatttttaataaaacatagttgtttacatacttctcctttaatcccacagctagttttaaaaactacatgattgtgttgctaggattagttaagaactgatttgaggtcactagcacatggtgagtagttagtaaacaattgcttctgctagaatcatcattgtcaatattaagaaggcgagtccacgcatctctctggcctgttggctcacatttgggggtgtggcatttgtgcgtgaagtggagcctggtccctggtgacccaggtacagtttacgtctggagccagcatttggaaagttgcctccagggccctggatttggagggagccaactgccagagtctcaagcaggtgagggtggggtgcaggagaggagcgttcagggcacctctgagcacatgtgacattcgtaagtggcactcctcatgctgagcaactgacgtcgtatttccacccgacaatggcttgattcacttgataagtgaaaggaacttccacgtaaggatcccgaagcacggttgcctccgcctcccaccccaccccgtggtgcggcgtgtgccaagaccagccctctgaggtcagccctcctggaccccttactgggtggacaaaggttttctgtgtgactcacctctggccagaaatttagggaagcttatttgtaactaataccacccagtcactgcaggagacctgccgaagggctctggggaaagtgatcttcaaaaatagaaaggttgagtgaaggtaggacttttgggagaagcagaaggagcctataagacagcacattaatttggcaggtaattaggaactctgatcttgagcatctcattttaattagcgtggtccagcctgccttacggtgctcacgctgaagcagagagtggcctgcttagctgctccgcaccatttatttgggtttcttatttgggaagtttgcatgtgactgggccaagtgacatttgttttgaggtccctcccagggcycaggggtgagctcttgacaaccccagagtagagatggggcacctgtgcccgggcattgatttcctgggaaggaaagaaaacgccaggccatgctgctgtgttacagccctttaatcagaagcccctgctgcatgtgggcctgctgttcccagtgcctttcaggaaaccaccagaagggctccagctttagggaggatggtccatttacacgcctgtggttggaggttccaagtgccttgaaaaatgccttgatgccactyggagctgtttctttcttctctttcctttcccttttaaaatcacggaaccatttctttctttctttctttttttagacagagtttcgctcttgttgcccaggctggagtgcagtggcgcagtcttggctcactgcctcccaggttcaagcagttctcctgcctcagcctcccgtgtagctgggattacaggcgcctgccaccrtgyctgactaatttttgtgtttttagtggagacaaggtttcaccatgttggccaggttggtctcaaactcctgaccttaggtgattcgcctgccttggcctcccaaattgccaggattacaggtgtgagccacggtgcctggccagaattgtttcttgagtttttcaaacaatgctttctctccagccagttcaattgtagagggtcctggagaggaggtggagcagttgccttctcagcatcgtggggtggggctgggatgaggagagcgcggccgccagggtcagcctggatgctcctaggcagaggcacaggggttgctgattcttctttccagatggatgtttctaaagtctttcttaaaggagccagaggcttgcccgccctgcagtgccatccttcttgccgctcccacccacttctgtgatgcacagaacctgccgccctgccctgtctctttgtgttcgttggtctccatttctagtgtctgagtaaaggcagtccccagtccagtctgcaaagcctggccacttgcacaggaagatgctcatagatggctggttcctgccagtgacacacgtggacctcaagcaggtggatgggtggagctcagggaayaggcatgtggggcacactctccaggcacatccagggctggactggggccggcatgggggtcactggctgcaagcgaaggcagcttatgtcatgttccctctgccaccgccagctgtcctgcagcaggaagaggtagtcatgtttrgaggccgggctgtgcatgagctatgcaggccttggggtcttttcatcagattccttttggcagaatataaggaagttggcccaaaccacatttttgaacttctgctttggccttgtcagtctccttctgtgattcagaccgtagtgaagccctggttggctgaagtgctcaggagaggagactttgggggtcatcactcatttctgagttacagaagttaaatagtgacttggttcggggtcatgccatgtgtgtgaggcctgagtttgcaggtttgtgcagggcattgattggttggttggttgattggctgaggaatatttggggcacctgctctgggccatgtacacaatgaggcaaagcaatacttagacctcaaaaacaaagcgatgtagacctatctgctgtgtccttgtgtttctgcctgtggggcacgtgggacatgtgagggagaaacagcatcctgcaggagagcaatgcctccagcttggcttctggaagcctccagaaggatggacgggggcactgagacctgaagaagggttgtgcatgtgggagggagccagcctggtggaccgtggcctgcacacctgcagcagctcctcagagctgccccctcatgccttggccratcacagagcaccctttctgtccaggccactgatcagcccccaggtccaggtccaagaacaagcctgtgaccccctgggtcccctttgtccttggcctatacctgccttctgcattctggggctaccctttgctccagtggctacagaagagagaggagggacactgaccccaaggcccaggccagtctcgtccaggctgcccacacctaggtcttcaggatgggacaaggcagtcttgggggactttggggtgacacaaaccagagaagggcttcagcagagggccatgagtgcctaaccgtttacctgttttctgctctgaccaggcaccttgggggagggaaggcatcaggagccttctgctgagttcagtggaaggtggtcttcctttccaatactctggttccctctctcccctatgtgcaagtaaataacatgctactatatgtaaattaacacaaatgaatgtaagatagttatatgtgtctactgccttagaaagtacagtaagatgaatattaaacttttcagactgtaagatcgtgaatctgaaagtcgttgcttattgtatatttgagaagtggcacttatttaccctggagtgaatgtgttactggaagtgtcttggctaaattcctgacctaagcttgtgtggtcttttgctcttcattggcaatgtagaagtcaagtttgaactgagggctgtcttattttaaatccaggtttgatcattttctgaggatatagcgtttagtgcacacctcttttgtgcaactcagggctttctggaggttggggggcggatcccgaaggcagacttggccttcccagctggcgcgggactggggacttaggggactgggtcctggggtgagctctggagcccgtgggtctggttgtcttgctgacctggtctgcctcctgcttgcttccatagcagagcctgtgggacgtgaaccaccattcatgatcctgggaggtgaagccctgggaactgccacttggaatgagaggggaaggctggaactgagctgggctggccatggggatgctcagagcccggctctttcatgggatcacagtttgttcaccttggaagctgttgctcaccgcgtgttgattttatttaagactggaaaggcttgtccatgtatcgccgttgggaagggaaatcactccgaagacggtgrtgctgggtacaggctctggagtcatcttgatttggtaaaaggcatgaagtctgagttcattccgaagattctggcttttgagaacttatataaagagaacttataaaaaatggaaaatgagaaacgatgatgtcagtgaacatttattggcctttttttctgtgccaataactctcagtgcttaacctgaagaagcccacttaatccttccagcatcctgtcctagaactttccctgctgtctggataaggaaactgaggcacagagggtcgaggaacttgctgtggtacacccagacagcctgaccccagagtgggcacttcaggtcccgctccatggccgtgtgcaccttcatggtacgtgctggggttgtgccttatgaaaacaacggacttggctacatttcgacaaggggaagttagacactttagattcacagttaactgttgatgcttaaatgacatttgaggaacctattggtgctttcttgagccctgcgccatgtgagtgaggttttgtggtcctggacaggtgagctcccctccagaggctgcctgtttgtaaaataataggtttagatgaacaaagtggtctttagaggcagatacacctggggcagagtccatctgtgagtgggaagagtaccaggcacgggctgtggagaagcgggatggcgagtaggaggctggcggccttccctgtgtggaaggggccttgctgtgtgcctggccccgcagggtatgcagtacacacgcacatttatggggattactcggttccgcatgggctgtgtgtagaggtgggtgggatgctcagtggagatggaccaggctctcctccttgagtactgtcacctcttccttttctattctgtcacctccttctcatcacctctgttgtctgtccctgacaggcttctgtgctttggagacctctgtgtgtctttcttggttttggtttccctgtctcccagcatctctgggagatatgtgtatgattgattccaagaataaagtgtgaccaggaaaaccatgttttgaaatctgacctctcaagcccttgaaaatactcagagcttttccagaatgttctcatgtctccatccacttcctttccctttctgctttaaccccgctaccctccagtcgtagccttcaggagaaataaaaagaccccagagaggccagcctactttcccccacactgagttccaggaagctgagtctggttttcccataggaacaatgttatgggatggggactgcattcctcacaaaggactctgcctcgaaatgtgcgattagaaagatgcacccgctttcagccgcagcaacttacaataatgccgttatgccctcagccataaacacattgtgcaaattgatttcttgaggagccccaaggtactgtgggtagaaggagagcacatacacatgtgagtgctgtgaaatcattaccatagcctcagacatgtctgttcttaataaggaaaaaaaaagttcattacacgtcattgaagatttttttttttagatagggtctcgctgtgtgtcctaggccggagtacggtggtgtgatctctgctcactgcagccttcgcctcccaggctcaagaaattctcccacctcagcctcctaggtagctgagactacaggcatgcgccactacacccgactaatattttgtattcgtgtgtgtgtaggtggggtcttgccatgttgcccaggctggtcttgaactcctgggcttaagtgatcctcgcacctcagcttcccaaagtgctgggattataggcctgagctgccaccacagttggcttgaagattttttagaaacttgccagcttagtctttataaaaatacgatgaaggggtgatttgggtgtcccaagactgtttggaaggttgttctgacaagcaagtgctgatgttttgtacttgatcggcttctctgtggcaagccagaggcgtctgtgatgagcgcctgcagacgctggtgggtgcttgccgtgtgccagtgattgattgacgttagtgtcggtatctctcattgcgaacattcttctctaaggttgaaaatcagtttttcattatgtaaataatgtgtactcagtgtagaaaaaattagcacaggaaatagaaagctaaaggatatccctcatgatccctcatccagatccccagacgtgaccactgttatgtggttatatgttacgttatagcctcccagaaattttctatacccctgaaatttaacattttggtgggtatgatgtggtatctcaactgtggttttgatttgcatttccctggtgactaatggtgttgacctttttttttttaaatatgcttatcttaaagcatatttatatatttgtatatcttaggagaaatacctattcaaatcttttgactgtttttaaattgagtctttttattgttgagtggttggagttatttatggattctggatactagacacttattagatatatgatttgcaaatatattctttttttctgtggtttgtccattaatgttcttgatattctttgaggtactaaagcttttaattttaatgaaatctaatttacctgttttttctttgattatttggactttggtgtcatatttaagaaatcgctgcctaatccaaggtcatgaggatatactccttgtgttttcttctaagagttttctgatggtttcttttacgtttaggtctttgattttgagttactttctgtatatggtgtaagatgggrtaattgtcaattttttaaaaggaaaatgaaattctattaatattgttgtacaagttggttttcccctccacggcatgtttggctgtcttcatatcagcatgcttagatcatttgattgattttctcttctttctttctctctttctgcttcctttcccttcccgtctccatccctccctcctcacctccccatgcctccctccatcccttcccctactgtggtagacagaaaaatggccccgagatgcctgtcccctaatccccagaacttgcgatgatgttacctcacatggcaaaagggactttacggatgtgattaagaactttgagatggatgatcttgtgggctcaaggtaattatgagagtacttaaaagtagaagagggaagtgaaagaggagagtcggggactgtggaaggagggcgagagagttgcagcactgttggctttgatgatggagggaggctaccagccaaagaatgtggatggcatctaaaatttcggaaaagatgaggaaacttggagcctcctgaagggcatacagccctgctgacacctaagcctggtgagacccacattggacttgtgaccctcagaactgtcagacagtgaaatcacgtcgttctaaaccagtcagctgagtggtcacggcggcagtagatgagtgcacctcccctttccaaccttctaaacctcaggtgttgccttctccactaggccaagcgatgctccaggaaacctcaggtcacagccagatgctccaccctccatcagtttctcatgtgtccttgaaaagtcataaaaaatgttgaccagaatgtcagcacagacagtagaggtgggagtgtttctttggagtgggtgccgctgcctggttgtttgggccatgcacagaaggcttgtggcaggagcctagggtgtccatttagccttctctgttgtgttggcttccatagggtcactgcctcctcgcctgtgctctctatgtgaacacagagtttctgcttcactgtgggatgaggaggcttcagtgaattgtccacagacctagtcgctgtttccaatgttatttccttagggaagagtatctccaattttaaactgcccacaaacaaatgacgtttaggaaaccttgtaggtcaggagctgctggggtctgcgggtaagaacaggagggcttcctaagctcttccactgatttagggggcgaggttgggaggggtttcctgacatggtagaatttttctttattcctactcgttggttcaggtgtgtaattattaacagttacaccctttatctcctgcttcctctggctgctgacttggagggatgctgggagaaggggagggctgaagagttggggatgggtgtgcctggcttccttctaaggtttagggctgaccctggacagtcccagccccaggcaagtgttcttgaggcttattgctgtctgcctagctggggaggatgttgagaggattacttagctaattcagtatttggaaaaagtatctgtaaacttaaatagaggcccattacataccttttgtggattagaactgtaattgacttagtgtttaaggcagaaactaaggcctttgatttaaaaactgttgacagatcggagcctaagccgcttctgtttgcagaggagagccatgacttccagtcaagttgaaacatagctttctttatacccttcccagttggacttctgtcatattttacaaaattcaaggcttttmatttaacttagatttatggcttttccatggactatcttgaggtttttctccaaagcaaaccagctcataccttgacattgtcaaaatagcaaaaacacacatcttaacaaatgatggcaaaatatttgagctgagagattggggtatgtgtagtgttacacctttgcatgtaaaagattatgtcaagcaatcttctaaaggaaatcagtttttagttaacttttaaggctattcaccatgatttaaagtgattccttgattcctctgttacattaagtgtgattgaaactgtacmtttattttctcatgccttgataagcagtgtagtcaaatcataacatattatgactgcaatcaagtgattatagcacgtgattatactttttgtctctgtggcgtgaggagtggaaaggtgtctttttttgcaccacttggcactaacggtggggagagatggttccccgaagccccctccctcttgtgtgttttggggcagagcgccctgttcctgaatagcacggattgcacgtgtttctgagcatggtgtgtgagactgctttcccttcctgcagtcaactcgccarggtgcctccccagccccagcagtccggcttctctcctttccgctgccccatgctttctggtggcctggcagactcaggactatctctgagtccttcacaaaaccctcctccacatgccttcttttgtgaaaaccctcagtcctctttaagagcagggcccctggagccagacagctctggttcagtcctggctccggtcctctgcagctgggtgaccctgggcaagtcaccatggctctgtgtttttcatctttaaaatggggatgctggctggtgtcgcggctcatgcctgtaatctcagaattttgggagactgaggtgggaggattgattgagcccaggaggttaagaccagcctggacaacatggggagatccccatctcttttaaaaaatacaaaaaaattagcccggccggtggtgtgcgcctgtagtcccagctactccggaggctgaggcaggagaatcctttgagcccaggaagtcaaggttgcagtgagccgctgcacaccagcctggggcaacagaacaagaccctatctcaaaaaataattaaaataaaataaaataagtacagtcgctttgccctggggctgctgtggggagtctgcaaacaggacctgccttgtgctgaatgcagcatctctgttgtacttgggaggtgtgcagccccagcatctcatgcctcgcaccctccgagctgcctggccttggctgtgcccccctgccctggcccactcggcgtccccagcacttcatttctttccgtcctgcccccctttgctgtgtctggtccttttatcactgctcttgtgtctgcctctgtgccctcctgtcctggccacggcttgagatcacactgccgtgcctcttgcccaggtgaccccctgagaagctacctgagctctgctaatcagccccactttcctctgcccaggcagaaactaagatgcctcggctccttctgtggaggaaagtaatgtgttaattggatccagggtcctcagcacacactgggctatttttacagtcagacaggaagttgtcgttttataactttatcctgtgtaaattatagcccgggcggggggtggggggacttggattgttaagaaagtgatcatcctgttcttggatagggtgattttggctgtctgggtaagttctaggaatttgctgtattctcttgattctaatgaactttgctatggcttgggaaggggcctctgcatggagagagagaaggaagctagcgtttcttgagggtctggtatatgctaggcactgtgctggctgctgaattggactgtttgatttaatccttgtcacaacccctttgaagtggtcttgttaccctcttttacaaatggggacattgtggctccagcaggttaagaagcttgctccaggttacatggctatcagtgggaagctgggtggggggtgtggacaggtctgtgattcccagacccatcctcagatgcctcctggagcctctttgtgggagagtgcatgtgtcatggcgagtatgtggctctgcgattggaggaaatgtcaccggaccagtcaataggtcttcctctttacaattagcttttgtcaatgtacgttttttctttagtccacacaaccttttaaaatttatttatgatcgtagccctggcctttatccatcgaatcctaaagtgatctggctgctcatgaccaggggtgacagccaggatgcttttcttggaccaagaaacctggcttaaatgacagccttgagccttgctttggagcagtcagactctctggggatactgttactattactgagcattatttgctgcagaaattgattccttctgccgtacagtaggccagggaggcctccaggtgccttcggtgggggaaggattttagttgctcaggccaaataaccgagactagctccctgcaaattccatggagccatctatacttctgagtatatcttcaagtgctactcctaaatttaaggttcttccacttttcatccagttcacatgtagttgagggcctgcctgccttgagcctgacacagggccagttgtgagcctggaccagcacccacagccaggtgtgagcctggaccaccacccagggccaggtgtgagcctggaccaccacccagggccaggtgtgagcctggaccaccacccagggtcaggtgtgagcctggaccaccacccagggccaggtgtgagcctggaccagcacccagggccaggtgtgagcctggaccagcacccacggccaggtgtgagcctggaccagcacccacggccaggtgtgagcctggaccagcacccacggccaggtgtgagcctggaccaccacccagggccaggtgtgagcctggaccagcacccagagccaaggtatgagcctgaaccaccactcacggccagctgtgggtctagaccaccacccatggccaggtgtgagccaggatcatcctcccagggccaggtgtaagccagggtcatcctcacagggtcatgtgtgagcctggaccaccacccagggccaggtgtgagcctggaccaccacccacggtcagctgtgaatttgaaccaccacccatggccaggtgtgagcctggaccagcactcacagccaggtgtgagcctggaccaccacccacggccaggtgtgagccaggagcatcctcccagggccaggtgtgagccaggagcatcctcccagggccaggtgtgagccaggagcatcttcgcagggccaggtatgagccaggagcagcctggcattggccccatgccacatgacactctttgtcccttgtcagcattttaaaccaaggtgaagaggtcccacttagctttgtggtatctgttttataggaatgaagggggtactttaacaagttcatcttagggttctcatctgcattgttgcctgtgcagttacaccactcatgcctacccagcataattaacagtgtgacctacgaaaggtggggcggggctcacaggaactaaccagggattcctgtgtgtgaatgttattatgaaggtgctttacctcattagttatttgtgatgaaaatactcttaaaagacctgctataaagtgtcaataccaaaagcttctcatgtcattgacattaaaagactttttgtattttttttgagacagggtcggctctgtcacccggggtggagtgtagtggcatgatttctgctcactgcaacctctgcctcccaggctcaaaccactctcccacctcagccgcctgagtagttggaactacaggtgcacgccaccacgccaggctcattttttattttgatagagacagggttttaccatgttgcccaggctggtgggcaatttgtccacctcaatctcccaagatattaagaaactgttaaagaatgttttgccactaaactattgttttacaacatttcattatgaaaaatttcatacagaaaagtggaaataattttatagtgagtacttgtacactgattgccaagattctgtaaacaatatttccctctgcttgtgtcatctttcatttgtccattcctygatttattattattattattatttgaggtggagtttcactctgtcgcccaggctagagtgcagtggcgcaacctcggctcactgcaacctctgcctcccggattcaagtgattctgctccctcagcctcccaagtagctgggattacaggcatgcgccaccacgcctggctaattttgtatttttagtacagacggagtttctccatgtttgtcaggctggtctcgaactgccttggcctcctaaagtgttgggattacagatataagccatcacgcccggccttgtattatttttcaatgcattgcaaagtcaacggcagactgaaggactgccgcatgcatagctgctattattaactcgagatcaatattgatttactgttttgtttttttatttccagataagcattcataaacagtgaaaagcacaaatcatcagtgcgccgtacgttttggccagcactttattttatggaacagaggactagatgaccagtgctgtgagtgggcaggtctgtctcctgcctctcttatttatgttgtatgcctgacaccttcctcatgccgcaggaccagccgggaccggggagaggctgttcgaggaacacaggatgcatattcaggcaggaagttgttggggttaacatgagtggaccctagatttccctgcctgaagggggccccgtgttagtttcctgtrgctgcygtaacagccacaaactaggtggcttaaaacaacagaacatcattcttttacagttctggaggcctgaagcccaggatcaaggtgtgcccagagctgtgctccctccagaggatagagcaggattcctcctagccttttccggcctctggtggcccctggcaatccttggtgtcccatccagctgcatcactccagtctctgcttctgttatcacgtgccctcttcccggcatgtgtcttctgggtgggtgtgaattttgggaggacactattcaccccagtacaagcttgagcctggttgcggggactgtgtggacctctcccacaggtctgtccccctaaagggagcacactggcagtgtgcccacccccaggccagcgggcagcccttggcagagggtgtgcctagagcttggatgtgcgggtcggatgtctttgcctctcttctttcctgtcctggtttcagctggaaggatgttcagatatgagaatgggaaaaggcggagcggtgtttgttcatgagagaggactgctctgccctcagctggcccatggccttcccttccagagccccaaagggccctgccctcagctgggagatgggccctgggcgtcatttagcttgagcacctgcctggtcatcctctgcaagccccagtcactgtccctgggagaggttctacagctccctacccacacctgcagccttgcttctccccgtgtctgttcttgcgctgtccatctgtatgggagctgtcttttcatgggtctcaggtctgtgccagtatgcagctggggagctgtgaacccaggtgtgttttcaacctgcttcccagccggtcgcatactgtgggactggtggactatttagaggtctagggagtggtggggagaaggggctgcaggggaagagcatctgatggtggtggccaggaggaacgtggcactggggggtgggcagggtgggaattgtccactgtggggggcggctgaggaagccaaggggtctgggcctgtaggggaagtgggagaggagagaggaaaggacaaagatgaaggtggaaagrgggaaggtgacagtggcctctcaatatgcggaggggcttgaaaacaggagggctgtgcactagaggatgcactggcgcagaactgagacatttctggaaggtggctttggagccagcatccttgctggtatgtaagaaatgccaggtatatgccctctgggaggttgtgtgggctgggtgacactgccagttcccttcagtctctggggctctgactcagtggggattcccacactgacctcgtgatgtctctagtgccctcagggaccctggacagcatcctgagctgcagcctccatgaaaggaggcccctgaaggtggcaggttgtcagatcgaggcccacatggaggtcattccttactgggcttggtgatgccccgccagctaacttgagggcaaaggcgtgcttgcaggttgatgagcagctctgtgggatccgagctgctgctgttcgtgggctgcctgctgtgggccaggcactttgcggagcatggacgcccgttctcttactctgttgatgcaacaacctgttgaaccagagtttttctccgttttatggagaaagaaactgaagctccttgatgaagtgaagccatgtcctaaagccgctagcacttagcatgtggcgggcacctggcatgcatgcgtgggatggacatggactcgtggcagaaccgagacccagatggcaggaaggagaagctgtgtatgtgttggaggaggatgtggatcgctgctggctcagtgccggttgtaaaaggaagcaattgcagttatttcttgctgctgctgtaacagattacaacatacttagtggtgaaaaacagcacacgtcattctctttgaggtcagaagtccttaaatgcatccacaaagctgtgttctttctagagggtgcagggagaatccatttccttcccttttctagcatccagaagccacctgcagtccttggcttgtgggcccatccttcatcctgaaaggcagcagcggatggagcatcttctgacctctcacctctgctctatcatcatgttgtcccctagctttactgctttttcttagaagcctgtgattacattgaacccacctggatagttcaagacaccctcacctcaatgccattaatttaatcacaycagcaaagttccttttgccatataaggatatggcagcgtattcataggttctgggtgttgggacatggacattttgggggacccatgattcagtttccctcacgttgtcagagaccatcctggccaacatggcggaaacccgtctctattaaaagtataaaaattagctgggtgtggtggcgggcgcctgtagtcccagctacttgggaggctgaggcaggagaatcgcttgaacccaggaggcggaggttgtagtgacccaagatcacgccattgcactccagcctgggcgacagagcgagacaccatctcaaaaaaaaggatcttggaggaagtacatgaccccgagtgggtgcctctcctggccaggtgtccccttgtgtatgttatccttgaatcttcctagcagccttccaaagtaggcttcgggattcagttttacagatagggaaacttaggcacagagagacttttggtggctctataggcagtaaagggcaaaatggaaagcaaacctggcctcttgtacctctgagccccgaattytgccctctgcccatgtgagcatggtctgtgagcaaaccttcctgtggataggtttggaggattcgaaggacatccctggaggggctgtgcccaggtagggtgtgttcactgtgcccctgtgtgagggtttgtagtcttacacctttgccaaaccctttctgggttttgcccctcacaggagatgcaggtctttctrtggaacctgtaggttctgagaccgagccttgggtagtttttatttcttaggctctctggagttctcccaaatccccattgccaatcagtagctgaaagtggatgctattgtttttccgattgctggtctctttacttgtttagtgaaaacagcaaaaatttagaatgtttatagaattgaacacgaaaaccagagttgtatatctaaggaaaacatggtgtgactggcccgggatccaaattatttgcagcgcctgtcgtctttgttractcttctcagttctctttttctttccttctctctgyttctttcagttttggtttttctttttgaagacggaatcaaagggaaattattttcattttcttcacagggagttcccaggcttccccctagcctttgctttacttgctgtgcccagttccatgagaaggagttgttacatttcttcttcctaaagcagtgatcggtgcttctgccctggtggagaaggcttgagcagtccccggctagyggctgttgccacctacaagccccygcctccattaggaagccatttatttatggggcctaggtaggggcaggaggttcctttcaagaaaacaacagattgcttaatgctggtctccctcttgctggccaaaaggaatgttaaagccagatcattatcttgttataatgtgtgagagagtcctgcttaaaaagaggacaaagacttatcacacaaatatgcttgggtcccttttaatgtgggaagcacattccatgtaaaggcagcctcccgttcctgtctttctttgcagagactttcagaagaagcaggtgccctcatcgagcattcctttgatcacttgctaggtgtgtttggtggtggtttcagtgctgctctttggcctcggcattagagactagttttttaaaattaagtttctctgggtgtcccaagattcttttaaatccaaagaccatttaggttccagcttccttgagcctcggtttcttcctctatgaagtggagataatggcaaacatctgaaaacattttatcaggatttggtgtgacactacgtgtaggtgattaggccggtgcctggcaagtactgctgctcgaggaatctcaggtatctgcattcaactgttctcacacggctataaaggaatacctgagactgggtaatttataaagaaaagaggtttaactggctcacagttctgcaggctgtacaggaagcgtggcaccatttgctcagcttcagggtggcctcagggaacttacaatcatggcggaaggcaaaggggaagcccacgtttcacatggttggagtaggagtaagagaggggttgcagggggctgtgccacacacttgtaaacaaccaaatctcgtgagaactccttatcacaggaacagcaccaaggggacggtgctcagccrttcatgaaggatccaccccatgatccagtcacctcccaccaggccccacctccaacactgggggttaccgttcgacatgaggtttgggatggggacaaggattcacaccatatcagtgtcttatgcatagtaaaacattttatgaatgattgtctctatgtgctgtagctgtatatcctccagtatggtagccacaggccacttgtggctaaatttaagtgaaatgaaagattcagttccttgggcacactagccacgttttccaggcctgacagccatgtgctgctgatggctgccttattggaccacacagatagtgaaaggtttctgtcacggctgagaggttctgttggccagtgcttgttcagctaaggttaaaatattaaccacctacacttcctttgtatctaaacccatttccttggttcttttccaatacttatttcctgggtagccctttgtgttacagggaaattgtgaattttcatattaaaggcaactcacctgggatatggcttgctgaaagggaagaggcagacgctgtagtatatagtcagtgctcaatgaagggaaaggggcttcacttccccaacagagtggccctccaaaagggtctcactttgtagcccaggctggtctcaaactcctaggctcaaatggtcctccaatcttggcctcccaaagtgctgggactacaggcgtttgccaccacatccagctgctgctccatctttaaagttgtcttgcccacactttgtgtgtgtgtgtgtgtgtgtgtgtgtatacatatatatgtatacacacacacacacacacacacacacactttttttttttttttttgaagcagctcgtctttattgaaacttcttaaaacatccaacctgattttcaaagctcacagctctgctcctggctttgggggcttagcctctaatttgggtctgaactttattgagctttgcttggcaaatgcaatgaagaaagtgttaccaggtggcattactgagagcccttgagggtggggggagattgcgtgccgtgccctgtgtgtgtgtcagctgactcttgacccccgcttgcagctcagcatggctgtgtgacttaggactttctagatgcacataatttcaggagtggtatttgagtgcatttggcaccaggcatggggtggctgagccccatcagtggcacctcactgttgctgtgcactggtggggtagttcttcaggcagtgggggtgatatccatcagcaggttccaccactgggcaccaccacccttcccccgcaggtgctcctctgtcctctagatgtcctgcctcctgcgtcctttgcaccataccccacaggtcctgccacccctgctcatcatctctcttgctgttttcatctctgaagtccctcctataggggcttcctgcccacttctctgcacctgggcttctgccccagctaaaatctcacctctccagaaaatagtggccaacttccccatcaccttggctagaagtcacccctccatttggaatgccacagcagctgcccttagagtcttcctgctctggcaggccgttgtgtgcatcacactgacttcagccccacaaaggaggacctactgtgtgctcagcgtgtgcccagctctgagtgaggctacacatgtgaacaggaccagctcggctgcgggagctcctggtgttgggggcaggcaagcagacattctgcctgagactccttttagaacgtgaatgagaagcagcacgagagttgctgtcagactccccgattgctccatcttttttcttcttcttcttcttcttcttcttcttcttcttcttcttcttcttcttcttcttcttcttcttcttcttcttcttcttcttctttcttctttcttctttcttctttcttctttcttcttcttcttccttttttttttttttaaagatagaatctcactctgttacccaggctgcattgcagtggcacagacagctccctgcaccctggatctcctgggctcaagtgctcctagagtagctgggccacaggcatgtaccaccatgcctggttacttttttacttctttgtagagacagggttttactttgttgcctaggctggtctcaaattcttgggctgaagtgatccttagcccctcaaagtgctgggattacaggtgtgtgtccctgcacccggctgctgctccatctttaaaattgtcttacccacacgtacttacattttttgttttttaaagcagcttgtttcattgagacttaccaaaacattcaacttaattttcataggaaaaagtcctcttatttaaattcttatttagtcagtgtgtataatgtttaatcaaatgatgtcattatagttactattattaaaactcccatttcatcgatttgtgtgatatttaagtgatgtgataatagttagaaggaagcgtatggaagaaagtgtggcaacaacactgctgacactggaggacagaattctggtctctgcaaacggcatgagtgcgccccatgagtgcgccccatcaccagcaggtgggcttggcaggtgtgccccggctcatctggagagtcaggtcaggggtggctggtcaggatagctgttaccacatggaatgtgcattcctaaatccaaatgcttgcctcaccccagtgctgagcctggccagctgagaggctggagaccccgtgtattcatggctggggctggctcctggcagagcctcccagcgggttggcattctgttcagctttcccctgctgtcgcacaacctttttattgacccctcccttcctgtgttggccaggagcccactggcttcaccagaccctgactgttagctggtcagggaggcagggcctgggtgccttggggcctgtcctatctgaggtccacagcctgcagggacatcacctaaaagttgtcatcagcttcattagcagcactcaggcccagctgggcattcagctgtgactgcattctggcacctgaagcatctgggcctggacggactctttcaggttgtttggataatcatcctaaaaacgcctctgagatccacccccactcctgccatcaggcattaaaatcttccgaacagaaaagctgaaaatgttcccttaccttaagggaaaggcctcaatggattgatttaattgtatgtgtgaagcattttttcttctttgctaaatgcataaactgtataacgaaatgtaattagtgaaggtgcattatctgataaagtaaatctcagccactgggaagagccctttttggcagtgtagtttctcttttaatagctgtgatcagattatacctttaaatctctttaaacacttcccaccactgaagtctttggtttccttgatttgatagtttttaccaggctgttcaaaaagtcaagcagtgttcttttaggtcctttttggttctgtgcgacagttaatgaatagtcatgtgcatttgacccctaaaaggaaggtcttttgctttttaaagagactgtattaagaggaataatggaccaagtacaccaggagggaatgaacgagaaaaataaaagaaagaaaatcacacaagaccaaataactaattttgaatattttctgagacctttggtttagaatctaaactttgttgaggctgggcgcagtggagcacgcgtgtaattctagcacttagggaggccgaggcaaatggatcacttgagctcaggagttcgacaccagcctaggcaacatggcaaagccctgactcttccaaacatacaaaaatcagcgaggcatggaggcagacacctatggtcccaggtacatgggaggctgaggtgggatgatcgctggagcttgggaagttgagggtgcagtgagccacgatygtaccactgcactccagcctgggtgacagagtgagatcctgtctcgaaaaaacaaaaacaacaaaccaaaaaaaaggtgacattgagaataaagagatggtggttggatttgtggctatttttccagctgctcaatagttgtacaaaatgtagcttgatatgatgagtgtttccaaaattcctaaattacatgtcrtgtttgttgattatttgtatatgttttaatgtgtattaaaaagacaccaaaggtgtgagttcataaatattaatacttaggataaacttaagatttgaaagaatttaaagttgaagagagttgaagtaggtgatagtttaggtggtctttgaatgtggcagaagccacaaaggtggtgcatgaagtttgggaaaagctgagccgaggaaactggaaggctttctcctttaaggaccagtgtgattctaggctgttgaatgatatcttcagatacccgtttgtcctgttgctctgcctcctccgtgagctgtgctcacgggtggccaggtgtttgacactagtatccagagacaaactcagacatgcgccctgggctctactcctggaacctgggagaaagggctgccgtagggaaaggtgtgaacgcacaggtttgcatgcctaaaattataacacttttttattgcaaaggttcttttcagcttttttcttttcaagtaaatggagatgtgtctttcttctgtttctgktgtcctttttctttccgtaaaataaccacctctttactgagattggggagggaagtctgtctccattgaattgtctgctgtcgacatcagataagacattcccttctgttctgttttcaaaagaagatgatgtgaaaaaaaagtggcatttttatgagacgtgttgtcccctcacataacttcttggatacctttcccttgtcctagggacctaagcctctctgggtgtcactgtccgtgcacagcctgtgataagccgctgtgtggcagagaccaactgtgggtgatttgtcgctccccagagcccggttgcaacaggaggagccaccaggctgggagggcaccaggcaggaggctgggtccatacctggcgcaaccctgggcctcaggttccccagtggcaaaggtaggataggggctttggtcgcctctgtgctatgagtctttgtccagtttgtcagtcaccatattcrttttactctccagtcttttctataaaagtgtttgggggccagaagttgttaacctggttcactagaagctaatgcattgattatttttgtgtgtgttgtactcagcacgtgcttctcagtgcgctgtgtcctcatttgctgtttcccctgaagtttgacgagtatggtatattctggtcaccaggcaggtggtgcttgggkaatatctcctctccgtgtgctggaagcattgcctgattttaatgaggtgactcactgcagctggttttaagaactttgttgcaggtattggttgactgcagtgttcccaagtggtcgtgctgtgccctaaaggctgctagaacctcaggggccgttgagggcaggttcgagtcccgcaggcaagaaggtggaactctrgagaggagggggatgccttggcctgggccccctctgagggaggactgtcgcccctgctgctgggagcatcattagctgcagctcctcatggagagatgcccagcgtaagggtacatcctgtcagaccctcttcccgtgactgttcttccagggtgtgaagggcagaaaggtggggccatctggacccatcatgggacaattctaatggcctctccattgctccctgttgggttggcgagatggcctcaggtttgcctggcagttcagcctctctctggccagttctgcttcttcccctccttccacaggtatccatcttccctccataccccaaatgccaaactctacctctgcatcttcaccaagaaaagcatttctgttgtcctgaaatatcaggccttcctgaacccccttgtacctctgtccagtggaagtagaatgccagccacatacgtcatttaaagttttctactagctacattagaaaaaataaaagaaacagatgaaattaattttaataaactgtttaatccaacatatccaaaatattatcctttcattgcaattatctggaatttgtggacgaggtttgctataatcctgtttggtactgatgctttgggtggtgctgtgtaatgttcattcatcgcacatttcaattcggccacattttagtgctcagtagcacctgtggctggagctactgtattgggcaccacggccttagggttttgattaaaaccccattctcttgaccttctgcccaaagcctttgccagatgagacactgcctctcgctgaatgcctgcttggagcagagtcctgtgtttgtttggaaatgatcggaagctcctgtgtccctggtcgcttgctggagtcggtgggagctgagagtcccttgctgcccggagcatggctgtgtggctgcctgactacatggttcttcccccggttatttttgtttgggcagttaactctgagcattcggaacattcgccgagtggaacgtgtgtgtcgtcatcccctcgaaggcttggctgattgagccagtaaacaaaaagtgcattcaacacaggcttgtctgctggcctcccccgggagagagagtaggtttgctattcctgaaatgtaatccctccttcagcgctgcacaaaaggcccatgtctgctcgctgggacctgatagttcgcctttgtacggatgaaaaaaaccaaacactgagcctggtctgagcggggctgtttgttgaggctcctgatgcagasaagggagcagtgtctgcacagggggtctggatygcacccgacaccatccaggtgcctgcgtgtgctggtcccgccrtcaggacttcccctcgtgaggagctgggtaccactgttatcctgcctgctggtctgagggtccgagcgtgattgggrgcagagacaagagttccagggcgagcctcagttctgggaccaccattgaccagtagagctataaaggacttggccaccaaggttggagctgagccccccatgtcatgaaactgccactgtcagagccagcctgagctccacggtgcccgtctcctacctgcactgtgcccccacacctttgttgacaaggacctgacctctcctcaaactacaacctaagaaccacaatgcctgttccccttacctgcccccaggtgtcctgggagaagtcagtgacatgattaagacctttaaaaatgatggtaagcatgtgccagtgtgaatgtacttagtgccactgagctgcacacttaaaagtgggtagaatgatgcattttgtgtgtattttgccacagtttaaaaaattacagactggacgcagtggcttatgccaccccagcactttgggaggctgaggcaggcggatcacttgaggtcaggagtttgagaccagcctgggcaacatggtgaaacctcgtctctactaaaaatacaaaaaaattagctggatgtggtggtgtgcacctgtaatcccagctacttgggaggctgaggcaggagaattgcttgaacccaggaggcggaggytgcagtaagccgacattgtgccactgcactccagcctgggcaatacagcgagactcagtctcaaaaaaaaaaaaaaaaatttttttttttttacaataagctatttaaataaacatttgtgtatagcccaatagtttttcactgttgagggtcaaaattttacctttgtctacctatctgcctgtccctctagctgtcagtcacacagacggatatagatatgtaatttgaattacttctgtttctttctctttgctagtctaagtcttagaagaattaagggttttcttattactggctaaagttaaaaggtacccagttgaatcatcttggaaagaaaaccaggaaaccaaattatcaccatgaagcagccttccccagcttgtgtcacagtggagcgctcatttttgtggctggtttactgtcgtaaaactttcgtataagggcgcactgtgtcagcccctgcccactgagggcttcagaaatgaaaggcagttctatttatgcccagctggcttctgcagagccgagctcagtttaccaggcgacacttttgctttaatccttcctggtgtgacgtaacctttcactgtccttcccatgccctgaggtctccagcctttttgttaaaacaaaacaaaccttatttgggcatgatcaatacagctgtgggttgcaatcccagggggcgacttggctcttttgttgttgtcgttaaaaaatattgaggcaaaatttacataacataaagttaagcatttaaaagtgaacacttggccaggcgtggtggctcacacctgtaatcccagcactttgggaggcctaggcgggcagatcacgaggtcaggagatcgagaccatcctggctaacacagtgaaaccccgtctctactaaaaatacaaagaaattagccgggcgtggtggtgggcacctgtagtcccagctactcgggaggctgacacaggagaatggcrtgaacccaggaggaggagcttgcagtgagtggagatggcaccactgcactccagcctgggcaacagagygagactccatctcaaaaaaaaaaaaaaagtgaacacttacttagcgtatgcaccacatggtgtaaccacccacccgtctagttccaaaacaatttcatcacccccgcccaggggaaaccccatgttcttcagcagtcattgcccatttccccctctccctagcacctgacgaccgccagtcttctgtttctgtgggtttgcccattctggacatttcatataaacagaaccatacaacatgtggccttctgtgactgggttctttcccttaatataatgtttttgagattcatcgagggtggtagcatgcattggtgcctcatttctttctacagctgaatgatatttcattgtatggagggaccacattttgtttattcattcatctgttgatgggcgtttgtgtccatcttttggytacagggaaccatgcagctatgaacgtgcgtgtacagggatttgcttgagttgccattttcacctctttggagtatatccttaggagctgagtggttgcttggaaaggtaattgtatttgactttgagaagaaccgccatactgttctccccatcattagtggtgagaatgaagacgtgccggccgcttacattttgtcgggttgatttcttcattttcttgcatctccttcacagtggcagtgctggcttttccctcggtgcttgttggaggcagtgggggagggagggttggggagggtgcgctttctactccaccattctagtgtcttctagaggtagagtcgagtgtatctgagagtgcttctctcttagaataaatgacattaacatatgaaaaaacagctacttgtgcctgactatgggcattttcatgtacaggagttcttgaagctgagtttattgagaatggttttgttacctgctgatagctatctttttgtgtttagttctttttgacttctttggcctctaatgttttgacagtggcacttagatgacagtcagcaattgcaacagtgaatgaaatcacacagcttgagttcaaggtggaaagagaaaaaaatctagagaggatgttatctgacctggcatgagaggtgatcatcctgtctctgagcagtgggttcttgctctcgaccttagggtgtaatgtggccctgctccttgtatggtgaataacttgtgactgctgtgtttaccacatggcttgacagtttacaaagcacttttgtgtatattattgcacactctgatccttacagtaatcccgtgaggtgtggagtggaggctttttaagaaacagagactgctttgggaggcataggtcggtggatcacctgaggtcaggagttcgagactagcctggccaacatggtgaaaccccatctcaagcaaaaaaaaaaaaaaaaaaaaaaaaatgccgggcatggtggtaggtgcctgtaatcccagctacttgggaggctgaggcaggagaatcacttgaacctgggaggcagaggttacagtgagctgagatcatgccattgctctctagcctgggtgacaagagcgaaactccgtctcaaaaaaaaaaaaagatggagggtgaaagagatggagacttggaggttgcacactgttcagtggaggtgcaggacttccagcttggtctttgtccccagctttttaagaattcaatcatgaagaagattgtttatattgttcttttttttttttttttaatggattgagtgtgaaactggtggaaatatattccaggaggccatttaaaaagaaaataggctgggtacagtggctcatgcctgtaatcccacactttgggaggccaaagcaggcagattgcctgaactcaggagttcaagaccagcctgggcaacgtggtgaaattccgtctctgctaaaatacaaaaaattagccgggtgtagtggtgcatgcctgtaatcccagctactcaagaggctgaggcagagaattgcttgaacccggaaagtggaggttgcagtgagccgagatcgtgctactgcactccagcctgggcaacagagcgagattccatcttcaaaaaaaaagaaagaaagaaaataacaaggttaccatggagatcctgcagtcacggggacattctcaaacatcacaatgattggtgtcaaaaattgaaacctggaagaagaaaactggactatgattgttgaattagcacccggggaggttttattattctgtgttcaccccaggaaattcttaaggcctgagtgttgatgtccttcagcaacccaacatattaacgcagtctttaggagacatgaaatgttccttccatccagggaagacgtgattgcagcaggcaggagttgatagtgatgctatggggctgtctgctctatacgaggagcagagacccctggatcctagtggtggcccctggtcaccagatgtgagccctggagcgcatgattgtggttttgacccattcttgccccagcttgagcctgacctttggcaggtccaggagtgtgctgagtctttctaccccgctgcgtggtgctgcctgccgaggtggtgtggctctttgtgctggcayttagggtgtcactaaagcccaagaccaggattgcttgtcctttgcagtgtgctggacaggagccacacagtgtagaagcgacttgccctaaatgcctcattgagaagcatgggtgtccccttagacatcatgggagctcattgcattgatgaagccctcttgagtcagatcgtggggttggttggtcatgcgtgtaattatgtgttgaggtttggtgccttgagattaaagggatgccacattttgagcttctcagatataaaagaaggattctttgggggaggacctataaatatttcttaaaagtgttttacaacaaaagcacggagtgtacttcagaaggaaggatttagctgctggagtgatggccgaaggagcctgggagaagtcagagagagggggctcgtggtccttcttgggctctcattgctgttagcaggagttggcacttgagtcccacgtcctagcctcccggsatcacagccttatgctgcatttcctaaagtgctttctagcactgaccgactccaggaggcagcactggcaaggattttggtgagcctttgatggagtgtgttccggaatcgggaggaagcttgtaaggctgctttccactcattttatgttgttgggatttggctcggaacctgccaaggacccctgtgtgttaaagttgaaatagttccctagtaaactggccactttcagaccagctgcattttctagaataaacytcatttgtccttgactcataaagggaaaagccagaagccaggggctctggggcacctccaagtgggccagggtcaggtgtgggtcctctgcctgggttttaatgtaaactcagggttttaatgtaagaacctgttttgtttgcttttgtttttagaccaagtctcactctgttacccaggccagagtgcagcagccataaacatgtcttactgcggccttgaaccttggtcttaaatgatcctcttactcagcctctcatgtaactctggggtaactccaagtgggccagggtcaggtgcgggtcccctgcctgcgttggtctcactgccatagaaccccagccatggtgatcttaccagagaaactcatttgaacctatgcggctgcttcaggccggtggttgttggcctgataggaagagagcatactcagcctcatactcagcctctcgtgtaactgggaccacaagcatgcaccaccatacctggctaatttttttttttttttttttttggtaaagatagggtctcagaggtttggtgtggtggctcatgcctgtaatcccagcactttgggaggctgaggcaggtggatcagttgaggccaggagttcgagaccagtctggctaacatggtgaaaccccatctctactaaaaatacaaaaactagctgggtgtggtggtgtgcgcctgtagtcccagctactcgggaggctgaggcagaattgcctgaactcaggaggcagaggttgcagtgagccaagattgtaccactgcactccagcctgggtgataaaatgagatcatgtcttaaaaaaaaaaaaaaaaagatggggtctcactttgctgcccaggctggtctttgaactcctggacttaaatgatcctcctgcctcggccccccagagtgctgggattatgggcatgagccaccacacctggccagggcctgtttttaattgttgaattgcccacattgcattatcaggattgaaaacatagtagtggcacagcctcctggagagtgcagatgtagctcatggtacgcttggggtttctgcagagcatgacatcaggctgtcttccagccttgcctcactaagaacttgaagcatgaccctcaataarccacttttttttttttttttgcatggaaatctgtgaagaaagaaggccttgggaaagcctgtgtcctggcctgtcattgaacgtaataattacattaacaagtgaatgatttaagttctgcactctttgttcttataggaacaaggttaagggaygactgtgttgtgggttgaaatgtgtcccccaaaatagtatgttcaagtcctaaccttggtagctgtgtgtgtggccatacttggagatggtctttggctgatgtaattagttaagatgaggtcatactagattggagtgggtcctgatccagtgatcggtgttcatctgagaagagggaggttgtgacagcaacacgcaggaagggccatgtcacgatggaggcaaaggtcggagcaagctgtgctaggaagaggcaaggagggatcccctcccccagccttcataaggagcacggccctgcagacaccttgatttttgaacttctggcttccagaactgygagggaatacatttctgctgtttgagccacctggtttgtggtacttgattacagcagtgctaacctccccacagttacccacaacctctgagtacctgtttgccgctcactcctccctctcccattgccacgtggtctctgcttttattcgttttctcagcggaaacttggaggccattggctattgtgtatcgtgtatcgtggctaagtcattacctttttttttttttttttttttttttaaagaaaacccaaaaccaaaaaactccttttaggcgtcacccccctacccacttaggtacagtgctgctgctgctgcccccggcttcttgaaaccttctttctgactctctgagagagactcttgtggatatcttgtagctctggcctttttctttagctctggtctttccctctcttggctgtggattcatttcttatcgctgttgtaacaaattaccacacactaagtggcttaaaacagcatagatttattacagttcggaagctcagaagctccaaatgggtcttacgggcctaaaatcaaaggctgtgctccttttggaggctgtggggtagactcgatttccttgctttttccagcctcaatggctgctgcattcctggccttagctctgtatccctctggcctctgccgtggtagctgcgtggcctgctctgaccctgacctcctggaaggaccctgtgattacattggacccacctgtgtaatccagaatccttgcaaaacccccatctcaaaatctttcacctcttcacatgcacacagtggctttgccccgtggagccacatgctctcaggttccaggaatgrgtctgtgggcatctctgggggccactgttcagcctgaatgtgttctgaggcttagtattttgtctctttgagttctacattcattttgatccttacatcatcatctgcaggggataggtgattctcaatctaggtttgggaagaggaacttaaggctccacagaaatttgagtccatttttacttaaatgtactttttacctttagaaaaacttgtaggtaaaaaccaacaggtrcattcaaaccaatcacacgccaacttttaccacccaccaccgtcttaccttctgctgctgtgttggctcattattttgcgcggacccgaaatgaaggctgtctcgtcctttctgtttaattggagcgcctggagagcacaggtgagttgttaaaaacccggtgaatcctgcatggatttgcaaaccaaactacatggagaaatcagttaaattctcaggtttcagggttgcagctgccactgagaagtgtatttaggcaggttctggcaacagacttggtgttgggcttgagtgggaaggggatttaggagcttcatgagcgagtcaaatgcaagttggggaagtggctgaaaaaaatgcctcctggaaaaagcagtaaatgtaaggatttaggtcggccattgtctccgtgtaagtcaacactaccttgtgtgtgtgcgcatacacacaaagagggtgagccctcagcccgccataygggcatgttatccagaagagaggagagagaagcccgctgcactctccactgaccagaccacccactttgccctctgcacgctcactccacgaaggatgcaggtgggcacactgctacaaccccctgggtgtgtgtggagttgggaaagagacggatgttgagcctgaagaggctgtgacctccccaaatactcggactcccctgtggaaggcaaggtggaggcagctgttatgtggtgtgttggattcacagcagtcaaggctgccacgagcaagtattttgagtgctccttatgtccatgcagaggctgactccagaggatgctgtgcacaggcctgtgtgacctgaaggcccttgcaggctgaggtctcttggtgataatccacacactgtcctgrgccttggttttgcagcatttccaacttgggttgtcagagtgagactgtgcaggactgcccygtacagtacggcttctatgtgtgaacaacacagaccactaagagatgtgacaaagctgttccatcagaggaaacatagtctgggggacaaatcctcccattcctgataggacaggagggagcggttggctggggaagacctgagtgagggagctttcttgaggacgggttttgtcggagtgtagttcatataccatgcacagcctgtcagcatacagcttgaatgaactcacrtgtgtaaccagatcaagaggcagaatattactagggtggcagttttgagtcccatgaaaacaaacacatttactctgtctagctccatctctagttaattctagtgcagtttaaatgctcacaaaatccttatttgaatggatgagtcagtggtttgaattgaatagtttttgagccatttgtatggagaaggtattacccaaacagaaacatggtggtgataatagactcacgttgatttcacttgttaactgagcaaacacctcttgtctcctcattctgtgcagagcattctgggtggaaaagtcggaccaagtttctgaggggaggacggaggagtcctgtcttttaagcagatggagctgcaaacagccagagagtgacagagattgagaggcagcagctgtcttttcagttgcgcatcctccttgtagtaaccataggtgggaggctgggattccgagctcagggcagcgggatgctcaccatgtgctgggtgctgtttgaaggaccggaaatgcatcattttgtttaagtctcccaacaggccgggtgcggtggctcatgcctgtaattccagaactttgggaggctgaggtgggcggatcacttgaggtcaggagtttgcaactagcctggccaacatggtgaaaccccatctctactgaaaatacttaaaaaattagccgggcattgtggcaggcacctgtaatcccagctactctggaggctgaggcaggagaattgcttgaacactggaggtggaggttgcagtgagctgagatagccccatttcactccagtctgggcaacaagagcaaaactccgccttaaaaaaaaaaaagtcacaacaacctgtttcacttaagtacgggcttaagaggccagtgtgagggtcaggagctaacactcagccccacaggggtctccaggtcctgctgctccttccacgcctgcccggtccctgcagcttcccatgaacggaagggaagtcatctggcagccttagaaatgctcatttgtggccgggtgtggtggctcacgcctgtaatcccagcactttgggaggccgacatgcgtggatcacctgaggtcaggagtttgagaccagccttaccaagatagtgaaaccccgtctctactaaaaatacaaaaatcagtcgggcatggtggcacatgcctgtagtcccagctactcgggagactgaggcgggagaattgcttgaacccgagaggtggaggttgcagtgaaccgagattgtaccactgcactcagcctgggtgacagagtgagactccgtctcaaaaaaaaaaaaaaaatgcacatttgcatcagtgatttcattctgccagtgttaaatgaaaattgttacagggaagttagttctcaggatccattggggataaaataccagaacaaagggaaggctagggtttcttctcctccacttctctacactcaaccacccttcccatttctttaatgccaacgcaccgtcaccttcctcacccttgatgctgagacattcragaccccttagaacccaggactcccggtggctgctacaccctggtcatatctggcctctcacacttaacccctccaaatagtaaaatctggataaaaaaaaattgggttttcaaagagctgttaacagtcttctgtagctgagtttttaagaaattataccatattcattttgactcctaattcctttttggaaaaatttctgaattttgttaaattcacggagtaacacaaatggttatctttctgttcctttaaaatctatctttgatttggagattactagggtaaattatagatcaagaatatcatacatgtcattattcactgaaatttgcagtcagctctgtagacaccattctgcctcctttacccagcacgttggggattgtgattactgacgagacctttaaagaatcttccggctgggaaaggtcccgagtggcctgctttcctggcttatttgagaattttgcctggcccctaggtttctcagcagtctgtatttcccactgttcgttgtgctcgtgctgagttgttttcctatcgaaatacaactgtgttttattgaccttgaatagctctgccagatttcacaggtgctccttgctctgggaggccctgaaatgccctttctggtccctcttgggttcagcgctcagggcctctggaaggtttcaggagccccgatgctggtagaaaaggagattttgagaactaccagttaatagcttattgttttttttttttttttttttttttttttttttgagacggagtttcgttcttgttgtctaggctggagtgcaatggcgcggtcttggctcactgcaatccctgcctcccaggttcaagtgattctcctgcctcagcctcccaagtacctgggattacaggcgcctgccaccatgcccggctaacattttgtatgtttagtagagatggagtgtcaccattttggccaggctggtctcgaactcctgacctcaggtgatccgcccaccttggcatcccaaagtgttgggattacaggcatgagccaccgcgccagtgctggtcccagttaatggcttatttctgaatttcccatccaaccgaacttttcaagtgtaactcctggttcttcatgggcaggaggaccatgtccgctctaggtggcttgtcctctttgggaaggctctctttgcattttaaaattattctggatgacagaatgaaaccctgtctcaaaaaaatatagatagatagatagatagagatatagaatggagataattggaggaagcagtggtcattttagtgtttgtgtagccaggagagcacggccaggactcactctgagttggggtagccagaattcagagcatctrgagagagagagagagaggctcacctcttaggaaagggtttgggaatgagtaggaagttattttcctttttttttttgagatggtatctcgttctgtcgcccaggctggagtgcagtggtgcaatctcagctcatggcagcctctgcctcccgggttcaagcgattctcctgcctcagcctccctggtagctgggattacaggtgagtgccaccacatctggctaatttttgtgtttttagtagaaagggggtttcaccatgttgagcaggctggtctcgaactcctgacttcaagtgatctgcccgcctcggcctcccaaagtgctgggattccaggcgtgagccaccgcgcccggccctttcttttctctcactgttactgtctccctgagtttttactcggtgttaacgtttaaaagctccagcttcaaaaagtagtttttagtctttcttaaaatacagatgtaagcacccatcagctctctgcccaaagataaatattcttaacctttaggtgcctatccttttatgccagatgccaagttgaccagggagtgtctgcacagattcccggtgtctgcacctcctagggatatggaaggaggcctgagctccgcgaggctggatgttgaagctgttgatcaacaggtgtgggcaggaagggacgggaggctggaaaccgtgaccatgcccagagacagggcttctgggggtcaccagcaatgcctttcactgccctctccaccacaacctgcttttcgaatttaaagataacagaacctgccaggataggccactcatttttgtttttgtttctgttttttttgttttgttttgttttaatgtgtgtgtgtgtgtgtgtgcgtgtgygtgtgtgtgtgtgtgtgtgtgcatttttttttttttttttttttttgaggcggagtctcgctctgtcgcccaggctggagtgcagtggtgtgatctcggctcactgcaagctctacctcccgggttcatgccattctcctgcctcagcctcccaagtagctgggactacaggcacctgccactacgcccggctaatttttttgtatttttagtagagacggggtttcaccatgttagccaggatggtctcgatctcctgacctcgtgatccgcctgtctcggcctcccaaagtgctgggattacaggcgtgagccaccgcccggcctatatttttaattttttgagacagtctcgctctgttgcccaggctggagtgcagtggggcgatctcggttcactgcaacctctgccttccgggttcaagcaattttcgtgcctcagcctcccgagtagctgggattacaggcacccaccagcatgcccagctaatttttgcatttttagtagagatggggttttgccatgttggccaggctggtcttgaactcctggactcaggtgatgcatccgcctcagcctcccaaactgttgggactgcaggcgtgagccactgcgcccagccctgttttttaagttatgtaaacagcaacgggaatgaattgactgaacgagggggagtggagtgggaagcaatgtgctgcccgggtcttggtgtgaaacgcagtggccctgggcagaatgcacaacaaaggcgcacggatttgggtttagaggcttaatccctccttctcttggtgtgatgttgactccacagaggcaaatgtgccccaggctgcagtcaactgtttgacctcgagtttgggataagcatacggcctcttcagcctgatgtcactgatgtggtttggatgattttctcctccaaatctcacttcgaaatgtgatccccagtgttggaagcgaggcctagtgcaggtgcttgggtcatgggggtgaatccttcatgaatgtctagcaccatccccttggcgatgagtgaattcttgctctgatagttcatgagaggtctgttttgttttgtttttrattttcctttacacaacagtatacagtattaggtgccaagagacctggttgtttaaaagagcctgcccccacccccaccccccaccacttctctcttgctcctctcttgccatgtgacatgcctgctcccccttcgtcttcccacatgattggaagttctgggaggcccttagcaagagcagatgctgctaccagcttcctgtatagccttcaggaccatgagccaaaataaacctcttttctttataaattacccagcctcaggcattcctttatagcaacgcaagaacagactcacacagtcatacattgaagtggcgctggttcccaggggcccaggcttgcctggacagcgccctgtggccaggaagacctggggagggagggtggctggaggccaggagctgtgctaggtatccctgctctgcagccaaggaggctcctcctccactgccctggccacctggatgctgcatttaattctgggcaccacgcgccagaaggaggagtagatgagccatgttctggggggcrgtgagcaggatggtgaaggaggagtagatgagccatgttctggggggcagtgagcaggatggtgaaggaggagtagatgagccatgttctggggggcagtgagcaggatggtgaaggagcttagaaccacgagaggaccccgcttttccagggttttggagggcagggctccaggagaggctcatttagggctgactccgggcttgcggcttgtggcatgagctcttggaggttctccctaaggagtcagccaatcaggccttcctttcttgtggttttgagcagattccaagctggcttcacgggaggggtgttgaacaggagtagctatatcagagtcaaggcagggaggggagacctcagtactgctggatgtcgcacatggagatatgggcgcatcttagttatggtgtcagtcccaaagcctgtatctggccgaggttgcttggggacgtgatggctaaagctgtgcccttgcagggtgagagtgcggggtggctgctcgtctggagaagagagcaccccttgggaaatggaagatggaggtggggatcagctgctgcacagtttccaggaacactggtgtctcagggagacacctggcatctcaaaataaggagaggctgtctgacagcttcagttaaggatgatcggtggctgggacggtggccgggagggctgctgagcttctgaaatgagcgttaggtgaccctgacctgctgaaggcccctgttcacctgaccaggtgagagatggctcggaagtgagggagaggggagagggrtgcaggttgtgggcctgtaatccttattgatatcagccaccctcaacctgagatgtaaattggaatcacctgtggctctcaagctggcattcagacgggcagcttttcctgagccctcaaggagattctgtcttgcagcacgtgggtaacaagtggattgggtaaataggctcttccctggagggatggtgttaacgcagagacccgagactgagcttaggaaacaaaagtggaacagaacaacctcctgatttcaaaagcaaaggcttaaaatttatttcagaatgagttacagtgatattagtatgtttttttgggtggggaggacagaatctaattttagttgttttagattatggtactttttcctgcttgatttacatgttaaatgtttctgatgaactgttaaaatcttcgaggtttttgcttcatttaaacaaatgatgcctgccaactctacaacttaaatatgttttccgtgtatatagatatatacttaaatatatctactgtgtgttttggctttgaggttttcaaaaatgtgtattcaaatcgtgtagcgctacagctaattcagtaataaggactaggcttagtggctcctttctgtaatcccagcactttgggaggccaaggtgggaggactgtatgaggccaggagttcaagaccagcccgggcaacatagtgagacccacatctctaaaaacaaaaaatacaaaaattagctgggcatgatggtgagcatctgtagtcccagctgcttgggaggctgaggtaggaggatcacttgagccccggagttcaaggctacagtgagccatgattgtgtcactgaactccagcctgggggacagagcaagcaagaccctgtctcaaaaggaaaaagaagagaaggaaaaaaaatcaatcaaattctaaggtgaatttgagagtatacataagtttaatgaagatttttatttagtaataatcataggtgcacatgtagtaaggatagttttcaagcggtgttaaggaagtggagattgagatgttaaatagcatctgataggcgtttgcttttcaaatagacttagtacttcagcttcttactctagagacagaatacagttcttacatggcttttaagatgctgcccccttctggtgactaggaagattataatatctgtagcaaataggcattctggggttttttttttttcatatttaaatattagttttattactgaacctgaaaaacaaaatgaggatcagaggtagcgtctcctcctctgtactctcctttcttccttgagaggaggaataactttctgtctcttgctgttctttgtaaatgagtttccttttggcttkctttcttctgtccttccttcctctgatgggtagagcatctctgtgggccaggtactgtgttcagcatttcatgagatttatcaattttaaagaagaattgacaatatgatgcggagttttccagattgctgtttgttttgagagggagtcttgctctgttacccaggctggtgtgcagtgatgtgatctcggctcgctgcaacctccatcttccgggttcaagcaattctgccttggcgtcccaagtagcagggattacagatgcatgccaccacacccagctaaattttttgtatttttagtagggatggggtctcaccatgttgaccaggctggtcttggactcctggcctcaagtgatccacctgcctcggcctcccagagtgctgggattacaggcgtgagccactgcgcccggcccagattgctgtttttttttttttttttttttttatgatgtaaaagtatcaacatattttttaaagaaagtttcatctgctgctatctagaggaggtagctggaaccagagcaccaggctggcactggcaaggaggagagggcacctcccggcatgtggacggaatgacccaggtgaggcgggtgtggcgccagaggggcctgttgcagacctgaagaactccagtgtgttttgcagaaagggagtttcagagaataaggggcagccttgactcagacggcttgggagaggagtaagtgcagcccagcctccaggggaaggggaggaaaactgaaggtttgtaagggatctggccagcatggtcttgatgcctggaaacagctcctgggcttctcaccagtattgggagctgactcttagaaaggcagccttcctggggagcacaccctcgaggggccggaaaccgtgaaactgaccagaagcacataggtccagtgggcactgaaatacattctcaggaaggaagtgtagctgaagtccagaactcagcttactctcactcctgggcctgctgctgccttaatgtgcctgctcctgtgtttttgttctgataaacacgtatagcactttcaattatgctgttacttacagctaagtaaagcagtactaggtggatttgtcagtgccacttcctacaaagtgaaggctggatttttgggggactcatttccagcagccaccagcaggtggagggagtgagatgcgtaaacaaactgtccctcatgcttggtgtttgggcagatgyatygctaaagcgtgctcactaataaatcccctgctgatatggcacaaatatttatagccgatgattgatgtgaaattaacaaaaactagcagttgacagcgatatgasgtggcaaaggctatttgggaaagtttccgttgtctttgaaaattaagaaaaattatacgtttacttgccttgctaagaactgtttaagaataaatcaacataaactagggcagcttcttaaactatgatggagaagcacaaggtcaaagtgtttygtctcagaatgaagcagtaatgtattactttgcrtactgtgtacaggggccggcagatgtttctgatgttatgaagctatgctcctggaagtggttgtgaaaatcgcagccctgtgaattgtgtgccctaagagccagctgtgctcctaacagtgatgccgtctttccatggaaatcacccataagcacagccttcartctaacttcatgtcaagtctaagtggcacagctatccatgaacactgtaaacattcccagctccatctaaggtgattaaacggagtcagaacccggccatggatgtgtattcactgttatttaacagatgctcaaactagacaggtgggactgtccagatgcctgtggggcactacagagttttgaggaaatagagtctcagactggagccccaaggaccttgaggacaggagtctacctggggaggggcatcccagagacttactccagctgcttaactccggtgtgcctggagtcaccttgggaccttgttacctgcagatttggattcagcaaggcaaggtggacctgagagtctgtgtttctggtgagccacaggtagcaccccggctgctggtccctggtctggggaaaggcaggcagagttggagagacccttcccgggttcctggttgcaggtgctgtgtcatcgtatggctgtatttgaggggattgtgtaagaagatgttgttaaatttatttttagaataatagacttttagatagaagagaaacctcggaggtcaatcagctttcactcttcctctcttgtgccccagtcctagtgatgagaaaagcaatgatgtttcccaaggccggggctgtcgactgaattgtgtccctgcaaccccgtgtgatggtattaggaggtgggtctgtgggaggtatcaggtcatgggagtggaccccttgtggtggcacgaatgcccctcaggagcgcttgctctgtaccctatgaggacatcatgaggagatatggcttctgcaggaagaggcctcaccaggaaccaaattgaccagtaccttgaacttggacttccagctgccagaactgtgagagstaaacgtgtgttgttgaagtgcctctgccggtggtctttgtgatagcagccccagccgactcatcacagccagattaagggagatcaaaagagttaaggttccagactccagctcctgagttcttctatgtggaaagatgccccttcaaccaccaaggccagggatgccctgtggttcagcgttgtcacccttgttgcccgcctccagggcagagctgggggcactggaggtgctcaggacgtgtggagcagaattgggagtgaatgttgtgtgctcagggccacctccactctgcaagcacagctcccagagatgaggacggggcttgctttgtcctctgccacacacagcccttcatgcaaggccttggcccctccagggccacacaccttggccacccagcaagcaccccttgcttggccagtctttccgtcacttcctttcctttttccctgtctcctgagcttcagactagttgaccctaaggggtgtctccagctgtaaataactgtccagactgcttgtaaaggaaaacattgcaaccaccttactgcacaattgatactattattattttagggttacccaaaaatgtgcagcacgccctcgaatgacatggatttgttctaacgttggtgatgaaaaaaatggattcccgckggggccctgtctgtgtggagcgtgcacgcgctcccgtgtttcctgtgtgtggagcgtgcacgcgctcccgtgtttcctktgtgtggagcgtgcacgcgctcccgtgtttcctttgtgtggagcgtgcacgcgctcccgtgtttcctttgtgtggagcgtgcacgcgctcccgtgtttcctttgtgtggagcgtgcacgcgctcccgtgtttcctttgtgtggagcgtgcacgcgctcccgtgtttcctgtgtggagcgtgcacgcgctcccgtttcctttgtgtggagcgtgcacgcgctcccgtgtttcctgtgtggagcgtgcacgcgctcccgtgtttcctttgtgtggagcgtgcacgcgctcccgtgtttcctttgggtggagcgtgcacgcgctcccgtgtttcctttgtgtggagcgtgcacgccctcccatgtttcctttgggtcttccggtttccgtcgacgtcccaaagctgtgcacattaggtgactggcgtgtctacagcatcccagtctgagtgagtttgggcatgtgtgagtggccccgcgatggaacagcgccctggttcctgcctgcccccactgagctgctgggacaggctcccaccaccctgaactggaataattgggtaaataattatcttacttatttttacatgtatgtaagctcacgtttattgcagtgtttaatattagaagggctttggtctttatttagaagtttggtgatgtttttgtgaccagaaataagccataggagcttaactcttgtttatatcaaattaccctatgggaaacttggttgcattgtatgtcgtttcgtttaaagttgctgtttccaggaacctattggtgatgtgaagtgaggacttactggatgacgtgaaactaattttaactttcttttactcatcatcctgggattattcaagtataaactcagaattgccaaattaaatgcaaagatatgaaaaggagccgcttatgctaaatgtacagatgatgcgtttttgctgtaacggagtcgtccctccgggtgctgactgtgccactcagcatggtggcccagggctgtgtgtttggtgcacagtgggacgtcttagtcccactacctcagccagactcctggcaaagtctttattttttawgataatttatttttagattttattcaaaatgaaaacccatttaaaaagcacatgagaaatgagttctttattcactcatctaaatatttagggctgtggatgggctcagctgctttaaatatttggctgggcagatgagtgggagcctgtcttcctcttgttgacatttgcgtctgtggtggtgtacacagatgagctcactgctgtcctcggagcaggtaggaatgtatttatttactcgcatgccttcagatgcttgcagtaagtccatttgagatgctgcttctatttttccttgtggagaacttacttgacgccaacaaagaaatttctagctgcttgtagaagacaccccagggtacgcagccagtcccttccacgaatgctgcgagaacccacacagctgttcatttcggtggccgagggcctgtgggctgcagtacgtttacactgtgtgttgggggggtggcagtgtgctttcttcctgccccaattttgcccaggaggagtctggtgatggagaaggtgtggcgggcagcaaggaggctggggaagtggatgctgcagggtgagctctgggcgacccaggaggaagtatttgcatgaattagccacacgcagagggcagttatgtgtgatgtgggaaatgactgcaaagctrtcttactctttattccatagccacaaaaataagtttataaaaagcccccaccaagtcaggatttgtccagaatggtcactctgctttggagaactgcggatcccctgccatggcccatgtggctccggaagttccygggagtggctcgtagagcctgttttcatccttcagaggaatcctgcagtccacttgcccagcgtyacttcctccagtgccctttctgggtcccacgtgattctacctgatcgctggctctctagggcttttcccctccaggttcagagagagcgcctgccccagggctgggaagatgagcagggatcctgggatgtgatggcacggtcagtcgcccctggtggaggcaatgctggtacccacgacgtggagccctgaaggatgaggaaaataatttctgagaaactgactcagggaagtgcctgtgttcagggcggaggttccactgtgatttgaaaacaggcgattcttccagacaactttaaagatgagtaggtgcaaactgcagccacagtaaacttcagggtgtcaacttcaggggaatataaacagcctccagggagcccctctctccatcccarcctttcttcctctctcgtaactgttatttactcagtaattacaggttcaagtcccttgtccaaaatccaaaaagccgacactggaaatattctgtagctcatctggcagcagggccagagctgatgatctaattcggatgatttatggcctctgtttaccccacagacgatcagtgtgcctgcttccagggggctgctcctaagggaggtgctggcactaccttttcagcctgcatggactgtgctggaaacactcagtagcaactcaggctcagggagccctcacctgaagccctcctcttacccaccctctgccctatagacccccatactcctgtagataccccctcattacagacccccaccatccccgctggattagggttctctagagggatggaaccaataggccagatatgtaataaaggggagtttattaaggagtattaactcacaggatcacaaggtcccacaataggctggctgcaagctgaggagcaaggaagccagtcccaggccgaaagctgaagaacttggagcctgatgttcgagggcaggaagcatccagcacaggacaaagatacaggctgggaggctaagccagtcttgcctgttcatgtttttctgcctgctttatatttgctggcagctgattaaatgatgcccacccagattgagggtgggtctgccttccccagcccgttgactcaaatgttaatctcctttggcagcgccctcacagacacacccaggatcaatactttgcatctttcaatccagtcaggttgacactcagtattaaccagcatacccaccattgtttcacctgcagcctcccccatctcagctggtgctcactttatttttactgcttgttgttctggccccagatctcagagtcctggtaacgcctctcctcttctcactgccttcagtatccagccaagctgggaaacgccactgccmcagtacctgcagggtccagccagctccccacctccactggatgccactgtgttagcttgggctgccacgacagagaccacagagtgggtggcttaacagaagtgtatttgctcagtttgtagaagttgaaagtccaaggtcaaggtggcgtttctggtggggcccctctttctggcttgcagatagttcctccttactgtgtcctctctgtgcttgggggtggggagagaggcgagaagggaaggagaaagagatggagacaggtttgctgtctcttcctcttgttataagaacaccagttgtattagtctgttgtcgtgctgctaataagcacatacctgagactgggtaatttataaaggaaagaagtttaacggactcacagttctacatggctggggaggcctcacagtcatggcggaaggtgaatgaggagcaaagttacatctaacatgggggcaggcaagagagcttgctcaggsgaactcccgtttataaaaccatcagatcttgtgagacttattttctaccacagaacagaataggggaacccacccccaagattcagtaacctcccactgggtccctgggagccacaattcaagatgagatttgggtggggacacagccaaaccatatcaccagtccgtggagccaggtgtggtggctcacacttgtaatctcagtgctgaggcgggaggatcactggaggccaggagtttaagaccagcctgggcaacctcttttaaagttaattacttcccagcaggccctgtttttctggtacagtcacactggaggttcaacacaatccagccaccacatcacccaggtcactgcagtaacctcttagcgggcctccgtgccccatcccaaaaggtccattctcaaaggagactccagggtgacccctaaaacccaagtccaatcacattactcctgggcctcacacctgcagcagctctccaaaattctcaggataaacaccgatgtccttactatgacctccagggccgcagagcaggcactggcaaactgctgccacctgcttctgtatggctttctagctcagcacagtttctgtggttttaagtagttgggggaaaaaatcaaaagcataacttgtggtgcatgacaatgatatgaaattcatatttcagcgagcacaaataaagccgtgttgggtcatagccatgcctgtttgctcaaatgttatctgtggctgctttcatgtgacatcagcagaattcactggttgtgacagagatctacataattccctcgattttgtctcttggcccacaaaacctaaactatctactccctggcccgtggcagtggaactttgttaacccctgcttggccttctttcctcactacctctttgcccgccaggctcaccctcactccctccgctccagccacactcagtccctgctgttcctctagcacgccagccccagggcctttgcattagccgtgccctctgcctgagtgcccttccgcttcctgcattttgcccttccttcaagcctttgctcagtgtggccatcccattcagcctaatggtgcatgtttcctccacctccacagttcctcttatcctgtttccattttccttagcagttatccgcatcagacacatttctttttcttttttttgagaaggaatctcgctgtgtcacccaggctggagtgcagtggtgcgatcttggctcactgcaacctccgcctcctgggttcaaatgattcttgtgcctcagcctcccgaacagctgggattacaagcacttgccaccacgcctggctaatttttgtatttttagtagagaaggggttttaccatattggtcaggcaggtcttgaactcctgacctcaggtgatcctcctgcatcggcctcccaaagtgctgggattgcaggcgtgagccaccgtgcctggcccatcggacacacttcttactgatatggtttggctgtgtccccacccaaatctcatcttgaattatagctcccataattcccacgtgttgtgggagggacccagtgggggataattgaatcatgagggtggtttcccccatactgttctgatggtagtgaataagcctcctgagagctggtggtttcataaggggaaaccccttttgctyggctctcgtytctctcttgyctgccgccatgtaagatgtgcctttcaccttctgccatgattgtgaggcctccccagccacttggaactgtgagtccattaaacctctttttgtttataaattacccagcctagggtatgcctttatcagcagcatgaaaaacgaactaaggcacctactgtatttgttttcttgtctgtgcaccactgcggaactgtgagctcccagagtgcacagatatgtgccagacaccaagatcagaatgggtgcttcgcagtgctcaatacattatttattgaatgacttaatgtagaatgactagttacacagttcaggtgctaggaggcagtataaaagtcagagagcaaatgctttaagaaactgtagtatacaccaggaaatgcaattctttagttagataccttctcctttcagtaaaattatgttcagtgctgtaaataggcaactttcagtgatttgtttttcaaacaagtggctttttatcttttcctcttgacagtgagtgtctctccatgtgtgaagtattttctcctctcatatctgtgaagtcctgcttgtaagtgtttcggttatgcaacatttcatggggaatttgagcactggaattcttggtcgctagttaggtgggtcttaccgcatttgtcagaaaggaatgcgtccatcaggttggttgacgggttggttgacggtctgcaagttgcagtcttggcacaggcacccatcaaaatgacacacggtgactctggtttcttccagcatccccgagatgaagatgaaaaactgttgcatagcaggtggatcttgctagaagctctccagccatgtgattagtttatttgctcatttttttttttccttttaatataaatatatcagaattcaggctggtttcagaacctggcatcaggaatggaatttwaaaaaaaaattggttcagatgtatcattcctccaattggcatatataaaaagaatagtgtggctcttgcctggtaatactggcactttgggaagccaaggtgggaagattgctttactccagggatttgagaccaggctgggcagcatagtgagaccccgcctatacaacagattttttttaattagctgaacatggtggtgtgcacctgtagtgccagctactcgggaagctgaggcaggaagatcctttgagcccgggaggttgaggctgtagaaaaccacgattgtgccagtgcacttcagcctgggcaacagagcgagaccctgtatcaaaataaaaaaaaaaaaaagtgcttgttactgtcctctttatgccagttcctttaggttgcacattcgtgtttcttttttatttttattatctctttttttnnnnnnnnnnnnnnnnnnnntgcattagccgtgccctctgcctgagtgcccttctgcttcctgcattttgcccttccttcaagcctttgctcagtgtggccatcccattcagcctaatggtgcatgtttcctccacctccacagttcctcttatcctgtttccattttccttagcagttatccgcatcagacacatttctttttcttttttttgagaaggaatctcgctgtgtcacccaggctggagtgcagtggcacgatcttggctcactgcaagctccacctcccaggttcacgccattctcctgcctcagcctcctgagtagctgggactacaggcgcccgctaccacgcctggctaattttttgtatttttagtagagatggggtttcaccatgttagccaggatggtctcgatctcctgacctcgtgatctgcccgcctcttcctcccaaagtgctgggattacaggcgtgagccatcgcgcccagcctattaccatttttttttgagacggagtctctctctgtcccccgggctggagggcagtggcgcgatcctggctcactgcaacttctgtctcccaggtttaagcgattctcgtgcctcagcctcccaagtagctggccacaggcgtgcatcaccatgcctggctaatttttgtatttttagtagagatgggtttcaccatgttggccaggctggtctcaaactcctgacctcaagcgatccgcctgcctctgcctccgaaagtgctgggactacaggcatgagccactgtgcccagcctcatgtttcttttgacagataacatttaatagtaataaataagtggtaataagtaataaataataattgagtgcttttcacattccaggtgctgagctgttttgcatttcacgcccctcatcttcatttatattgttgttcttaattatccccattttaccgatgaggaaagggagattgtaaccaccccgaggctgcacagctaatacccagagagcagaatttcgccacatgcgaagattctagctaatcctaaaatctgtttttcaccagacgacgccggcccttccggcttgtcgtgcagcacggcattatctggtacccaccatttgtatcccggcatcatttatcttctccctaccttgttgccaaggcacgtgtgggtccctaacggctggaaacaccaattattcaagacaccctaagggagaccagaaggaaagcgatatttaagaaatgcaggcacagaaaaatttaagcattttagactcattctccatcagaaacagggaggtctttgaagaggctgcttttgtaaaaattgccagctgtacccggtcagcacatttttgttgtctaacatttgttctcaaccagcaattagtcaatgactctagaatttcagcgcagatccgatgagtatagaggacgcggtgtacgccctgtgttgccatggcaacgcaggcatgcacatcctcctcccttggctgcagtgtggtggtgaacagcactccggttgcttaagtgctgtctgcagacacaaagatgtgtttgcctggtgaaattacagagcttttctttctactttttaagaattttctacactttctccaataagtatgtgttttataaggaaaacaacaaaacaagcaaacatgtttataggtctgcagagaagaagagttcttgtaaacagtgttgaatattcatggttcccaagatcggccrtttccccggcctttcaccggtgagaagtaaggcatctgctctggccagtggcttgcgttccattggtcacccttggcattgcttcacatatgtttgcggctgcccttttttaaccccttggtgaatgtgatgtaggaggcagaagaaaggccttctgttctccacaacagcagaccgctgagagccgatcatgtatctgtttttaaggaaagcaaaacctgtttgccagagatgaacatccttcaccctggagccagcatctggtagatttgggggtttggggatggcaggaatgagttactcgattcagagaccaagaactacttctgtgaaagcatcatctgggtttatgtttggaatgtctagtatcacatccataatgaacctttttttaaaaaagtgggcatcagaatgaatcttgcatgtcaccaaatcgaaagccaatcctgagtcatagaagcattgactggtgccagaacttcaaagaaagaaggaacactgcttaccttaaattttaattgtttacagttgtttgcaaaccttttggcttggtggctcacgcctttaatcccagcactttgggaggctgagacgggcagatcacctgagggtcaggggatcgagaccagtgtggccaacatggtgaaaccccgtctctactaaaatacaaaaaattagcctggcatggtggcgcacgcctgcagtcccagctactgaggaggctgaggcagggggatcgcttgaggcggaggctgcagtgagctgagatcacgccactgcactccagcctgatgacagagcaaagcaagactgcctcttgaaaaaaaaaaaaaaaaaaaaaaagcactgcttaccttaaattataattgtttacgaacctgtttcacacatattatctcatctggcccatgagactggcaggtgagaaaaatgggtattaaattattgtttacatcccactgacaaaaataaacagggtcagctgggtaagggacgtttcccggattcgttaaggggcagaagtgggaccacggtgagttcgtttgtttccaaatccagagcccccccttccctgcccagacccagggctgcccctagaccatgcaggggaatgctaggtgggaaataggacattttgttgaagcccgatgcatgatttagcccaccagtacttgggttctaatattccattgtgtgctaaaaacaatgtacttggatcaaactttaccttatattcatgcaatctcacagttatgtggaaatctagctattatacagaattattagtctacctttagggctccccacagcaacaagcaaactcacagagcccagggcaggaggagctgttctgactkcaggcggccttgccaggagcccgttggcctgggtggagcccgttggcctgggtgtccactgtcagaggatggagattgatctggggttacctttttcagcctttgctttgtttgtcacctgaaggggctggatccygagccctgtaaggcccccttcggctggtgcacacaagaggacagctttgagcctccaccaaggtctctggattccactttaagtgcgggcttgggtgtgggaagctgcaggccagcctcgagggcagcctcctggaggtggaagggcagcggggcgcgagactgctgcgctggtgggatgcttggattcccaggccccaagtcactatcggggaacrttctttgaggtttaatagtattttaggattttttaaaggatagataatatctagatgttgtgttctaccaaaacaaatattgttcttttggaaatatgttagaccaaaaaaatgcatctagatcttcgagttttgacttggaagtgcctcaagtgagcgagtgcctgctgtctcagacatgaggtggatgctgaagagattacccctgacttcatagtctgcctgtctcagagcgtgggcgggttggcatcgtctgcacgttgaccgggtcgtttttagctttgcccacttttcatttttggcttcacagagtgatgcctctggagcatccccttgcggagcctcagcatctcttctctgcttggcccacgtctagcagttcttcttcatcttgcagggaaagtgtgttggcaaacatgctggatactgtcagaatcagagcaggctggatccatggccgtattctgtaaaattccattgtgtctttttttcccccaagtaatctggctctgggaggaaactcgctgattggagactagctgagagggcttggctgggattctgtgggatggggccttcaggaggtggagccgccccaggccatggagacctggagatgctcagggaagggggtggtcaggccctgggtcccatgttggcagcctccctggcccagcgttgggctgggaccmtctgcctctcccagtgagaccaaccctgccctctggacggatggaaggacactggggagccgatgatgcccagagtgtctgggggacgcatccagggtcccaggcccagaaaacartggagccaagagaggaacgaggtctctggattccggacgccctgctgctacttggcctccaaccaaaaaattgttcttctccttccttttttagtaggggagagaggagcaattttccatggaatatatctgatggcaggtcttgaggtcagtctgtcagaggcctgggagatcaggggacaagggtgaaattcgaatagattgtacgaaggtttgagagctggcatgacccacttttgaccgtaaaacctttcagcttgttcttgacttcccccccatccctaatacccccaactatgcaaatgatagtactaggaataatagtagtagaagtagtaataataattacagaagagcaaatttaagaagctaaggagggaggaaggaggcagtggtaagttctgcatagaaatgatttttgcacagagctttgtcattgggaaggatgcttatcacagggggctgatgaatttgtttccttcttgccttatttttggcagttttctttcttgatggtggggagggtttgtgaccaggtcctagtgaggcagctttctgagcactttttcttgatcactgatgatgaccgtaaacaagctgtgggaacataaggaaaagcagatgtggccactggtgcttggaagagaacacaatgaaattgagtccctagcaggagaagtccctgttaaaatggccagaggacatggggacatggggcagggagagcttcagaatgagcgggaagcctccacaacaggtggagaaaatagcaagggctgctgggcacgatcattcgagattccaagasgtaagaactgggggctgggctgtggaagaagtgcgagagggagtggggaaggcaggctgggcgtgctgtggttataggcagcctacatgtcttgagttttcagtagagaaggcctgctcctcactttgaccccggacctgcatgcgcgctgaggatggcagaggggctcctgcctgtctcagtgctctggrgtcccgtgctgagggagcatccttatggtaaacgtccctggttctgtaccggaggaacaggagctctggaggtcttctgtttgctgttgtatgctgtggctcagaagttatgtggccactttcactcccaactcacaggccagaaagtgtagtgggaggctgtgggcatatttggcgcttggcaggattgaaggcgcaactcttggcttcgtgtttcagaggttggtaaatggagtcttgctcgccaggtgcatgaggtgaagtcactgggctgggtgcagggagtgagtggccaaccacctgagaatacctggtgtttccttcctcagggacggtttggcactgggcaacagctccatttagctagggtaggataatggtaaagttgccagcagcaatgcttttcctgcatttgccccaactctgtgcagggccagcacttttagctcctagtcacagatatggtgacaggcttgtctccaccattggagtaagctccagcccagctcctggcttctgatctgtgttgactgctacccgatagagccacagtcatcctgtgtgcctgcttgagtctgcaccgaacatggctctagcttcttcgttggccagacaggatctgctgtatccttatgatacctcgtcatcttggagtccaccgtgcacttgtccgcttgggctgccataacaaaataccagaygctgggtgccttaaaccacagaaatgcattttctcacagttctagaggctggaagtccaagatcagggtgctggcatggttggactctggagagactcttgtcctgacttctagatgtctgccttcttgctatcctcacgtggtgcagagcatgccagctctctgctgtctctttttctaagggtgctaattccatcatgagggccccatccttatgaccttgtccaaccctaattaccttccaaagatcccacctcagataccatcgcattgggggttgagctttaaatacaaatttcaggagagctcaatacagcccatagcacagcgcttccgcacacatccacattgcagacccgccatcctcaaacgcactgtgctcccgtgagctccctgccctggagtggaaaccctgggctggggaggaggtgcgctaagactgggccacaggtgtgctctggttcagaaaactcttgcaggtcctacttcctgccttgacaccaccccctgcccacagccttctcattcttgtcctgtagcccagtttcgtttcacctgtcctctgcytgtaatccttttcagcccctctgaagagcggcccagtaggatggttgactgacgttagcttggctttcttcctaaggcaccgtcttcctcattgaaactgtgcccatgacctccggaagcctgccagccgcctgcctgcaaccccatagccgagtcagctccctggatgggctagtgtgttgaccttccactgccccgaggggaggactctgccctastggatcctccacctctcacttcattttgccagttgaaatgttcccctgcctagtgtagggactgccacttcatgctgtcttgccagagcaccttcccaggcagctgcaaaggtggtcttggtttgactcccttgtggcccacacaacactttcgttggagatgaagagtctccctttcagactgcaagccccttgaggtcaggatgctgcaacgaatataatagaaaatgatgttaatattcaaggtcatggccatcctcaatgcagccttcatattttcataatgaatagttattgtgaaggagctgatttttggaggagtggtttgtctgcwgttgcacacatctgtgataacatggggtgggtggttctgattcctgttttgaggtggtgatttatgatgcctgtgtacttccctgtggtgcccaggcctgcagattacagacgctgtgtaattagagaatccctctccacrtgtgttctctgaacagggagcccagggaggcttggatctttagattgataagcaggatagtaaaccagttgtgaggaacattgtatagagaaaaaacaaccttgagtttctgttgaaatctagatttggtataactgtcttcatttctttaaagagcattcatcaatgatattaatgattttcatttcctacctttgtagttttcatataaattagatttacataggagacaaagaaatccttccctccctgttccagttgtggaacatatggtcaccgttctgtgactgggagcattgctgtttggcrtgcttgtgggcacggtttaagggttgagaccacatcctaggtggcggtcacaaacccggcccagcggcctccctgctaggcagtcctccatcaatactgatgttaataattatgtaaaatcattcctgtccgcagcctagagtctcactggagaacaatcagacatgctttattttctacttgtaatcgtaatctgagtgcaatttcaggactttgttttccagatggcttattgtttcacacgttttcttttctcagtgaagcccaggtaacctgctgcttgggtgtacgctgggcgggttcgcagtgctggaagagagagtggacagattttacaccagcacctttcatctcaggggtgcttgtgaattgattgcaccyctcctgtggcgtggaggcggtgcctggttaaagtggggmtcagatgccccttggttgcatttaatgtgtgtgcataatcagagggcaaggacagcagtaaataatttatgtcagctggagcccttggccctggtaatgagatctcaggggcagcgcctagagtgctgggcccttccagatgatctatgaattggtctttgcctttgtacttattcaaactgacaaatacttacttaatagctgattgtattcaggtgctaagggaaaagaacgtgactgtgtgggggtctccctgactccttagaacctgcaaatgcatgaaactcatgttaagaacagttgtggttcacgtgtaccaaacttgggaaatcctgaccagcgcatccagggtygcttgggcacagtggtccttttgcatggggtggccggvcaggtgtgctgagtgccacctgggcttgcatgccggacgcatacctggcacctgcttccaggttggcctgccagccgatgttgtgatcttgtggagggaatgaccccacgtctctggattctggcttctgcttccagtgagactccgcccaggttatgtttgtggccttttatctctccaatgtgaggcatctctgatgatgcctaaggatgtccttctaatttggagttaacctctctttcccaggtgaggttagcaaatacgtatagattgtaacaagagaattttgcatttcagttttgttttttttttttttttgagatggagctcacgctgtcgcccaggctggatagagtgcagtggtacgatctcggctcagtgtaacctctgcctcctgagtagctgggattacaggcaggcaccaccatgcccagctaatttttgtatttttagtagagactggatttcgccattttggccaggctggtcttgaactcctggcctcaagtcatctgcctgcctcggcttccaaaagtgctgggattacaggcctgtgccactgcacccggccacatttaatattatttacctgagatttttgaggcaagcagccctggggatgtaagcaccttttaatttggcagcttatttgataagcaaatgggttctatcttaaaatccaaagttgtttacacttawtgcatattttgagagctgttacccaaacctttttccttccttcaatgagaagacttatatctttttgagcagaaactgtggattcagaaaccarcagaactcttcattctccttaaggagatagaggccagggaaagtgtttttaggtaaataataacgccttcttgcctctctccctttatctccccattctccctgaaaaaactacaagaaatggtaaggaagagaataaaagaggaaaataaatcacagataactagaaccactttattgctattattccaggtgatctactgataaattaaaagaaagatgaatataagctggtaattactttaaaatattcctttgtgaatgtgcctaattggcgcgggcctccctgtagaatgaggctcctcctgcagttcgaggagaggctgtaattaacagtgaattagcatatagtggcgccgygtggcccgcagggtggccttgtccatctgctgtgtaggggacttaggtgacacctggctagtggtagtctgcaagaaccctttgttaatgggaatattgtgcatgagtcagaattcagaatctttggtatggttttttttttttcccccttttgtgtgttttggccaaatactcaaaagcactaagttttcttgcgtggtatctgttcatatattgattcaccaaatattgattgtacatctgcgaatgtgctagataccctactggtgctggtgagcagaaacaggcaaggtctttggcctcagggggtccttggagtctagaagggatggtgacattggccagagtcaccccataatcatacagttagcagtgtggccagcgtcacttaaagyggggaggtggctggtgctggagcgtgtataacaaaagtgggatccggaaagggctgctggcgagtgggagttttctagggagccgctgctcttgcttcaggtctcagatggcataggagtgtgtgtcatcccagaggagcagcagcaaacggcctgtgatgggctggatgtatttggggagggaagaaggcagttgtagctcaagggagagaaaaggcaaggagaaacatggcgaggggtgggggctttgctctttagcccgtgagcagtggaaagtcattgaatgctgtctggtgtaaaatctgttagcagtttcacttccatctggagcacccaggcctgcaggagtgtgggttggctctctacccccgttgcagattggcttgtggtttggggtgtgccaggctcaggggcagggccctttttccacacgcttagggaagatacgagactggctaactcagtattcaccgtgaattcttttgtgggaaatagaacacagcgttgggtaccaagagggtgctgtcttttcctgttttcttggcctcctagggaatcagtttgattctgtggctattaaattaatggtttagctgagatgttttctctactcagggcccaatgccgtatgtgatattttacaacaaatttggttcactggggccgacttgaaaatagtcaaagtccaagtaaacttctgcctgtgtgtggtgcgctcaaataaaggaggctgttcaaggtgagtggttttcctggcggtgtggttttttaaaatttctaataaaatgcaaatgattacagccccttccatgaagagtgcaagtacgcctgactcctccgcgcagggaatgagcagcctctgctccttcatttgattgctatgacaacccacagaggtgggtgttgtcacttccactgccagccagcttgcacggtccagggacgtccccaccctcggttgggttgtccagggtcacatggttgggagtcagaaccagacttcaaagggcatgtgactacagcatccatcctccctgctctgcctcgcactgccttctaatgggtcccactgaggagcttgccagtattgttacaattggagtgatctcatatgaccaaaagttggaatgatcccattctttactcacagcctgagctattttttttcaaagcattatctctctactgtttgtaggcagagaatttattaaatcttgcctaaatttatccgtaagcatggatcaaatgcacatttggcatgattctcatctctgagccattgcaacctattttttaatgccaagagaaagtattttaaggaagtggggtcagctttcctctgctcccctgacttcacaggatagctatgcattttgcctcttggggagctgggttattgtgaamctaggtcaaattattgttttttctctttatgctcatagccattccaaagacagaatcctttcctcaaaaaatgaatttttgagtgttcctatattcttggggatgaacttcaagggcagaaaataaatgaaaggggattactttgacagcatctgaacaacagaacaccttctgaacagcacaaacacttgtagcaaaattaaaagaccaacaaaaatatgtattacatatagagcattgtcttctatatgtaaagagttcttataaaacaataagaaaaatatttcctaactaaaggaaatggacacaaaattcataaaagaagaaacaaaggagcaattaagatataaatatatttggctttgttgattaaagagtaacaattaaaatgacaggtgacttctgggccggatgcagtggctcaagcctgtaatcctagcactttgggaggtagaggcaggcatatcacaaggtgaagagatcaagaccatcctggccaacatggtgaaaccctatctctactaaaaatacagaaattagctgggtgtggtgacgtgcacctgtagtcccagctactggggaggctgaggcaggagaatcacttgaacccaggaggcggaggttgcagtgagccaagagtgcgccactctactccagcctggtgacagagtgagactccatctcaaaaaaaaaaaaaaggtgacctctttcttttcatctggttaagttcagtgttaaaaacaaaggcccagtgttggtgaaggtgatggaaaatagttccccttttacattttagtgggaaaaatgtaaattgagatagccatctggagagaaatttgtcaaacagtaataaaaaccctaacaatgtatttgacctctgacctggcaatttcatttctgcctatcttcttttaaccctagattgattaaactcgttaaataaaacacatttgtgggtatagaaaacttcataggtttctggcttcctgccccacctgtggtttcattctgcccagttgtgttcaacttgaaaacgcttggtgcctagcacagagtagacccttaataaatgtttctgtcctgaacagatttaaaaacaaatagtgaaaacaaaattctgaacgtatgattttaaaaatcattttgtagcctaacacttaggaaacgtacttttttgttgcttcgctgaagtgaggaggggtgtatcttgtaatttttaaatgccattattaacttccctagggatgcttgtaaaatgaacaaacgtgcatctttaaattttttttattttttttttttaagcttggaaagagttgaaaagtcaaagtcacatcagctctctagggattgggctgggctcacattttatgaatttgctgtaaagaagggaaacatttgctttcacttttggcatgctgaagtggctttaccagggaattgtgactttaattttaagaattaatcgtaatgtagggggaaaaatgttcttaaaacacaaaacaaacaygtgtgaatagatgaggaacagcagttaaaataataactttcaaaaactaggttaaaatgtccagagaattagattttgttaatgttcaaagcacagctaagttactttttctacaaacaattcttgaaaacgtttttgatttttaagaggaaattagaatagtggttgaaatcatgaggccccaaatcagcagtgtgcttgctgttaattttgttgttgtaaagaacatttgtttttggccaggtgcggtggctcacacctgtaatccgagcactttgggaggccaaggtgggtggatcacctgaggtcaggagttccagactagcctggccaacatggtgaaactctgtctctactaaaaatacaaaaattagccaagtatgttggtgggcacctgtaatcccagctactcaggaggccgaggcaggagaatcgcttgaacctgggaggcggaggttgcagtgagccgagatcccgccactgcactccagccttggcgacagactgagattccatctcaaacaaacaaaagaacatttgtttttgagttataatctctgtttctgcggcctggctaatagtttggatagaaacatgtcttgcatacatgagtatttgttttttgtttttaaaaacactccaaattcagatttcttttattaagtaagtggatgcagtgcatagttttgggatatgcatgcatgcacttttgaatttaaatacatactaagatggcagttgggggacctgagtctcccttgtggtgctgtgggtttgtaggggccggcgagttaactgaactgagttgagtagctcacatctcgtggagcatcaaccaagaggatgcaacttgtgtaactgtgagaagctcagacttggaagatctgcgtctgtatgtgatcgcacacattttggagggtgggatgtgctcggtcttgggcgcgtgcagtttttgctcccttttactgttactgcgttgatgatgtgtaacccatgatatccatgagttactgtgatttctttgtttattttgactcagagctccaaatacatgggatgctagcaatttctgtgttatcattactaaaccacaagagctggaaaattccagtaggtttttgtaggtgatttttcgggagcagttggttttccttggccttcatcctactctacagagtgaatgtgactaggttctgttgtcatggggcacctggtctatcttgcaagttgaagcccctatctgtccagtttaattgacctcctgcaggtctggtctttcttagtttttttctaaccttcactttctggtagacccatttcacattagtgcaaaaattttcagtctcaattcaggcataaagcttcaagttaaggatttatagatgaaaaggctttagttattttatctttttattaaggtccatttttaagcttatatttaaataatgtaccataaaagcttaaaattacaagacttaaaattttaatagtggctgttaataattattattactgagctcttgttatgtggtatgtataatcttatttaaccctcaaaacaaaagcagaaatcaaaacctgggtgggtagatgtggtagacgtaataacggcccccaaagatgtcccaagtcctaatccctgaaacctgtgaatgtgtgaccttctgttggcaaaagaaattaagttaaggaccttgcgttgggagattattctgggctatctgggtggatctgtcataatcacaggggtctctataaaaggaggcagtaagaatgatcttttgggtcagagtcacagaaggagatgtgaatatgaaagcagaggctggagtgatggagccatgagccaaggaatgggggagagcgctaggagccggaaaaggcaaggaaatggactctaccccagaacctccaggatcacagccctaagtcaccttgattttagcccatgtcgattttagaccttggatgtaaggtaagaaatgtgtgttgtgtcaagcaagccaccaagtttgtggtttgttacagtggtaatagggaactcacgcagtaaggacagggcgatccccactttaccatgaaggaaaccaacactcagagaagttgaatgatttgcccgagttcacatcatgaagtgggggagctgggattcaaacctggggctgaagtgggggagctgggattcaatcctggggctgaagtgggggagctgggattcaatcctggggctgaagtaggggagctgggattcaatcctggggctgaagtgggggagctgggattcaaacctggggctgaagtaggrgagctgggattcaatcctggggctgaagtgggggagctgggattcaaacctggggctgaagtgggggagctggtcaatcctggggctgctggagcctaggatctagagtgcagtctctggcctggaggagagaagaggctccctgcagatgcagctcttttccccatgtccacccctttaatttcatgagcatcctgggctggctgcactagaaggggacaagattgccaagaggcggccagctgctggagatcagcaacaccagcttcggcgcccgaattgctgcacattgtcccagcagctcaagtgtctacctcctctgatagcacaggtgtctgggcaattctgcattgcaacaagggccctgttctacttttttctgcaaggtttgtccagagtgcgcagccagactatatgctgggcttggttttcctgagccttggccactgctggcgccccgatcccgggccagttgttcttggtggcatggctgtcccaaggagacacatgttactgtctctgtagctgcctgtgcctccaggtgtggtgctgccttcctgggcctctgcagcacctgccctcggcccccagggaccttctttgtcacagctgaagccctcgcatgctggagacttgtcattcttctcctgccgggcatggatgctgacaatagaactactttccagaaatcagcaaatgctgggctgtgccttcaaagtatatccaggatgcagtggcttcctgagccacctcagccattagcaccctggtcccgggcagcagcgttgcttggcggattactgctcwcctcttcaagccgatgctgctactctcctggacagtccacttgcccagcagccaggggcatccctgagaagccgggtcagagtgtgatgccctctgccaaaacctcctcctggccctcgccttctgccactctccccttgctcatggctctgctgatccttcaaccaaatgcatgctcctgacccttacatgtctgcactgcttcctctttttggaaaaccttcctgggggcccttgcagcttggccctcgcatccttcagcctcacctccagtgtcattgaggaccctccgtggcacctggccttcctcccagccacagcccctcctcctcacctcctcacctgcttcctatttccccataaaccccagctccctgacatgtctggtgtctctctctccccactggatggaatataagggcttgtgtttgccgtttccccagcacctagacaggacctagccaatgctaggccctttgtcgatgttcgttaggcatgcaggtgaacaagtgaatgagtgatcctgagtttgctctggtttccttctagttgtgggaagtaattcctgaattgcagccctacagcttttattggtgacaagttcttgactccccatcacctctgatggagggggctggggtctgttgtgagttcaggagccagggggctgcatctgcgtgttggctctgctgctgaagtggctggatggccttggagatctagttaatttttttcctttttttggagacccagtctcgctcttgtctcccaggctggagtacaatggcacaatcttggctcactgcaaactccacctcctaggttcaagcaattctcctgccttggcctccggaggagctgagactacaggcgcccgccaccacacccggctattttttgtatttttagtacagatagggattcaccgtgttggccagggtggtcttgaactcctgacctctggtgatccgcccacctcggcctcccaaagtgctaggattacaggtgtgagccaccacgcccagccgatctatttaatttcattgtgccttggtttcttcatatgtttcaataaaatgggtatgttaacagtctctacctcccagagtggttggggttacgtgaagtaagcttagacacggccgaatgagccagagcctctgctgctgccattggcgttggcaccattcttacctcctatacctacgaggctgtcatgtgaatgtgtcaagggccctgtcacgtctctgagccggcttctctgggcactggctgggctgaccccaatggcccctgcccatcatgcatttaggggctcctctgactccagatgtcagtgacccttytggtctctccaacacaagggttggtcattccctgtgcccattgttcatgcattggaacttggagtgcctgctctctgccctgggtttatgtcctaaggatttgaagatagaagaggcacagcagtcacttgggagctattcccagtctaacaggagagggcacatggcagtaaccccctgggagcggctgctgatgttctggctctctgcagttgggtaggagtggaggaggggtgcgatcggaagggagtgccgcgcagaccccccccaccccctcagaacagcggccactgtgtggatgtttctgacggcctcttacagactctgtcctttttgttgtagctgatggagcagaattttaaatgcattcctctaactagtggtcagcttgctactgyccaacctaagctcatattcaacactttagaatgccttaatcttttcttgttgtgttttgaataggttacatgcagacatccaaaataaacttttttttttctgtacaaaattagatttagctaaagtagcttaggttttataaaagctgatgttcttcatgctcttcccaattttgggaaaggagccttcgtctttgcttcctaggaatggtcatagtcacaccagccctcctgctggctttgtagaatgctcacagtggaatagactgtcagcaggtcctgagatgtgactctggacagccagtggtctgtagcattctcatccttcagagctccctgagcttcttcacggccacgctgctctcctgcatgtccgcccatctcactggggtgatgaatggatctagacctggtgcctggactcaatctgcagagacaggtgtctgggatctgaagacagcagttggggaggacagtgttggctgctgctgtgcttcctttaactgaaccccggtggcccagttgctcctcttggtggactcactaagtcaactttgaygcttcagccaacgtcggtttygagaatgcgacctatgaaattgggagccctggctggatcagaagcacatggttcagtggacactgtcagaggtgctgtggatcacttggaccacggtagctaatgtttgtagcgcgctcacrtatgccagactcttcttagcgctaagccattttcccaggccgggttatgcagtgagacttcagggcaggcacacatgtcgcttcctgcacccacactggacagtcattgtagaaagtaagatgtgatgttaatagtctcttcttggagtcagcactgcttcacggtcctattggcatgagaaccacgtccccagctattcccacctgcacactggagggaagcaggaggggaacaaagtcaacagcaatgactgtcgctgaatcttaagtttattctggattgagaaaagtggaagaggttagaagctaacttggacattctttttgggggaatagatgtctctcatgcagctcattttccagtggattgcctgatgttctccaggctgctacagctatgatattttaaaatcaatgggcctttcctttcatttcgaactttcaatacagctgcagaaacaatgcatctgaacggatggactgttttggagatttatgcgtgttctgcaggctgacctctgcttgttgatcgtattacagcatgttgggcatgtcaaatgaatctgggcgttagcctacaaatcaagatttgctttgcctcgttgtgtaaatatcggcaaaccatgttttggggatggaaaattagttaatttggagatggtgggttattagacttcacttggtctgcacgtggtggctttgggatttgctgcttcaaggtttcaggatgacacaagccatcgggttgagtgtgtttgtttcagcccctcttgctgagcacttctctcttcctgttcctgtgctgctgggccttcacagcatggtgctcccaagctagttgctgaagctgtgggccattgagccagcctggagatgcatggtaggttagggtgctgtgttgcaggtctgtgatgcagttgccatrtattttttgacttttggatcttcactcctcccctcattttggacattttctcagaatgaatgatacatctctgctttcagcctccctaagccattaatttacaygtcagatttttttgagtattgtagtttttttcaatatttatggaatgcttagtatttgtaatgcaacaaaaggtcagaattaataaggtgtagtgcccaagaggaatattttgtttccattttcaagatgattccaatttgagctgtctcctggagaagttggatccatttgtgtttctgagtgtgcttgtaagcagtcttaggggatctgtcactgcttactactaacagaagaacaccaaaataaggccaacctgctcccaggctgaatccaggagagccagtggccaaatatcagctctgcagccaccgttgcaagtgagactttgtgaaaggaaacttctcaccattaaatgtacattttatcttaaccgttgaatgtacaggatggttcaaatactaaaaactggagaaaagaccatgatggatgtcatttctccctgatgggacattttaccatatttgctttctctgtatgttgtgcgtgttggtgtttatggaagaaacacctacagatacagtggaagtccccttgcccccttctctgttctgttgaagatggtctgtctttcccatctggatctctttcctccgctacttctgtgtccttagacagtagatggtgctctgtgtgcatgaggggaagcacctacagtggtcgcctgctgaagatgtccttcagtggttrgaatggaaaaacaattgttctgctacatgttgctctggttctttcattttacctgctctagaatattccatttagaacttaaaatatttcattacttaaatattgctttttctgttctgtgtgctgtaaagtgtatgtgcgtgtgtgctggcattgtaatgtttgtgcttgtggggaggatggaggagattctgattttgccaggggtctcagctacagcccctcagatcattgcaggtgatatggtttggaagtttgtccccttcaaatctcttgtggaaatgtgattcccagtgttggaagtggggcatggtgggaggtgattggatcatgggggcagatccctcatgaatggttcagcaccatccccttggtgatgagcgagttcttgctcagttagttcatgcaaattcaatttaaaggagtatgccccttccccactccccgacccctctactcatgctcttgccatgtgatgtcctgctcctccttcaccttctgccatgattggaagcttcctgaggcctcaccaaaacagatgctgatgccatgctttctatacactctgcagaaccgtgtgccaattaaacttcttttattaattacccagcctcagatattcctttagagtaatgcaagaatggactaacacagcaggtgtgatcattggatgaggaaggctctcggaatcattccaggtgcctgctctagactcttggtgttgctcttctttccttcatgaccttgaactctctgactccagcagtcccctctgcacatgcctgaactgcttcagggcaccctacaggtcactcaggcctccaactctggggtgatgcctttagcagcattgagtataaggtgacctggaggaggtgtgaagacctgcgcatgtggacagtttgaaagcctagctgaggcagctggaagaaattcatgggagtcctgcatcgctgaggtcaggggaggttctgtaaatctgggagaaaggtgcctttcctttggagggatggtgggtttcaatggtttgaaagagaaaaccatgctttgcatgtgtctttttaccaacccaatgagattgctgattttgcaagtacaagtcaccagattttagttgtttataaacttcagcttaaaaggtggggttaatagggaacaacataaatgagggcaggtgtgtgtttcagggatctttgtgcaacttttctaaatacagagttggttgtgacatattcagctgggggaaaatagtcgtctgaaatatattatggtttgtttgtagcttcagctagtacttttcattgtaatcatggctcaggtttctaagagaaaattaaaataatttaggatgttgccccacactattgggaggtgtagatgttgctactgcatctggaaagcattgtgacaacatgtgaccaagtattaaaaatgttctcacatttattcttgaaattccacacagagaaaggtgtttcggggaagtagaatattagcagagctatttgtaaaaataatgcacaggcatttgctgctgtatcctatgagcgaaaaattgggaagtgtgatatctgtgtctgcctccatactgtacagaaatcactgaatataggccagtgcggtggctcatgcctgtaatcccagcactttgggaggccgaggcaggtggatcacttgaggtcagcagtctagaccagcctggccaacatgacgaaaccccatctctactaaaaatacaaaaaaaaaaaaaaattagccggttatggtggtgcatacctgtaatcccagctacgcaggaggctgaggcaggagaatagtttgaacccgagaggcagaggttgcagtgagccaagatcacgccactgtactccagcctgggcgacagagtgagactgtctcaagccaaaaacgaactgaatatggctgacactctctccctcataagcttgcttgttccattaatggggagacccatgtaaggtctgggtgcagtgcatggcacatgggaagtgtgtgtgacagttaatggtggcgttttttaaaagtacatatgtctatagcagtctggaaaggcatacgccagaatgtttgtggcagtgacagtggattttataagtgatttttttccctttacattttttcttaaatatgcatttctcttttcctcaatgaacacgctaattatgtgaacagttatttaagaagaagtaacctgagtaatactaaaaatgtattttctgaggggcgaaagtatagttgaagtaaaaagttttagtgcactttccagaatgggcyggatggtgactattttaggttttgaggatggtaccgwctctggcaactcctcaactcttgtagggagaggtacagacacaaattggcatggcgtgtttcaataaaactttatttacaaaaacacatggtgggctggatttggcctgtggcccatggcctgatctctgttctaatatgtcccattaaggacttttgtttttgaaatccactgatagtgggtcattccagcgcatagatatgttgggtttattttcactgttcacataacgtaagtttgaaacccaactgtcttaagttgaaaagtaagacatagcgtggatattgttttgttctttaattttacactgcagaatccttttaagaaaacaattcagtctatcttataaaggggagtggcattgtcccctgcttttcctgtgctggccccaggctgttttgaggttttttttttttttttttttttttgatagggtctctgttgcccaggctggagtgcagtggcgygatcttggttcacttcaacctccacctcccgggtttaagcaattctgcaacctctacctcccgagtttaagcaattctcctgcctcggcctcctgagtagctgggatcacaggtgtgcaccaccacacccagctaatttttgtattcttagtagagacaggatttcgtcatgttggccctgctggtctcgaactcctgatctcaagtgatccgtccaccttggcctcccaaggtgctgggattacaggcgtgagccacggcgcccggctattttgagttctttatgttgggcatgctgatcccccagcctcagcgtctgatcgtcttggtaccaagtccactgcccgtggggcttattttgtggtgtgaggtgaagcagcagcatctgttgattttggggtctgtgtcccccagattgcccaggatagtaatagtaaaatgcctcgtccccggctcagcccttagtctcccattgcaatactcctgtttgagattattcacagttggggctcatgtctattgctgagaaagagaaatggtttttcttggtgatttttctcagtgctttgaatgttatttttgagttctggccaaacagagatgggacaaggtcagaactagaaaaatatgtcctataatcttctcaatgggagggaggaagaggttcccttaggagcatgaacttaggaaaggaaatggtgcgtttggtggaaaagaaggggggcataggctgaattgggacagtgcccttgactgacacagggagagggtctgagccccccatgcacttactgggcaggcttcccccygaagcaaggtggacctgcttccagtgggaggagaagggggagcactagagccctccgtgagaccattgactgcactggggtagttcagtggtgagcggatggggagaaggcagggccagcccccagcacacgtcaggcactgtctgggcacctgtgcattgctgcctacagtcctttcagagactcggcaactcagcgagagtccctcacttgcctgtgagctgctccacttggtggaggagctgctggggcagaggatactgagcctgaccactgccctgtgcttgttcctgtccccatggaggagcactggacttgtccaggggcacctagcagggakccagggacccaggcagggccggaaaggggatgttctttgcatggatttctgggaatgtacttggcagaagggaagcctgggagtgagctccaggcagaagaacaagcaggtggaagtgcccggttctggaagagcccagggtatctttgggggaagatggagacaagatttggtgggtccttgaatgctctggaaagaagggggagccattgcccacctcttttttttttccataggttattggggaacaggtggtgtttggttacatgaataagttctttagtgatgacttgtagagattctggtgcacccatcacccaagcagtgtacactgcaccctatttgtagtcttttatcccctgcttcccctcccatccttccccccaagtccccgaagtccatgtatcattctttttttgtttgtttgtttgttttttgactccgttacccaggctggagtgcagtgctgtgatcttggctcactgcaacctctgcctctcgggttcaagcaattctcctgccttagcctcccgagtagctgggattacaggcgcctgccaccacatccggctaatttttgtatttttagtagagacggggtttcaccatattggccaggctggtctcaaactcctgacctcatgatccagccgccttggcctcccaaagtgctgggattataggtgtgagccattgtatcattcttatgcctttgtgtcctcataccttagctcccacctatccgtgagaacaacaatgtttggttttccattcctgagttactcagaataatcgtctccaatctcatccaggtcactgcaaatgccgttaattcattccttcttaaggctgagtagtagtcattgtgtgtgtgtgtgtgtgtgtgtgtgtgtgtgtgtgtgtatgtgtatacaccacagtttctttatccacttgttgattgatgccactgcccatctcttgagatgcaacaggatcagacttgttggggagcaaggaggaaagtgggtggtgggaggctctggccctagtcagacaccgtagaccaagaaaaggagaacaggacagagacatgaaaatcagcaggtgagtatcgagtgtccagcacaggggccaggtgtccagcatggggacttcatgaggtattttaagagtaagaagtcattgaggggccgggcgcagtggctcatacctgtaatcccagcactttggaaggccagggcagggggattgcttgagcccaagagtttaagaccagccctggcaacatagtaagaccctatctctacaataaatgtaaaaaaaaaaaaaatagctggacgtggtggcgtgtacttgtagtcccagcccctctggaggatcccttgagccaggaggtcaagactgcagtgagccatgatcatactactgcactccagcctgggtgactgagggagaccctgtctcaaaaaaaaaaaaaaaaaaaagaaagaamagaaatcaccattgataatgtggcatgaatagacttcatgacagacattactccagagatttttatgatgctttattaattaaagtatcatcttcaaagcagatgttaaccacttcatcactgtatacaaaatgtctgattacatttaatttttttttccagcaggatggaaatgcattaagatgaaactttaaaaatataggactgtagaaagattttgtgccaaattaaacatatactgaaacaaataagttgttttttgaaaacccagggagstatcacacgattgttaatattttagtggaattcctcctaaacgtctttctgtacttttttttttgagacaaagtcttgctctgttgcccaggctggagtgcaatggcactatctcagctcactgcaacctctgcttcccgggttcatccaattctgcctcaacctcccgagtagttgggattacaggtgtgcaccaccaagcccagctaatttttgtatttttaatagagacagggtttcaccatgttgatcaggctggtctcgaactcctgacctcaggtgatccacctgcctcggcctcccaaagtgctgggattacaggcgtgagccaccatgcccggcccctgtacattgtttttttaaagatgtttgagatagggtttgtagccttattaacacattagcatttttccgtgtcgtgttgtaatattgcacatccatgttactggtaagctgtatttgagaaagaattagggggttagtttggggagcagcrgctgatgtgtgcctcagttctcaagttaattggtcctgctccttctctgccctggtgtgcccctcggctcgccactggcttaggtgcaggtacatttgtccttcatcggaacargaccaccctcccttggctgccaccatggcaacgctcagccccgctgcctccgtttgtcatttctcctcctaatgatttgaactgaggtctgtgtgctggcccagcccgttgcgggtctgcataatgtatgaacacgagtgacagccagccgcagcccgatcaaaacaaagagccgctgcacgagaggggcagattgcggaagcatattgtgaacacattctctggtaactgtgaatcgtgtcgtaaaacgcgtctttggcctgtcaaaaatattttgacagggcccacagtctagctccttcatatgcaaatgcactggtaatgcctggataccagggttacacactcagggaaaatccacaggacgagggctgatgttagcagggttcattacttctgcaaataaacacgttgaagagcctccttccagtgggtaaatggcaaactcgataactggaatgctgtcagatcccagggtaacaaaagggtggtgtcccctaaaggcttggaaggattgagttaggagagttcaactgaaaagtcaagcatggcgcaaggaaggacgatggattagccaaccatgaccggccaggctgtgcgagctagccaaggagaggccacgaggcgggagagccaaggaggacagcctccrggtgggccatcactgctggtagagagggtttctgggtcccaggaccggactgcgtggtcctggttatacctgctggtcaaaggtcagtctgccaaggcccctccttgtgaagatggacactgagggcacccttcctagaggacctatttcctcttggtgctcttctgctttttgcttcttccctgggcttgctttccgtgtgattctgggcaagttggttaacctctctgtgcttaggtgaccttcgatggcacgggggatagcagtatctgcttcacatggtcagaaaattctgtgaggtgacacacggagccttggagctgcctgtggcaggtggcggtgctaattaagttccggctgttgtgacggtctcctcggctgggtggcccttcctgctgtcaggtgtggccactctcgtgagatgcaactggaggtgttttgtggcagcttctggaaggcctgcctttgacccttcctttctgctttttccatctgttacctgcatgcatatatgatggctggccaccatctgagactgggacagcaagggtcatgttggcattggaaggggtctgggtttatggggtcaccagcctcaagggacagcccacctggagattttgttaaggggtaagagaaatattcttctgtcttgtataagccactgttatttggggttttcagacatatgtggccaagtgattctaattagcatacaaggtgagaatgtgttatctgcaagatccagagcttagccgccctggcagttcagtgacttaaggggagttaatgaactggttttctgacttcatctcccaccaccagagcagtgttcgcatgaactgcccagccagctgtccccaggagctaaagaagtcagtttctgagcttcagagcctttggctatcctcggggtgcctcagagtagtgagggcagctctgggggactgggacctctcagcctcccctctgcctgtgtgttcctccatggagcccctgtttcgccacgtccattacgcttgcagtagtcagcaactgcctggtgagctttacatgcctgatgggctttggtgagctggcaagtctgaaacacacctggggtcatctgtgaccatctgctgatggccaagtttgatagggtttatttttcctttctttgctgaaatcgggctggggtcttggcagcaattgggaaactttgattgcttcagttgcttcagtttttctagctccacctggcctccctctggggaccacggttctgtcacctctcctgctatttaggtggccgtgtttcccatgctaaacagtgcccgctgatttaatcaagagacttgatagccggccattgcacgttcatcagcccggttttcctcttgtggcacctggtggtgtgctggtgtgtggtttataaaacatgctctgccrctttgatttccctgcttagatttacataattgttttwgaagaaggttcaggtgctttgctggcagaaaaaggaagacgacctcttgcaaagtggggttagccctagccttgcaggaaggggtctcggcttccttccaaaccagaagcccgtggtgcagcctctgaacccccgactcttggtgggcttttgagttctgcttttgcttgaacttctagcggcagaaagggggtgatccctttcttctccatcataagggtcatggcccacatccctgtaacaaaagacaggttaacgagagaaaagcattatacatttacttgatcctggttttacggcatgcgggagcctacggaatgaagacccgaagattcaggggaggtcgtctgtgtgccttggttccatgacttgggggcagccaagtagaagtggaattggacaaatagggcatgagcgggccgggcgtggtggctcatgcctgtaatcctagcactttgggaggccaaggtgggtggatcacctgaggtcaggagttcaagaccagtctggtcaacatggtgaaaccccatctctactaaaaatacaaaaattagccaggcatggtggcgggctcctgtaattccagctactcgggggctaaagcaggagaatccctcgaacccaggaggaggaggttgcagtgagtcaagatcgcaccattgcactccagcctgggtgacaagagcaagactctgtcttaaaaataaaagagcttgagtgaattgtcatagatggagtggggagacctacaaggcctgtctgttcagattcctcttggcctctgtgtaacatttcttcctctcgggtatgggatgggacccctctggaatgagggtcttaattaccttatgacagctttacctaaaaagatgggggaaggttacagtaatatttttaggcttatggctagctttggggaaaaggggttttggtttctatgacctgtcttagggaagaagaattctagttcctgtggctcaggggagaatgaggggcaagagatcaggagagcaggagaagctcagagagaaacttggctgcatctgagggtggcctttactttggggtatcagttttccgagccccagcaagcccctccctgcaaagttgcagcccccagcaagccccccgccgcagagttgcagcctggtgccctgattttctaaagatcttgggtgggcggggcccacaggcatgggggaagcggtagctgaggctttacggcaagttgtggggcttctcacttgattttcccacaattaatcttgtctgtctcctgaatttcttcaagtcctgatgataaattatggcatatattccagaatacatgtttgagtttgcattggtgcattgctagaggaaagcacccagttcactgtgtatctctgtgtacctgtgtatttcatcgacacatcctttggagtcttaaacacagcagcagcactgttgtggtgataattacgcaccctgcatatggtactgtttaagcaacaaagagctgagacttcggaaggttcccaagggcatccctgagatgggactcggtcctgtcacaagcagctgtgggagctggagcttagaagctgtccatcaaaaaaccaagtttttgtgtcaaaatggagtctctcaggctgtgaagcaagcccatctctaatcagttcagccacctgtattgcagactaattgtgaccaagacactgcgaatcatcagagaaagctgagccttgtagggaatctggggacagccgtaagttcttcctccacattccattttagagaggcttgtgttccacatttttgtggctttttcctcatcagatttctctgtgttcttgctttagtttgaaactgagaacactaattttttttattttgatcaaaataaaaccatcttttcaaaatgtcaaaatgtttaattttcagagagaattgagtttacgtaccacgaaggaggctctgttttgttccggcacacgctttggctggttattggtgttaggatgtgtttgttccatgtacgagtggatggagcagacagtgcctggtccacccccacctcctcaccctcagcctcccccccgctgtagacagtggccaaccgtgtgtcctcagatctgcatggaatttcctgtggcgctttctcaattctgggaccagttttccctctgaagcgtgaatgtttcctctccagttgggaatctcctgcctcaggacctggtggtctagaggtactgtggtataagtagaaagagcagctggacttagagacaggcgtcctgagtgttgatgccagccttaccctgaccctgtgtgtggcagcagtgggtcggtcaaacctttccaagcctccgygtcctcatctgaaaatgggaatgaggatgcctatccgaggtgacttagcagaggatgaagcactcccgtgagtgagctgcgcacagtctccttgtacaagcaggacatttctccgtttctccttttctctgcccgtaggattgactttcatcttgcctggtaataagccctcctaggaaaacaaattactctgaaaatttgtcattttggtgtggtgaattcgttcttttattcatcatccaaaaagttccattgtttgagatgattcaacatgatttggaaaccatggggtaagtctctgaggaacaagaagacagaagaaagaacgcactttggttttcttttggaaacctagagcaacctactagatcaatgagttttctagggaggcatcagagttagccatggcaccttctccaaagctgcctcgctcctgcactgatgctgtgctatgaggagccacgttgcccggaagtctgatgcgtgaggcgggaaggttaaaacttgttggctttggaggtttactgataggtcgttctgagtaggacaaatgttttcctttccgtgctttaaaagtctcatcttagaccrggcacagtgactcatgcctgtaatcccagcactttgggaggctgaggcaggtggatcttgaggtcaggagttcaacaccagcctggccaacatggtgaaaccccgtctctactaaaactacaaaaatgagctgggcatgggggtgcatgcctgtaatcccagctacttgggaggctgaggcaggagaatagcttgaacccggaaggtggaggttgcagtgagccgagatcgtgccagtgaactccagcctgggcaacaagagcgagactctgtctcagwaaataaataaataaataaataaataaataaataaataaagtctcatcttatggagcaaaagattctaaagagaaaggctggtcctgaatttcatccagcttggttctggtttcttctcctttcttcagcgagtgcagggcctttatccttggggcacctttctgggactttatctggctgtgtgcagacagacaggaaagtgtcccctgcccccaatttttgggatgaccacyaaaaaatgaacacacccactcagggagcgtttgtgggatcactgaagtcaaataatttacacccaggagaaagcccttcgctgtggatgtgttcatgcctgtggaaagggaagttggctatctggtctcgaaccctcagtcactgtcagggacggcagagaactcatccagaaaccaagtgttgatgtgaagcctccccttccagaggccccccagcgtccactcccctaggcatccctcacttctggaccctccacatcagcatcccatgacattgggctagactcactgttccaggactccgctggcccagaggtgagtcggcctgaccaagtcgtcgtgtcatcacttgttgggggttgaagtcctaacgcccggtgcctatgaatgtgatcgtctctcagaatggaaataaggtcgtcgcagatktaattatttaggatgaggtcatgccagagtggggtgggcccctcatctaatatgatggatgtccttctgagaagggaaatttggacgcagatgcacagagggagaacatcatgtcaaggctgcggtaatgcttctacaagccaaaaagaatgccaaggataaccagacagccgccagaagccaggacagaggctcgcagcagaccctccctcaccgcccctaaaggaacccgccctgctgacgctttgatcttggacttctggcctccagaactgtgagacaatgtatgtctgtttctgaagccactcagattgtggcactttgttagagcagccccaggaaactaaaacgtcacctgactcactgtgggattcagcatcttgtacgaggcaggtgccactggtctcagtttctttgtctgtaaaatgaggctaagacctgctttatacagtggtagtgacagtttgcccagcacctcctaggacctcaaaatgtgactttttttaaaagacagagccttactctgtcacccaggctgggctggagtacagtggcgcggtcatagctcactgcagcctygacctcctgggttcaagtgatccttccacctcagccccgcaagtgactaggaccacaggtgcatgccaccatgcctagctaattgtattattatttttttttttttgtagagacagggtctcactatgttgccaggttggtcttgaactcctggactcaagctatcctcctgcctcagcctcctgagtagctgggattacaggtatgagccaccgtgctcggccttcattattatttttaggacaaaagtgaaggtggaaagttcggaccagtgggctgtatgtttcagaactttacacataggaagaggaagtattgtgtatggaagaaagtgagtgttgcattattcagggttctcagagaagcagaaccatatggaagaggaggtctgttaggggaattggttcgtgagattatggaggtccagaagcctcatgatctgtctgcacactggagaactgggaagactggtggcatccttcagcccgagaaccaggagctctgatgtccgagtgcaggaagagacagatgttccagctccaacagagagagtgagtttgcccttcctccacctttttgccctctttgggtcctcagtggattgggtgatgccctctgcatgggtgaggcagatcatctttactcgttctactgatcgagctgttatctcttccaggaacaccctcatagacacacccacaaataatatcttaccggctgttggggcgttccttggcccagtgaaatgcccagtcaaactgacacgtaacattaaccataacaggtgtgggtagacagtcaggagagcaagactctagttggttctgtcacacagcagagctgcgtggcctgggtatactcctcccatctgcctgggctgctgtatcctgggctataaggtaggaggttcgatcagattaccctgagatgtgctgtgagaggtgagtgtggccccctcacagttgcagctcttcaaacgggagcctggagactccaggcctatgtcttgggaggtgcactgcacagggtgsctgctctgtaaaccttgactgaagtcgtggggaaaactgcagtgtgctccaagaacaaattgtgaatagagactagttaaaataaacatcacaatggcgatggaaaatgttatttcactttattaagttaaaaacaagttataaaatagtaggtcacatayaagctcagttttgtatttaaaaaccctcaaaactgtatatatgcccagaaaaaagacaggaaagaaagataccacagtatgaatggtggttcccaattagtaggagaactaggagccatcattgtctttgctttccagagaataatagcgtggtgtcctggagtcacatggctgctctggcttgccagtggagaacaggctgaggccggaggaggagggagcagccaggaagctggttacaacccaggcggagggctggcgtgggcctcaggggtcttcagcctcagcactattgacattttrtgccggataattatttgtcctgtgcatgtcaggatgttcaggagcatctctggcctctacctactagatgccagtarcatytcttccagttgcggtgaccaaaaatgtcttcaggcaatccagatcaaatgtccactggggggcagaatcacctgctgagacccactggttaaaatagtgtcagtaggggtggagagaaggggacaaaagagtcttagagccatttgagagggagcttctagaggacttgatggatggaatttggtcaaggcaggaatgagggtggatgtggggcatggggaattggacggatgatagtggcccacaggttgagagaggggatgggttcagctttggccatgctgttgtgagtctgtggttcccagggagcagctgagtaggctgttgggtgagtggttctcaagctcagagctgagctgggggcatccatttgaaggttatgggaagatggaaagcacgccctggaggtgggtgggtgagctcacccaggaccacggtgtggcctgagaagtcggcctgcgatagaacccggggaatcccagtgtttccagggtgggcagaggaagaggaggctgggaagggaatttgtttctctggccagagctgttgctcagcgactgttggctggtgaggatgaggctcatgaacagatgtggaaacatcgtgggatgatctcatggtgggtgggacttgtcgccgtcatgcactcagcactctctggcctttattggtcaagctgcctgctgtgtttctggtgcccaaatgttctgggcacactgttgtttggggaagaatcgcagggactctccttcactcttagatagtggcagcgcttgcctcgctgcatctcgtgttctcaaaatcagcacatgccatcccacattctagaccatccagttttgcttctcaggctctgaaaaacacttttaagagcaggttaaactgttctcggacttctttttggattatttgcaacgtcttgaggggtccacggattgatagagtcagcagggatggacagtttccccttcagcacctttatagttgtaatttgcccatgatggggttagagacccacagttgctcaaaagcagtttttgtttttcttgatagctggatttgggttatctctcaggaagcggttagcagtctttagggcaacctaattgcatttctttgtttacaagcacttaacttcatccctctcaggcgcacaccagcactgtctatcactaatactggcagttctagggtgaggtgkacagttgctcttagtcagaaactcamtttgctgttttccactagattcccagatagagaaggacagttgtttcaggcaagcttaagaccctgtaacatttcttgccctttttgatttgaactcccatctccctagctctggcttgttttaccctgcagttaaaagagaaaatgatctctactggctatatggcctcaggccaggagaaaaggtgctgttccttccagcagaaattcaagggtccagggaggctggcccaacccaggtcagaaggataatctcagaaaaagaaggaagcatgcattacccatctcagaacttaggaacaagaaaatcctaaaactccaaaggaccatttttccccactgacaggcccagcttaattagagaccagctaggagttgcatttcctggttgtttactgactgttctcttcggtaaacagcttcagcctgtaattaagctgtctaattggcaatgactgcaggaaaaaccatgaatggggctggcctccctctctagcccctgtgtctgctgtctgttacctaccaccatttttattcccctgtcttctattaaaaatgtcgtgggggcaaattctaaagaatagtctaggcaggcaaaccctttsaacttcactttgcaaacctgcctgagagwgagtctgagaggcaaattctttttctttccacttgaagaagtgtcagaaatttggtggattggaaaagatgggagagaaaagtccaggagtcctgactgctttcactcatttaggtgggctggcaagcagtgctggctgctccacctgttttcctgcctaataacagtgtcttttatagttgtctgataacaatgtcttttataatgtctcataactctgcctttttgtaatgaccggcctaatacctttgcctacaatagttcttttttcctctgggagtttaactcaggttgtgattagagagtatttcccataaatcacgcaaagcacatgtcctgcccaccagccaattacagaaatggagttggtcagacctacactttatctgaaacaatgcataatgggagttttgaactaaaaaaattaccctctaatgttacaaatatgattcaggcaaataaaactgcagatgtatgtgtaggtcctcagtactgcgattctttctttctctctctctttctctttctctctctttctcctccctccctccctctcttccttccttcctttttttttttttttaagtgtcctggttgtgttagggtaatttgtgatttaaaaagaaatgcctctcctctccccgacccgatttttttttttcttttttggtaggatgcctccctttgcattccaaggcagcacttcaagcagcactttggtaaatgtcaaaaagttggagaggctgagtgggttgcgtggcccgtctgtgcctgtgggctcctctcccgcccacgcggctgtgcctctyactcagaaccctgcctctcttgtgtttgtcccaaggctttactttcccccccacatacrttcagtggcattatttgttacatttttaaaaatacatattttatttatttcacaaacaatgttactggcataatgttaccacactataggatataatggttgaagaatgatttcccataatctaatttcaacacattacctgattcagtattctgtgtcctctccagccttgcttttctctgtgcacaggtatgacctgattccagtgctttttaagaattattagcattttctgcattgctccttggccttcacagttatcatttgaacagtggcacaagattctctgaaactgctcctctgtcttcattcccattttgtgagcatttaagccgtttactgttgattgtccatttcttcaggtatcttcttacatcatcttgcttctttactcagcataaagcctcrtagtagattctcaggtcccaggggtgcacatgcctgtgtttttaccttacttccccaggggccctccagagggtgcccatccacggagtgcggcgcctgctcgacttggccttctggcactggggattcctctcccaagtcttgctagctcgtggcatgtgcaatgggatctctttcctgagtgcgcatttctttcctcacatttgggggcattcagtgggggaggatttacaaagaaacttgaggtgaggggccctctgcactcaacctcctgggacctggggctgcacccactggcattgattagaagagagcttgtgactgaggaaaacctggcttagggatttatctgcagggactgtccccagtaggtctatgagagcccaccacagcagcagccctctggatggggatttgggtcttggttttgcyagcactcccagtggacagtcakgcctggacttgtcttctccaccttccacttgtcctaacagctgtcgggaccatcatccaccaggggccagctgtccagaggcagacccaccctggaaggcaggccagcctccgctctccacaccagcttggggatgaatcagcgggtgctctgaccactactttcccaaggctactttgcttcaggaagttacagcagccatagaggactctgcttatgtgagatgtgcagacataattcttgcttttagaaggaggggggaaaatagagaagtagttatctcattgtcttggaataaaattattttgctttgcaaagattaggcaaatcccaggttgctgagtcttggcagatttctcgtggcctagactgtggtgtttggggccgcctgtctgtaatgtgctgccatgacaaggcacggtggtggtggggacctggcaaggtaccgaacggtggaggtgactgtaggattagccccggctttgcagcaggttttcttgggaggagaaaatacacagttgggacagactccagggaccagctccttcccccttttttctattgcagagggggaaactgaggctcagagagggggactggctgtgcatacatggattctttgaaattttaaaggatggccaggtgcagtggctcgcacgtgtaataccagcactttgggaggccgaggcgggtggatcacgaggtcaggagttccagaccagcctggccaacatggtgaaactctgtctctactaaaaatacaaaaattagctgggtgtggtggcgggcacctgtagtcccagctcctcgggagactgaggcaggagaattgcttgaacctgggaggcggaggttgcagtgagccgagattgtgccattgcactccagcctgggcaacaagagagagactgggtctcaaaaaaaaaaaaaaaaaaaaaaaraaagaaagaaagtttaaaggatgttaaaaattttccacacattatcttttaatgtgttgtcaaggagcaatgatcatcataatggcactggggaaatggaaaaaactggaaaactctcttggtttgacagaaagggatagatctaactgtttagtgttgccaagtgagcccccaaacatctcccctggaaaagtcattaggaatttaccatctcyatctgcaggggccaagtgagataaccgtatctagtatatccatctgagcaaaaccctgtttctcttcccttgaataggaagccagaaactgctgcagcgcactgttgaaacatagcttagaaatagatactttgtggggggaaaacaacctacttatctttcccattatgctatctcttaatagggcccctggtatctgagccagcatacacatttggttcttcygtgtcctgtgatcttcctctgagtgaaaactgattatctactcaaaggaagcagatgacagagcccccgtgatgtgtgctgcctttgctctgtgcctctgtagtaagggaggcctggaatgagcagaaagatggctcccctggccacaaaggggggtcagtctattgcaaagcagccttcacgttctggaagcagggagcagtgggagcccgggaaggtcagccttgcagacttgtasatgtcataggattatttgagctgcttccgctgcaggtggttgggaagtactggatggaatccttggaggcgagatgagaggatgggagaagaaagtctggaagaacagttagatttcttcctgattagataatactgagtgagagtgggaagaacggagcagagcctgttgccagcgcgatctctgtcccgttcactgtcatgtggcctcttcacggatgtgtgtgtgtctgcagggactcctgagagctcttgttgatgtttagcccttggacctgctggtgcttacacatacgtttccatggagtctgtaccaaaaccacagaggatcgcccccgtttatctgagagtagctcatcatcattctctgcttgggtgtaaatagctcactgaagaatcttaatccccagaactggagaccaaccattttctctgcacttggagggaaccattcaaacatccctgttgggctagcatgaggaaaagccaagtcaggcgcttggccaccaggggatcttggcaagagaggccgtgggatttgagagttagaactgatatgcagcacagtgcaccttggtgccagagttctgaccagtagtgttgcgtccattggtccactatgatccatggattgggaacccctgttactgatgtgttgacgctatagcaatattatggtgtgtcagcttcgctgtctttcaaggatgacttgcgtagattgcatttaagtatagtggagcaacagcaatcaaggtgtaagacttttttttttttttggagacaagagttttactcttgtcacccagactggagtgcaatggcgcgatctgggctcactgcaacctccgcctcccaggttcaagggattctcctgcctcagcctgctgagtagctgggattacaggtgcctgccaccatgcccggctaatttttgtatttttagtagagacagggttttaccatgttggccaggctggtctagaattcctgacctcaggtgatctgcccacctcagcctcccaaagtgctgggattataggcgtgagccactgcacccggccaaggtgtaagagttctaatcttaggccttcattctgccatatgacaaacaaagtagaattacagttgaaaactaattaactctacataaaacaaaaatgaagaggtgggctcacatacctatctcaaagttgctctggaagatggatttagcccatttaaaggaagctaagggatagaattcatgagaagtgaggtctccggctttgtatttattagggcactattattagatggcaacagatagatcccaaattctcaatgactaaccaaagggatgtttattgccctttcacattaggttggaaagagatgcttctgcttagtaacgctcctttagtgactgggctcagccatccagggccaccgtgaaagaagaagagttcagagaatgggtcattgcaggggtttacgccccaggcctggcaggggcacacagcattgcacatcccccttccatgggtcagcacgcagtcagatgaccaccccttcctgcagagggaggtggggagacaaggtcggcctgagtgtccaggggaaggagaaaaccggcacagaaacaactagccagtctctgctacctgtttcttgtgttaaatcagaatttataggaaggtgattttttaaacagtttagagagcttttctaatttttgagcgagggtcttgtctgagaattatagcttgagataaggacttcagaatctaacaattctttgctccattgctacaatttccccaacccagaagtggtgaaaccaagtctatcaagcttcttggttgacatcaagaaggttgttctgggcgggcgcagtggttcacacttgtaatcccagcactttaggagtcccagatgggcagatcatgaggtcagaagttcgagaccagcctggccaacacagtgaaatctagtctgtactgaaaatacaaaaattagctgggcgtggtggtgggtgcctgtaatctgagctcctcgggaagctgaggcaggagaatcgcttgaacctgggaggcggaggttgcagtgagattgcgccattgcactccagcctgggyaacagatctagactctgtctccaaaaaaaaaaaaaaaaaaggttgttttgtttggtaaacagaaaaggagccatcttaagataatgcatctttatttaacagttatgaatagaatctctcaaggtccaaaatgaatcttttgaaagaactagaaattcttgcctgtaccaaccatattagcaagacttgaaatgcaacattctaagatgtgcctcaggaataattttattgaccaaaaccagacgtcagcttgcagccttgtgaagcctcctctccatgtaggaacggggggcattttggttagctgggttaggcttgctgaattttaacatgacatgcttgcttttcctgtgttsgtgtgtcgcttctctcccttgggcccccgcccctaacttttccacctgatctctgacttctccatctttctaacccctgaacaacaactagagataagttcaaggtcactgctggaactgacctttgggtgcttgggccacccttaggccttgagaggcacaggctgaggccttctgtacaacctcctggccagtgtggaggggcygggctccaagcaagcttgtccatatcacagaaagtcaagagtcttgccgygtgcggtggctcacgcctgtaatctcagtactttgagaggccgaggcgggtggatcacgaggtcaggagatggagaccatcctggctaacatggtgaaaccccgtctccactaaaaaatacaaaaaattagctgggcgtggtggcaggcgcctgtagtcccagctactcgggaggctgaggcaggagaatggcgtgaacctgggaggtggagcttgcagtgaaccragatygygccactgcaccamccgagactccgtctcaaaaaaaaaaaaaaaaagaaaagtcaagagtcttcacaatgaatgttgacagtaatacaaggtcagctttttgtttgctttttaaaggttccagtctggtcacaactgcatgcaactgagttttgtaattatcatcttaacaatgtgatcacagtctgccctgccattaaagtatttacttgagggtacccatgtagcatgactgtctcagatcagattgaagccttcgaacttgctttatagaggtttttagagttgagcaatcacatttcttttttcttttctgagacaatgtcttgctctgtcacccgggccggagtgcagtggtgcagtcatagctcactgcagcctcagactcccaggctcaagcgatcctctcacctcagcctcccgagtagctgggactacaggcgcacaccaccacagccagctaatttttatactttttgtagagatggactcttgcagtgttgcctgggttggtcttgaactcctgaactcaaatgatcctcctcccttgccctcccaaaatgctgagattatgggcatgagccaccatgcctggctgaggaatcacattttaatagcctcacaaagaaatcctagtgttgacaatataggtttttaggtctggaatgaacttccattctagtctaatttcatcctgattttactgtccaggctcttggctgaccagtgtgtggagaccctggtggcagcctagggatcccctccaggtctcttccttgtccttactgtagaccatcacaccrccactaatttcccccctctggccaggtgagagcagattgtcaccatttcagagaaatttgaaccaatcagaaagagagctcaggagtactggggtgactgagatgagcacatgtggcttcttgargaccttccaacccccaagttattcttagaaagctgcacacaagccaggcagctgtaggctggcgttgaaaagtttttagctttagctaattacattgtgggagagactgactggggggtgtccatcccgtgtgtgccatgctgcctccatctctttctccctctcttctgagaccttctggttatccccagctacctgcccctccacctcctgtgccctcagggtgggcagtttgggtttctttcctttttcttttgtctgctgttgtttaggattgtgaaagtgcagcagtgcactctgtccctgcaacaggctctgcggtgggctagctccagtgttgcattctcccttcatcagtggagaaatgcactcttggaaccatgaagagtctgcasatgacagctctgcactcactaacattcaagcaccttgattcagagtttcacgagactaaggtgaggttacctttccctctctgttgttcttcccgtggaaagagggttttctattcacactgtacattcagccacagctggaaacctcatcttcctcttccagttaagacagtcatgtggccgggcgcggtggctcatgcctgtcatcccagcactttgggaagccgaggcaggcagatcactaggtcaggagattgagaccatcctggctaacatggtgaaaccccatctctacaaaaaaaaaaaamaaaaaaaaaaaaacattagctgggcatggtggcatgcgcctgtagccccagctactcgggaggctgaggcagtagaatcacttgaacctgggaggcggaggttgcagtgcgccgagatcgcaccactgcactccagtctaagtgacaaagcgagactgtctcaaaaaaaaaaaaaagtcatgtaattgtgacctcagttcgcaggacttcggaagcagggacccctcccctgtacccccgccaaagccaccatggtagctcctcctaattggatcttgggggactcggaacagggtttagcctgagaatgtgacttgtgagaaccccagatgagagtagttasacttttctggaaggcttatttaaaaccccagaacattcttgcattggaattgagttgcattgctctctgggatgggcagtgggctcttggaagaggtaagtgaagtcactgagtgggacgctcctcgggggaggattttgtggggcagtgggaacatcagtctttcctaggctcaggagtgagtctagaggccatgtttatgcacaggaagcatctggaagcttattaacacagattcctgggccctgcccaagagatttcaattccgtggggccaagcaggccttgagactatgcagttttaatttattgttttacttttatttaaagacagattctcactctactgctcaggctggggtgtagtggtatgactgtagctcactgcaacctcaaccccctgggcataagcgatcctcccaccccagccttccgaataactgagactacaggtgcgcatctctacactcagcacattttcttattttgtagagatggggtcttgctatgttgcccaggctggcctcagactcgtggactcaagcaaccttcctgcctcagcctcccagagtgctaggaatacagatgtgagccacagtggctggccgagattstgcttttctagcrcctcccaggtggctgtgctgatgctgcttgtctggraccttgccctgaggagcactacgctgtaggttctatcacggtaacgatactgtaatgtacagtgcatcagatgtcactaatttaaagatctaggctgatgaaaatgaaaccaattgaagtacttcagctcctccatgcaagcatgggctggcttcccttattttactgtggagtgccttttataccagagtagtggctttctaatgtctgactcaggttaattgatgagattccaaggcaacacaattcagtaaatcaaactggatgaacatcctctgccatcagaaaaatatctttatgattagatggtgatctttggatggaaaatattaaaataagaattgattaaaccagctagggatggtggctcacgcctgaaatcccagcagtttrggaggccaaggtgggtggatcaccggaggtcaggagttcgagaccagcctgcccaacatgaagaaccccgtctctactaaaaatacaaaaattagctgggcatggtggtgcacgcttgtaatcccagctactccagaggctgagacaggaaaaatcacttgaactcgggaggtggaggttgcaatgagccgagattgtgccactgcactccagcctgggtcacagagtgagttctgggagttgggtttgttcattcatttgtttattcatctatccatctgtccttacgtccttccatccttccacccacctagacatccatgtcttcctcctcttctccctctgcccactcacccatccatccattatatgttagttgagcatgctctgtttcagttctgggcactggggatatggcaaagaagtaaacatagaaaacataaaactctgcagtctcatgctgtggcaagtggtgccttctgaggtcctgagtgttcctggaaattagcttgctctttaccctgctctgctgaagaaaaccttggcaaatagggcacagaaaactcaatgtcaaaaacgtaccaattttcagagtaggaaaaagtgtgttttttgcagattgcaaatctgtgagcttagcttcaagtaaaactctagaaagacttattaaagaaatgtcctataaaaagagctagtatgtgctctgaagacctgggtctggcagagcagcctctgacatgtgtggcaccattaggagacagccaagatagagaccctggccaggcgtggtggctcacgcctataatcccagcactttgggaagctgaggcagacagatcacttgaggtcaggagttcaagactagcctggacaacatggtgaaacccggtctctcttaaaaatataaaaaattagccaggcatggtggcatgctcctgtagtcccagctactcaggaggctgaggtgggacaatcagttgaacccgagaggcagaggttgcagtgagtcaagatcgtgccagccagtgcgctccagccagagtgacagagtgaaactccatctcaaaaaaaaaaaaaaaaaaaaaaaaaaaaaaaaagagacacccttgcaggcagtggtcacaggccgaggaacctggtggacaagktggggaacgactcaatggatgatgataaacaggaagttctmgtaccactgagaaaacgatctgccagatatctccatcagcaatgttcttaacatgttttgtttttgacatactccagtcctcattttgacaagcttaagggaaacatatttgcagtgaatgttgcagacaaatggttattcctgatgtttaaacagcccatacaaatagattggaaaaacatgaagattcccataggcaaatagacaaaaaccaattaatctgaaacgctcttattgaacaaatcagcaaagactaaaaacagtgatgtcgacgacatagacagattcagccctctagtcatgttgtggctgttggcagattaagcctgtgtgctggtgggtgggctgggagtgagcaacgttgagccccccgaaataatgatggtgggaagggaaacctttttataaacttgtttggaaatgtgaatgtatgaaatgctggcttcctttgactcaggaattgtgcttctaggaatctaagctaaagagattttcatagtaattgacaggttgatttatatttatactcgtatcttgttccagaaaggataaagcggtccacggggagggacaggcatataaaggcagcagggcacccagaagacagcttgtcttgatgagaaggagaaggagccctgttttacagcaagtgtcttttggtatgaaattcttagggtttggggcaccccttttgttttttgaacgctcgacttttttgatggttataattgagaaatacaggatattgcaaaccctagaccatatcgaagggggcaaacttaatttcatttgaaagacacctggagtgggcaggagacatgctgatcagctttccaggtggcagaggcagcttttatagtgacttccctgactggtcaactggaagcttgattgaatgtcctgtgtccctctgggagcagcccacctgtcactctgtggccctgcaacagggccctgcttgtcaggagatggccatcttagttatctgaccactttccagccttcagccacgcagccctcagaccccccctaccccccaggccactgtgtccctggagacccctgtccyctgcatgcttcctactccttagaggcccatcagcctccaagagccaccctaagcaagtcacctgtctgtgggtgacagcattgagtccatgttaagagagcagcctctatctgtctgggggtggagagcccatgtgattcaggagacaccacatcatcatttcagagccatcactgaacatcagggaagagaactcaagggtagagttgaacagaaacataagtgatcctaggccgggtgcggtggctcacacccgtaatcccagaactttgggaggcccaggcgggtggatcacgtgaggtcgggagttcaagaccagcccagccaacatggtgaaaccccatctcccttaaaaacacaaaaattagccagttgtggtggcgggtgcctgtaatcccagctactcaggaggctgaggcaggagaatcgtttgatcaggggcagggagcagggtrggcagaggttgcaatgagtcagctactcaggaggctgaggcaggagaatcacttgaatggggcagggtgtagaggttgcagtgagccaagtttgtgccactgcacactctagcctgggggacagagccagactctgtctcgaaaaacaagaacgataccagtaggtgttctttgacccatcaacaggtgtggggaggcagcactgcaccgggaaggataagagggtaggctttgctgtctggccttgggcaagacacttgacctctcaaagcccatttgctgcattgtaaagaggaaatcataccctacagcagctaaccctcttaccttgctacttaagggcacattccggccgggcgcagtggctcatgcctgtaatcccagcactttgggaggccaaggcgggcggatcacgaggtcaggagatcgagaccatcctggctawcacggtgaaacmccgtctctmctaaaaataaaaaaattagccgggtgtggtggcgggcacctgtggtcccagctactcgggaggctgaggcaggagaatggcrtgaaaccgggaggcagagcttgcagtgagccgagatagcgccactgcattccagcctgggcgaaagagcgaagcctccatctcaaaaataaataaaataaaataaaataaaatawaatataacataacataacataacataaaataaaataataaataaaaaagtgcagactccctggccatcagcctcatctcttctacctgagtggattaagtagtaaagggggagctatccaagacagattttaaaatggtcagtttgagtaaaccaagagataggtttaaaaaacaatgtatgtttcactcagagcataaacaaaattgttgaagagccagcctacatgcaagtttaaaaattaaaaatggccttaygtattaaaaacaatccaggctgggcacagtggctcacgcctataatcacaacactttggatggccgaggcaggcggattatttgaggtcgggagttcaagaccatcctggccaacatggtgaaaccccgtctctactaaaaatacaaaattagccgggagtggtggcaggcgcctgtaatcccagctacttgggaggctgaggcaggagaatcacttaaacccgggaggcggagattgcagtgagctgagattgcaccactgtgctccagcctgggtgacagagtgagagtccgtctcaacaaaacaaaaacaatccatgttaattttagaaagtacaaatacagaagcagaagaagaatctgacagttatctagaggagattttaatcagtgtcctttaggttcattcgttgcttatttcaatctggattgggacaggatgacaaaggcccatgaagggattttatatataactgtgtgcttagtgtagcgtgggtgtytgtgttttatcgcctggcctctttgtggcatgtgacatctttgacaggaacaccaattgattcctctgtgctcaataatgtcttcactgccatggtatttcctgcacagctggggatgcttaactgtgtaactacaatagcaagataagggaaacagattttccaattggatattttaataaatgatggcttcagaaggggcacaatattctacgccactgattgaatgatgacaagaaatattttaatrggtgcattgctgtcgcagtgtagtaaaaagtaaagaatggttcaccaagtcagaggtcatcctcagatgtccctatgtgtctgttagtggagataaagtgatctcaagacggtgacacatttaaagtgaygtgaactagtttattagtagtcagtggtccccccggccacttctaaagatgacatgcttctaatcatacccacaggatttctaagatcctttttttttctcttatcaaatgacagtgcttgatgataatttcatcagaaaggtctccatcactagtctctgctttattttcacgtaggcaagtggtctcaagaaaattggaataaaaatattcaaaataatttctcccagctatatctggagcaagattaaacaattataaggagtaggcagtatgttttcaatccctgtgttgtctttgtcaccatgatttgcattcatatcagaaggccagcaaactcggaaagaaaatgactttctgattgaatcatatcattttaaacaaagctctttcatgaataaagaatattaattactatatccagaatgatcctcttttttttttttttgagttgtgtgttaacagaaacctttgtgcatttgacacaaggtcagcatagatttaacaggagacataagctttgaaaatttattcatgctggaattgaacatggaattaattaaatgtacagaagctggaaggtagacaggtcgttgtctccatttttgttctttaaagcactttattccattgggatatcacaatttcgtagcctggtatatgcattccttgtggtgtgtattaataaattgagtaggtgaaaaagacaatagatggaaagctggaaagtgatgtggcctgaattcctttctaggtaatttcaatgttggtcatgcccagggatctccttaagtgttgcagaatcacacctggacaacccaggtgcccagtccttcattgcctcatgggctctctagtcttacttttgatcccttttcctgtatttcaccagtataatactccccactcctagttgggaatatctaacctgtgttgagtacctgtatctgatgagttagtagctgtgaaaacgtttctctagcaaggctgcctgtgagtgggatcccaggccaagcagttaactgcgttccagcgaagcaggtgccccgtgtgttgctctgcaagtccacatggagcaggattccttattttgtgaagaaaggatctttagtgccacgtgtgtatttttaacacatttccaaaagcatgatttattcaggattaagtttattcagtagaaatttccaaggtatttttttaagtgaggcaccatcctggatgctggggaagaatctttgttggaatatgaccctgggttttgtatggaaaagggaggggscagtgcaggatgtggcaaggcagttgttggagctccgatacttccaataagtaactagcagggctgtacacactctaccaggaaagacaaagaaatgcagagtccagggaagcagtccatcgcacgtttcttccttccctgcaagggcactggagttctccttcaccaggaagactgcagcccccattctgattggcctcagggggccgctcctgctgatgatggctaatgaggacaagcagtagagaatattgctttcatttatcttggtgctttgtaccttgatggagacagatattcgggtttcaagaagacaactttttttgcagggcaggcattgtttgcttgttttaaggctacgttcagaagcacgagaacaaacaacagtttcaagcctaacacttgggtttacatgaagctaattgttagatatgagttctaaatttcttttcaaagaatcagtatgtcagtatgttcagttctttgccttctacttctaaacttaactttctcataaagcaacatttttcgattacctgctccaccctgactcatttcaatcacctgctccaccctgactcattccgattacctgctacctgctctgccctgactcattctccaccctgcataaccatttttcccrccgaaccactcaccgggtcactctctttaaattagccaatyggaattagtttagcctgtgcggtctaaccctagccaacaggggaacgacacagcagcaggggccacgtgagtcagggataagaaccccttccctcccttgtccaagtgtgcgctcaccattgctccatctgtaagggcgcacccttctrtagaagtaacttgccttgctgagaattaaaaagaaaattttatatttgagtgctatttcttttgtggcactgaaactttatatataacataatgttgcagtcctttaacataacagaaaggaaaaggagaggcatcctattcggttttgcactaggggtccccactgaaattgctgaccacaatcacatggattatgatttaatatttcagcaagacatgcatgattttaaatgaatccaattaatattccattgaaaagtggaaaccagagtctagataagctgacccagctctcatgcatgtgctgttaactttcctactttccccaggagtatcacagtgaaattgagccatgagggactctctgcttcttacagttggaagcctctggacttcctcctcagagacgggagatcttgtctctctcaatcctgagttagtctccactttatagctgttacttcagttgtagggcactgrgtagccctggagttgagttgttcaatgcatgaccttgtttatgtcgctatttgagtttttactgagaaaaaggccttctgtgaatccaaatgtgactattacacactgaatcttcccattactttaagaataagtgatgttgttgttgttgttattattatttgaggtggagtttccctgttgtctcctggctggagtgtaatggcgccacctcggctcactgcaacctctgcctctcgggttcaggcaattcttctgcctcagcctctggggtagctgggattacaggcgcccgccaccacatccagctaattttttatattttttagtagagatgggggtttcaccatgttggccaggctggtctcgaactcctgacctcaggtgatccatccgcctcggcctcccaaagtgctgggattacaggcgtgagccaccgcgcccagcccagtggtgtgattattccatraccatggtggtgattcctgtgggctaaactgtgcctcccagaatgtgtgtgttttaagtcctaacccccagtgcctcataatgcgattctatttggagacaggttctttaaagaggtgattgagtcaaaatgaggtcagtagagtgggccctaatccagtaagactgtgtccttataagaagaggagattaagacgcagacacacagaggaaagaccatgtgaggacamagggggaagacggcatgtccaagccgagagacctcaaaagagaccagccctgtccacactgtgctgatctcggccttctaggctccagaactaggataactaggtgtctgttgtttaaaccacacagcccgtggtactttgttaggtcaaggctggtaaactcgtacagtgatggcttcaaatgttatgaacattaaaatctttctattgctagggaaggtcattaaaaccttggtggccaattaaatatttatggattttttttcctttacacttttgcaaagcgttttttctagtttgtgcataccttcttctattagcaaaatgtcttctattaccagctttagaaataacggtgctgctattttccttggaggggtctgggttgacagacctgcgaaaggtctggatgtgttcagagaaataagcgatttttccaaggcccaggcctttgtactgctctaattctatccagaatgcttcggacgggaagaatttatggctttataagtgagtatttccgtattagcaaagagacatctacacttgaaagactttcctgcagcctcccgggggtcgaggtcargagtctgggaggaggtgtggagcagagtgtccgggtgagagggtgctgggggcacgtgcccagcaggggtggaggggtggacaggctcaaaagagagacctgggcagtggacagggctgggcttccctggagctgttggcggggcagagccagctcaaggaacagctacccagcctttccaggaactctggaaggaaacggggacttccctggtgagggtgggatttgggagataatcctaatcactgggctgttctttgtcctttgacattcaaatgaaatgggagcctgttttaccccaatcagccttgagttttcagcaccctccccctcggaatacccgtgagggaccttctgtttttgttgttggtgttttactaccatttctgagtactttctccgaaagctcttttagcacgttgcttttctctctgccctccctcctcctctttcctcccttctgctctcactctgaagcagcccagcagcatgtacagcacttgctttcctttgagaggccctccattgttcccgccctgccaacttccacgccagcctccttttgcaartccacctgccgttctgggcttgccctggggaaggccctggagctggattcccacaccctgccgagtttgtgcgtttctgtgaatctgatgagtgggttgtggacttcaatccagccccaccctttacagtgagatccagggacctttttaacctgtgactgactttttatgtctttctatgtctgtaaaatcgggataataatagtacctacctctctgtggcactttgggggtagaatggatgaactgaattaacgtctgaagtgccacagtgttgtatctgagtgagtagygtcctccttaagcattggctttggtgcactgggaaggggcgtcagctgggcaggctgagcctgtcacctttttcaaaatttccaacaactgtggcttcttgggaaatcctttggcagtcagggtgctatatgaacacatgttttgtgggtcacttgccaggcgtcagtgccctgctcggggtccctttgcagctcccctgaacgtgccatttgaagcatagcaaccattactttgagaacctgtgcaggtccakgtgccgagggctgtcagatccctgcatcaactctggggatgggttcaattattatcctctctgtaaacagttctcagttattccaagtattctatttcttaatggatcttctaagccctggatcaatagtgtatatttctttgtctctcagttggggccctggcctctgcagataagccctcggatgcgaaatctggggaaccagccagccacctctggtcctgggagggtcagggactcgtgaatcaacatctggctctttgtgcacaatgggcctggcatgggcccaggctggtggggtgggcagggaaggaacaggcccataggcacccctccatgggcccctcaaggctgtagacccctctgtctgaccagcatcccattccctgaagtgaagcagctsscaccaggctggcttttcccaggcagtcacactctgggatgcccccacccctcagcacacacagtgactgtgttttcatgttttccaccaagggagggagggacaggctttctcaggggggcggccacccaagatcagctgcggctgaggatttttgtggctaggggaagaagtgaatcaccctcttctctgtgtctttccctaaccactggagacttcatagataaacttgcggggtcacggtgagggaggcactgtgtggaagggtaaatgggcttcctgggggtttagtacaagttgaccaaccttcttgttggtaacatgactgaggcattacctgcactgattaagtcaaccatcaagcagcatttattaagtagaacattgataagggcttgagggtgagagaagttgtccttaactgaaggagggggttctataaatggaagtgtcagagcagggtgacagatgccaaggaagagtgcccaggtgtgcacaggtgtgcccaggtatgaggggagaagaaggggtcagggccagcagggaaagagcttggggactcctgagtccagctcccagtgatgtgtagagttgagctccatcctgctgatcccagcaggagatagtggcgagactgggtatggtgtggttgggaactagaaaggacactggtgtgtttagatggggaatcttgggatgcaatagaaacaacctctgttggttttcagcattggagcagatgctccccatacatcatcacatcttattgtcgcagctaccgtattgttcttgtcccgtttttgcagaaatgaaaacctgatgcagagcctcaaggtcactttcccaaggtcacatgtggtttgcatcattctggccttggagcccagcctcttagccactcagtgcaactgtggagactggagggtgtcggggcgttgaatactggttaaggaaacggacgctttattctgcaggtgacagggactcactgagggctccgaacagaattgtaccctcagactctgattgcaggagtaaggatggtttactgagagtaggctacgtctgggggtgggtcagcaaggacgtgtgtgctgtgggaatcctgagacagatgaagaggctgtgaacagtagagggagagtggactcttcgggtagttcagacagatacgcaggtggggagagattggcaggcggaggagaggcttttgttgagggctggagggagggaggagaggcaggctgtttctgttttctgttaagtgggacgtaatcgagtgttttcctctgccgcctgaaggaaaggcggtgattgtgattgagggtacagggtccatttgccaactctgagcgggagagttgggtgtgggcgggaggcaggacattgagggagctctgaagtcatggctggaggccatcctactgaggggatggggcagtgatagtttcaaggaatcctaggaatgggaaagggggctggccagggctgtgggggtgggggggctgtaggatgctggaagcagccccagcacatgtgcatctgcagcgggacttggtgatgtggacttggggcttccgatgctcgtgctagcctgaatctccgggagacrtggagcatctcagggtggggtcaggttcccaggtgaagcccctgctgctgatctgtagaccgtgcttggagaacactggtccagtgcactggagttcgtacagatccgcctttggggcatgcccaggggggtcttacaggagccagggacaggtggggccatgtctggagtagacagtgatacagtgatgtcccttggcctctgctggacagagaaggaggcgccaggaggcagctctgagttgggatggaaaggatgcatgacagtcagcttccctacagctggaggggaagttccagaaagaaaggatggccaacctgggacttgtgggcagggaaagggcttttggaggccaagattgtagggcagtgttatcctgggtgagttggggtatggccataggagggggctccaggaattcagggaaggaaaagaccatggcgctgaggaggcggcamsgsctggccctccacctccaagctgaccaccctactcagctcctttagggtggagtggctgtaaggccgtgaccaggaaaaaagggacccagggtggtggcacatgaatcccagctttgtgtatccactcagttgcatgccaggtagtcacatcttaacttgtggcgcggctttagagagtgtctgtgcaggctgcctctgatccctcagtcagtgtgcagagctgagctgatgaggaaagtcttggtatgtaaccaaccaggtctcaccttcagccacactcctagggacagagtgcgtccatggaggggaggactcacagcagttttgaagtaatgtagattgtgtggccatcccaatttagtttatcattcccctacttggtctgtctgccttcatggaagttggtgattttttttttttttttttggctctgttgcccaggctggattgcagtggtggcatctcagctcactgcaacctctgcctcctgggttcaagcgatttttctgcctcagcctcccaagtagctgggattacaggtgtgtgccaccacacctggccgaagttggtgattttgaacagaggaaagatagcacagtgtcataactcagcaaaggtgctcagcagctgcaggagttggggttttctgggctcacacccagcctgtgtccctcatccccttgctccgctgcaagaacccctcaccctgctcagtgctcctggccactgctgactggtgcatggcgagcagaggttttattccatcttactgtgtcagatgtgattccggggacgcagttctttcttaagagctctgatgcatgttctaactaggagggcaggtrgctgccgctcccagcagcccctgatgtgttttccttcaagcctggggaacaccgagctagggacacgctggctaatagaggaaggagagctgggtatggtggctcacacctgtaatcccagcactttgggaggccraggcgggtggatcatctgaggtcagcctgaccaacaaggtgaaaccctgtctctactaaaaataaaaattagctgggcatggtggtgggcgcctgtgatcccatctacttgggaggctgaggcaggagaattgcttgaacctgggagacagaggttgcagtgagccaagattgcaccattgcactccagcctgggcaacaagaaggaaactctgtctcaaaaaaaaagaaggggagcgatcacgtgcatccctctgctgagatgggagcagcagcgtggggttgggctttgaactggcatcgtaggcattttgttttctacatttagaggaaaaatatacatcaaatattcaagtcccctgggcacagataaaagagttttcagatatctctgcagccaaatcccaaatgggatgcagaagggagaactgtgtaaaatcacgctcttccagaagctgggctttgtaatggggctggcaaaaattcccagggcatcgtttgtggcctcaatgtgattttcatgtaagtcatggattttctaaatctttgaggttagtggatctaaagaaaagcttggtaaacatccagatgttgtcaaacatatttaggtcattgttctctgacagttcgtgatattcgttcctactccaggaagctcttaggagaatccaaatccgacttccctgtgctttgagaaggaatgtctgcatgaagaccatcgtacagatggcgatattagaagagttccctcccgtgaatcctgtagaggaaaatgttaccaaataggcctgttcccctgtgcacccaatactaggaagattagataatgtgtagggatttcttggtttttctgcacaaaagctccagggctgctttgaggctgtctgatagacagctgcagtgttgtgtgttacccttgaccgcatccctcctgtccctgagctcgaaggctgaatggtcgatgggagctcctttggtgactccgtagctgtggccagtgcctggcagctagcgagtggccagaactgggagctgctgtgtgtgacgtggctgttcagtgttgtttgtgttggctctgtaaaacgatgcttaatagattggattttaatatatagtttgtttttttgttttttttttcgagacggagtttcactattgttgcccaggctagagtgcagtggcatgatctcagctccctgcaacctctgcctcctgggttcaagcgatttccctacctcagccccccaggtagctgggattacaggtgcacaccaccacgcccagctaattttttttgtatttttataaatataaaaaagatttcaccatgttggccaggctggtctcaaactcctgatctcaggtgatccacctgccttggcctcccaaagtgctgggattacaagcatgagccaccacacttggcctgatttaatatcttaagtcacctttgcctgacacttagcaagaaaaactaccaagaaatatctaatattttccttttgtttgggaataagaatctactcacaatggacacttgctggcttgttttaaaaccaagcttgcttctcactggcctgtttaagtggaaatgaagtctcagtgtggggtccgatgcttcctatggctgcatggaggaaaggagtctgggcctgaatctcccgtgttcctcatgcatgggtagaactaaagcctcttcttctgtaatgtggcagttcccattctcagaggataaagtacgtgtgagtgatgccacctcaacccttagccaggtgcaggcgtaacaagggagacccacctgtgcaatatagtgagacccccatctttaccataaatgaaaaaaacrttagccaagcatggtggctcacgcctgtaatcccagcactttaggaggccaagatgggagaatcatctgaggtgaggcgttcgagaccagcctgggcaacatggcaagaccctcctctctacaaaaaaatttaaaaattagccaggggtggtgacatgtgcctgtggtcccagctattcaggaggcaggaggatcacttgagcccaggagttcaaggctgtagtgagctatgatcttgccactgcactctagcctgtctgtgtggtggtgtgttcatacacaatagacatcgccagtgttctgttggcaggaattgctatcgttggtccttaaggaaaaacacaggaaggatgcaggtgctcagaggaccttctggggtcttttttcctgccagatcaatgttcctgccctacagacagaccatacttgtccttcctccactagcagataagggtcaagtcctcatctcttttacagttccacgtttaaccttcagcttttaaaacgagagaaatagggtccccagtgagttcagctggagtgtcccaggcaaagggatgcgtgcagaattttcagttcctagaagctgagcatcatggcaaatcttagcttagaaaccattctaccatgacattctcagatgagaatttgagtcttatgctaaaaatataaaagtattaataagacgttactgtcttggtaattgcttcttcttacatgtatctgtcagtcaactggctaccagaaaatagcctttgatgtacccacggaggggctcttggtgggctcccggggtgggcatgctcaggcctgggcagtaccagtggttggccagtttctaccatcagcagacgcggttctgctaagatactgcaaacgtgattactggctgtcaggttctgttatttggaaagccagcctgtgtagcagatggctctgctgactggctaccagaagtttcctttaaataaggcttatcagctctagcaacacttggaaatactattctccaggagaatgtttgatttataggtagctagaaatgacccgggacagaggagtcgtgagacggtggccaaagcatctcataaacttggaactaagggagcgaagccagctgctgagggtgatgaatgggggttagctagggctggcacctttcctgaactctcctctgcagtcttcctctctcgcgcagcattagtccctgcagcacggaggcattacccggctgctgtttggttttgaggtagcagtgaaatcaactacatgctttaaaaaaaaaaaaatggtgatatgctccatggcatgaaaaaattcaagaaatggcagtctagtgtttaaaaagccacaggaaaataaagcataatgccacctgaacatatatagtattgtgatttttttttcctcttcaaaaaaggctggtctggctttgtagaaggggatttagattttggagtgacatgtcgggagcatgtgtcttctttgcatcgggagagcccatctctctaaggcagtggggaaaggcaattctctgtgaccaggtttttcagcacccacagttgcacttgacatggcatcattatgactggtgtggaaaataagtgcttccttctgaggtggaaatgctgaaagatcacaaacacactggctatggctggaagaggttccctggaagagtcagtgtcatctaaggtggatggaatggattcttctactccgcagcccgcatctcrtatggcaaagtgcaaaacctgggatggattctcracaaaggtacagtaattgggagacacaaacagtccagtgttttagccctgaaggaatactaccttattttttactttgggctctatgaatgcttcagataacaagccagatagatttacataccttaattatggacaagctactttcatattaaagttcatctcagtatgtgaacattgccctggtctcaaacagtgagaattgacctccccctcccacacctggctaagttaggagcccagggttctggtcccacccttgacagtagcagagatctctatctttccacgttgctgtttgtttctcagcttacagacctgggtgacctttaagtctgtacagctgcagtgataaaattttagacttttgccatattttagtggtgttcatcattaaagaggcgggatggccctgtagctgtctctgggattatcgcgaagcttttctctccctcgctgtctttctgtggtaaaatcacgtagccttagcatttttcgggagttgggtcaattctttgaggacagaacccctgcgttgtcactgtgtagcattgcagtaggtactcaatatatattcgatgaataaatgaaccaatagaaaaccgagtaagtctgtgaaagtttgctaaaaatgctacctggaaatgtcaaggtaacatttacatttgatttgtgtggagttcagtaatattcacatgtttactttggtctttgttatcaacaaagcagaatgctgatgcttactaagacaaaaaaaaaatgagcacaggcagtgtgacccccaaaccccagatttcacccttactgaggagctgtgtagccctggggaggtgccctctgtctccgagcctctgcatctccctaaccagatgggcgctaggctgtcattctgaaccattctgacagatgaatcccgcctggctgctactctagaagttgggggttcttggttcttatcaaagagggcttctttagcctggcgtggtggctcacgcctgtaatcccagcactctgggaggctgaggtgggcagatcatgaggtcaggagttcgagaccagcatgaccaacatggtgaaaccccatctctactaaaaatacaaaaattagccgggactggtggcgcgcacctgtaatcccagctactcaggaggctgagacaggagaatcacttgaacccaggaggtggaggttgcaggagccgagatcgtgccattgagctccygactgggcaagagcgagtgagcctctgtctcaaaaaaaaaaaaaaaaaaaaaaarwsttctttattgaaactcaaaaggtaaaatgattctgtcttggagacccctccttacaatgaggatgtaatcagaggtaccacatccagagcccttaragtttgagtagcaggtaggctgaggtatgaccctgtgatggtgaaaatcatgttaaggtcgaggccacagagggtgctcaggtgtattttaaagtatcctttcaagataaataaagtgaatcacctagcagtcactctgacttatttcattaaatctgaatattaaatttaatgctgtcataaaatctagatttcctaggctataacttctataacttccttcaaaagagagcttgcccaattcagttttatgccacttccagtgtcgtgaacacaataggtacccccacaataagattaaagtagggaaagctggcacctgacaatccctgcctgcaaatagcaaatcccaaagtaatgcttccacctggcctggccgccagcaccttgcccagaaacagcctgtagcaagctgtggcatttctaggcctggagaaggtcgtgtaagcatgtggtgtgattaggggacattgtatttttccttctgaaacttttcatcaaggaaactctgaaacaatacatctgtgtttaagacagcttgaggaactgataagttgatcatctatgtctaaatattgtggcctccgataacatcctagaccagtatctatcagcccaccaggtaggaaatcgrggatttgatggaagagaagttcagttttcattattaatggtgaatatttagcatgtacacagaatgcctggcacataggattttaaccaatttaatcttcacaggaatgctcaaagtttaggagcttttattggcacccctgttttacaggtggaaaagcaagtggtttgtcagtgaataagcctggcttgcgggcaggcacgtctgtctgcttgctcttaaccgcagtattctcctgtctgttgtcatggrgagcaagtgcttacctgtaaggaatccttccccacacattggtaaaataaccctacaagattattttagaagttttgcacagaggcagtatcgtagccatggaggtttatctggggtgaggttattgataattgaaaatgaaaacaataaagacagaattatgttaggagacagactgtggcccttcattgggatggcattggtgtacacagcaccctcacagtcacatctctttgttcttgtcttcctggaagcccacttgttcctaggtgaggttggcggtaacaggtaccaaagactgttttttaaacaagtcacatgagttgcatcttcgaggctgcatggttaggaaagatgcctcatttaaacgcgcagcaggtgagacatgcccctcgttttgttcttgcaggccaagccccagagtgggcgtggttttagggtgcaggctggtgctgggctgggcccctcggaggctccggtccgcgctgcgtcgatccatcccggcgcttgggcctgcacgccgccgcgctcgccgccgccgccgccgccgcgctcccgggactcggccagcccggctgggcgcgcggcccgcggtcccttgcacgtcggcccccgtcgcccgccccgccccggcgcgcgtttccattttaaaccgccgcccgccgcccgccacccgccactccttcggccgcgggtttgcatgctgtccgcgcgtcccggagcccatggagcggcggaggctgcggaagcgccgagtgtgcagccggagcgggaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcacgggccggcgggtgccaggggcgccgtccccgcagcctgagtgcggccctcgcggtcagcggggggcgtgggccacactcccggcccgcctgccctccccgcttggcccggcgccctcccggcccgcgggctcgctggatgcggcggggccccagcgcgcgggcgacatgtacttgttggacggcagtggcgagcccgcgtcgccacccgcggacgcgatgccgcgcgggacgccccccagaaagactgtctaccgcatctccgtgaccatggtcaggaaggagcagctggccgcgccgggctccggcggcccggacccacgcccggttcggcggccccggcccgcgcgctccccggacgcgcccgggaggcttgaggaggaggccgaggaggcggagggcgccgaggaaccggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggagcccgcgaccgccacgcagcccgcctcggagaagcgcaacaccctggacgtgggcgaggtgctcagcaagaacgacgcgctctcggacctggagcgttgggaacgcagtaagagcaagaaccgcacgctggacaacagcgacctgcagcggctggagcgcgcgcgtcgcggcgccgggcggccacatcggtagcaccggctgctgcgcttcttcagcggcatcttcgcgcgcagggacgcggcgggcggcgggccctcgccacggagcggagcctcgcggccacgcggctacttcagcctgcggcgggccccggccgaagcgcactcgtccagcgccgagagcatcgacggctccccgcgcagaggtgggcagcgtggccgggggtcccgggacgggaaggggcgtggtggggacttgccggttccgcagcggctatgggacccgccctcccgggtcgggagcctgcacgtggcctcgagggatgcgaactcgggtactgcggttttccccagcagggcgcagcggtcctgggttttctggctgcccctgcgcctggctgtgcgtgctggtgcccctcggagtccaccaccttcatcaaggagagcttgacccgggagaggtcgccttgccagccggcgccgacctccttcgcgtgctcgctgggtcttctgcgggagcgggccctgagctggctgcccgcgacacctgtggggccgccccagggagccgaggctcgccggtcgccgccgcacaggtgcsgctgcctggatgggagaagccggcattcatcctggcgcccctccctgcctcgagtcgtctccctgttagtgctaccatctgtcagtgttgtgatgtggactcagctgactccgtggccctcggtattgagctggctgtaaggacacctcactacagtggtggggcctggggtgggacggaggcccctctctccacagctttcctgccaggtggcatcttaatgaggagagcgagtctgggactggattctgtttcctcataatgtaggctagcaaaagggcaggaaaaccgcagccctgcagcctgttctgaaacctcaggtctgtgttcccttaagtcctcagacagggactttgcatggagggatctccagccagatatgttattctctgcaggaatcagttaaccttttggtagcatttcggggtcagagcctccagaaacctcaaaacacagactccatcaactgcgcatcaccctgagggggattctgggggtggaagtggtgctagattgctacaccttattctcctgggagggggttgtatgcctgaagatattgtggccacagacaagaggccatgcatttttaccaccaaaaaaaaaaatattattcatcctcttatctgaattctttaacttggctggtacagataaaggtagttggagagtgggcttttgatttgcagttcagactgctgtgtaacccacctctggagagggtattcatcccaagtggacttaacaggtcagctgactgcccctagggtttatgttaaaaccaactcatgcaaataaatgactgtccttatggaaatatttttaaggtaaagtgaagataaaatggtcatgttctaatatgctcctaatgatcctcagaatgtgctagaggatggttgaaaccaagcagtggcatgtgcggtaatgttaaaatctgacctgtttcactagtgaggctacactgttgccacacttatgtttagcttgtcatggcacatctagttttaacctcccttggagcacttactttagaaggcactgtatttaactccaaccattatcccatcccttcatgtattctcttaaaatatgagaacatgatgcgtgttattttgttaaaagaattggtttgcacgaagttgctcctgtcatcattggctttcagaggaagttaagacctgaaggtctcagttctctaatagcaggcttgcatctttgctctgtggacttggaagaaaacagtaattagctgcctcggttccagacaagtttgtatcagagagagaaagaaaaacgcacagacatgatttagagagaatgcatttcattgtggtccctcttgatacaagttaaaagcatttggagtttggatagttcctctctggtcaaatggattgatagtagatttggagtagtaagggtgtgaagtgtgttggaatgtttatagtaatgctcagtttgttccttgtggtcagtccttctctgggcggaattactttggtctgagacatgatattaccagcattgtgggttgtatagaaaaacggaaatttaatgaactacattatagccatatggtcagaactctagggcctcacttttttctgaagttctaagtaatcacatgctcaaaaaagctacatctttcacctggataaattctttgcctttggctaaaatgtctgacatgtcaatattcttaggattttggtgatgccagtgtctgttacaggtaaaaggtgtagcccccataggtgtcacaacttctcattttattacatttttccagtctttacatatttgcttcctgtgacataaattattcagaatttaggtgctgtttaagattttgaatttaggtgagaatctctaaggtaacagtcagatacagtagagcccaagctcagtttccctgtaaatgtccataggatgcaagtccccaaaccactggggacaggtgggtttgtaggactcggaaattttggatctgaggaaggtaaaatggtgtgtgttatatagaacgctgcttgtgagatcgggtggcgccctttagtaacacactagtattttgcagcaaagcctgaaatatccatactcagtgaaataaatagtgattaaaaatagcctcgtgccagttagagtctggttttgccaccaaagtaatttgccagccatttatgaaaagaagttccattctcagacctttttggatttcagattgacagctaaactatcgtagacctgcaacgtgataagcatcatgagaagcaccactggctttctgtacattttggccataatgttttaaaatttggagtccttgaaaatataaaggaaattagaagtgacctcagctggtacaggtttttcttccgttagaatcttttcatattctttaaaagagctagtaaatttttgaattggctacagaaatctaaagactaagtaattattgcattagtctatttggcttagagttaattgcttaggcaaggtatttccattagcacagggaagcaagatggctggagtcttattttaaagcacayacaggctcctacatacgtgtacctttggtttgcctgtattctgaactgaaggcattaaggatgaaaggattggagcacctaccttttgtaggakgattctcttgtactgtctggtccttgttggaacttgtctatttaggctcttcctagttcttccctctaatgcagaacagttgcctcggtgagttcagggctgctccctctgtgtaaggcttgcaactgatagcagcaagccagcagacattccagaaagaccctgtgtcagatcaagggcagtttcgtgttaactgatacacatgtgttagggcagagtccgttgactcaagtataatttaatacaaggaaagatcaaataataaatgataaatgacattgtagggkgtccccttgcagcgcatgctctctgcatcccagtggatgccgtctgggccrgccctggaaccagctgtgctgtgagtgaagcccacactggctatgcccatccagaacattcggtgtctttagagtgttctcttgctgtctgggaggattgattacagtaataaagtgattcattgatacctcttactgaggttagcttttaaaattagtaatttacaactgatttttgacagcacattttatgagtggctttgttctttaatttctgattcccttgatttgtatcagtcaattactgtagggtgatagactttttttttttttttttgatggagtctcactctgttgccaggctggagtgcagtgagcgatctcagctcactgcaacctccccctcccaggttcaagcaattctcctccctcagcctccccagtagctgggactagaggcgcatgccaccgcacccagctaatttttgtgtttttagtagagagagggtttcaccatgttggccaggatggtctccatctcttgacctcttgatccacccscctcggtctgggattacaggcatgagccaccacacctgtggtttttttattttattattttattatttttattttttaaaccatttatatttttattttttaaaccatttaaaacaaacagccttcagtggagaacgtgaggacacagcaattaaatgaaataaaattactgaaacaatttgataaagtttgatttttaaatttgatttgttactgaaaaggacactttttgttggttggttggttggttggttggttttttttttttttttgagacagagtctcgctctgtcgcccaggctggagtgcagtggcgcgatctcagctcactgcaacctctgcctcccgggttcatgccatgctcctgcctcagcctctccgaatagctgggactacaggtgcccgccaccacgcccggctaatttatttgtatttttagtagagacggggtttcactgtggtctcaatctcctgacctcgtgatacacccgcctcagcctcccaaggtgctgggattacaagcctgagcgaccgcgcctggcctgaaaaggacactagtaaggaaactatgtaattcagtgtttctcatttgaaacattttgaactgattagtcttttgttattagaattgattatctacagtgttttgttgttacaattgaacattcctagagtttgcttgctttttgtaaattactccagatagcaatttaggaaactcctcattatttttgtttagggctaaaatgattctcctggagacagagcagttgtacttggggtacaaggaagagctgtgctgaacgtcagccagggaaccttctaagtcaccgctgtgggctgtgtcctgctgtttatttccttaggttggagcccaagtttcagcataggtcacctgttaacatctttctctttgataagtcatcaaagagacttgggctggaatatcctgccaccagggggaatgttcaaaagtacatctgctccagaggtcctccagtgttgacaggcacattgtagcaaattattgggttatacagttaacaaataccttttgtttggagctgtaagacccaattataaagcactagtagtttttgtctttttaatgcattaacaaacatatattgcatgtttatggtgtgttctgcattcactaggcagtggaagctggagctaactagagcacagttcctgtcttcagaggtcagtagcatactggaggagatggaaaagattgaatgaatcacagcctcatggggtacttgagggatgatatgactatttctctgcatagcatatctccattagagcactagtccactgtgtaacaataaccttgcatacatgcctgccacttctaactagtgagtccttcctgggcatgaagcacgtatcattcctctgtgtactgcagagttgtagacactgtgcttgacacatagattttagtaaatgtttatgggtggaactaatgagagaactagaagagggagtgaattgaatgttcttgagttaatgggaaggagttaatgaaggcctcacagaggggcaaatgagctggatcttgtaggatctgtaggagtttaccaggtagagaagagtgactccaccagcaaggtgtttgggatttctatagttaattgttaagaatttattcctgttccccagatccttatgactaatgccaacactaaacataaaacaggatgttactctttctacaatgagctttggtgtttttgtttttgaaaaakattttcggtatatggtttttgtttctgataggaattctcctttaggctattgtcaatttgttttcctgtaatgatttgaaacaattatattaacttaaaatgatgtcacaatgagtgaaataatgaaaaaaagttatagttattgagggtagtctcatgatgagataaagtgcatacagctgcactcatgtcgccaggtgattaagaacagaattggtattaaggtcaacggattagcaaaaagggaggagattattgtcttttcattattttgaaagaagtaccatctgcccttgattgttttggtttaggttttattcagcccaaattagaatccgctgtggtgttgattgttccttgttggtgatagccctagaactgtgtttcccatcgttgatacttgcattcacgtttgctagttctctcttctcctrtgaagacatgaacgtagctgctcctttaattacatttagctagttttaattcagagatggctattggccctttgttttcttaccatcttttattgtgttcattttcctagttgatttttaatggtgacatcactaacagctctaaagactcaaagcttaccagacagcacgcttccctgggtcagaagatgagagtcctctcctctctcattcagtaccagggtgtaccagtgagaggcttgtgaagggattgtttcggcgactccttatctaagaaatgaagataatttttatgaggtgcattttggtctgtgggagtggaagggaaaatgacggtttctttcctatactgtcctttgtttggaatggtgaaaatgttttgaatctgtttctggtgtgatcgttaggtccaagatttcacgtgacgttgtgtgccgggtgttgtggtcaacacacrggaatgctcctttattctctgtacggcctttgggtgcatcatttgagtggatgttcatttgcttgagacgattgtcagagggaatcttgtgtgccctttgctctctgtgcctgtcattgcgagggtttctttgagccggtctgctgaccgtcaggcacttgagattgactcggtgaacaatgccgccagcctttctgatgcggctcctgccctctctgactcctacacaggatcagaatcactcagatatcacttctgttggtggaggcgagagaagaatatttatccagtttctgcctttctgcccccattagctctttaccaaaaaaaaaaaaaaaaaaaaaaaaaaaaaaaaaaaaaaaaaaaaaaaaaaagcaaaaccagttattctgtgaaaatatgcaaagcagagttttggccttgaggatgcgtatttgtgacttgctttcctgtacagtaagtgctgccgcctcaggagcgggcgcagtcgcttatggtgccggtgagcctgcgcggcgctggcttttgctcctctggtgccaatgcagctcgttgacagctccaagatatttggatatctcactcttccggctatttcagytgccaractagaatcccaaccttctgagagtctgttctcttttggatttgttcatagatgtctattctctcctgatctggttcatgaacactctggaagccaagttcattgaagacactctggatgtgtaatttggaagaggagactggagcatggaggctttgttcctagtattagagaaacacatagaaaggacacagtgtctagcgctggttaaggaaacttaaaggaaaaagattggggctcagaattaggaagtaatttctcacaagcatagccattctgctttggaagaagctggcttctcctatcactggaggcacccagactcgggctggcgagggattgttaggacgggggctgtgtgtgttgttgctggtagaattgatggacttcaagtcccatcctagttttcaaggtctagagtcctttcaggatctaggatttgatttttgtacctggtcttctctcagggggtagttttctcccaggcttaaaggaagatatttgtctggagtttctttggactgtcctcctgcctgcctgcctccctcccgcccccaccttgggatcctggtatattctgccggctcacctgagacgtagtaagagttctgcctgtcagctgcaaggtgctgggtggaaggtccctgcttcccactcccgctctcctgcctgccagccccacagtagtgctgcctgggcttgtgtttcgccatgtagcccctctcgataccgatgccatttgtcttctgggcatccagatggtgagtggtggctgggcatgatcttaatcggattctccctgtgcacagccagccttgactcgaaaactgatttcaggtgtgtggataatacaatgatggcggcaagaaagaaagaatgcttttctgttggttgttggaacacatttaaattgccacatggagaaarcacagtgtcttgatttggtggagtggatttagtcttgacaacaatacttcggttagtaaggtgattctgcctagttatctacatccctgagctctgtctaccttgtgccagtaaacagatatgtcactgtgcagcccagcaccatatctttgctttactttatttagctgtaatacgggttttgcaaaagacctaaaaatagaaatattgcatatgtggctgtgtttgcatttatagttactatgagatatacatttgcccaggtggatttcttatatcccgaagctccaagtataagccaaccttgtattttgctttcactgttttcccctgtattttctcatgatcttcaatttaactacttcctttaaaattattgaccactgttaccttaaaattataaatggggagaatagagttctctttttttcctttggcttaatccccttcccactcctcttattcggaggagtagcgattacttggcagcatatggattcgtctcattcctggtacaagccaaatatgtgtttattttggacagctagtctgagtgctgcgtcccaacatcacctttcctaatccctgctgtgccttctcctggagggctggcaccagagagcattgcctggaaagcagagtaatctgtgctcttgagattttagagaataaggatggatattccttgttgggcgtgactttcagtcttcagagtaagaaagcactgacacagtatattgatcaggtttgttcagtggagtgtagtaaaggtcatttggtgaattccgtattttcaaatatttaggtttctaatatgatgcgaatggtgttacgtggatctgtgttgtactgacgctgacattttgactgtcgtttctaagtaacgtactactactttggataaaaagcaccgtggcttaaccattgaagataatgttacaaacttagatagtggttgagctagcaagtaactagtgagaggaactttagctctatatgcaggagatcagagcacagggagctggccccctggctgacmttccttgtgggctacccacgccttgcaactgaagagcggtaattaaatatatattcatagaagagtggtaaaatctgctttgtccgtggaaatgagctaaaatattaagaattcaaggatgttgggccaggatttgggctttaatttggcgcgggagaagtgttgggcctgagcccttgtaggggtgggacagggcaggggtttgagtgtgaatgctggtgtccagaggggtcaggggccctgcagccccctctagaagctgtgacttgggaagcaccctcgtgtccatttggacycgtctcaggtgacttgatgtgtgtgatccccccatctctgttctgtggctctctatgggcctggggaaggggtcccaggcatcctcttgaagccatgtggggaggcaccgagagcaggaggctggcttctcctggtgtcttgtccttggcagggagcaagtgacatccattttgactggtgctgacagggtgaatgtactagcataggtgtgtgcagctggggctgtacctgccaggagcatcctggcgcgggtctcctgcctgagcttctccttgttgggaatgctgtccttaggcagatcctcattttcaggcctcaccagaattgcctggcctggtgggaagagagtggctgcgggctcccagaggttcagctcagagttctactccacacttcctgggccagcttccgcctctgaacacctgagctgacactgggactgtgaacccagataagatgatcatgctcacagctgcagctcaggatgcagccagctgtgtttttcctacttcctctcagctgggcagtttgctggcctctgaaaattctagccccccctcccccttttctttttaggcagagtgtcgctctgtcgcccaggctggagtgcagtggcgccatctcggctcactgcaagctccgcctcccaggttcacaccgttctcctgcctcagcctcctgagtagctgggaatacaggtgcccaccaccatgcycagctaatttttttgtatttttagtagagacggggcttcaccgtgttagccaggatggtctcgatctcctgatctcatgatctgccctcctcggcctcccaaagtgctgggattacaggcgtgagccaccatgcccrgcaattttagcccttttgacacactytatgacccttcttacgcgcctcccgaggaggaagcatgcactagagcgtgactacaaacctggtgccatgctagagcgggagaggagtgactgcaaacctaggcctctgtcctgtcacctttcctccagctggtgaaccaccttgtctactcccttgccccaacacagccgacaggtggacagccagacacatgcagagccattgttttttcaaagacctgttaaagtttaaaggctttgttcactcattcttgagactaacagttcaagttcacaagaataaatgtggaatacagtatgcacctaaaaatataatacagttttaattttcatctgtactgttagcattaaccagcacttactgaataatgtcctcttaggactctgtgttaattgactttttaaggttgattgttaatagagcagtaggttgggaattacagtattggtgaaatttaactgtttttcacgtgtgtatacctaagtcctataaagggtctaatttagtttgctttttttttttttttttttttttttgakacagagtctcactccgtcacgcaggctggagtgcagtggcacaatctcagctcactgcaccctctgcctcccaggttcaagcaattctctgcctcagcctcccaagtagctgggattacaggcatccgccaccacgcccagctaattttttttgtatttttagtagagacagggtttcaccatgttggccaggctggtctcgaactcctgaccttgtgatccacgcatcttggcctcccaaagtgctgggattacaggcgtgagccaccgtgcttggcctcggtttgcatattttatactgtgttatgaaacagtatcagcactgttttttttgtttgttttaatatagaaataatatgtacgttgtggactcctcctttcaagctgggcatatttcattttcactctgaactagcttggtggccaagaatgaggcgtctggaaccaggatcctgttttgtgggggttttgttttgttttgttttgtttgagatggagtctcactctgttgcccaggctggagtgcagtggtgcactctcggctcactgcagcctctgcctcccgggttcaagagattctcctgcctcagcctctcgagtagctgggattacaggtgtctgccaccatgcctggttaatttttttttaattttagtagagatggggttttgccatgttggccaggctggtcttgaactgctgacctcaaatgatcctcgcaccttagcctcccaaagtgctgggattataggcctgatccaccatgcctggcacagaaccctgattttgcttctagatttgtgacctttagcaagttatttaacttgtttgtgcctcagttttctcacccgaaaaactaggactgacaatggcatttaacctgctgggcactggtgagtgaactcgatgtgtgggtgtgtgcacacgtgtgtgtgtgtgtgtgtgtgttttcaggcagcacgagcacggaattcatgttccggtctgttgccagctgctgtagttcttttgttgatggactcatctcaccccctccaacacagggaatgttctggaaggaagtgtggctaccctgccatggttctgtgtctatgggaaatcttattctcctggaaaacgcaaagtaaattcttccctttaagacagaactgagggccggtgcggtggcttaattcctgtaatcccagcactttgggaggccgaggtgggcagatcacttgaggccaggagttcgagaccacctggtcaacatggtgaaaccccccatctctactaaaaatataaaaattagctggacatggtggcacacacttgtaatcccagctactggggggctgaggcaggagaatcacctgaattcgggaggcagatgttgcagtgagctgagatcgcaccactgcactccagcctgggcaacagagtgagactccatctcaaacaacaacaaaaaagacagaattggtaaaaatactgatcccttggaaagaagtaactattttagataccattgttttattaaaaatgtacttgcctccctcatatacacatattgatataatgccatctacatttgtataatttataaatattatacaatacttaatacatattatatttaatattaataaattatacaaataaaacttatagattataaaataagtttagttattttaatatttaaatgtgctaaatgtaagtttgtaaaatttaggaataacttgttagaaaggtgaagaagctctggattgaaaggtatgtgctgaggtcaggagtccagctygctctcctttgaggagatggccttgttttttctttctctctctctctttttttttttattatattttaagttctagggttacaggtgcacaacatgtaggtttgttacataggtatacatgtgccatgttggcttgctgcacccatcaactcgtcatttacattaggtaattctcctaatgccatccctcccaagccccccgccccccgccyggccccagtgtgtgatgttccccgccctgtgtccatgtcttctcatttttcacctcccacctatgagtgagaacacatggtgtgtttggttttctgtccttgtgatagttttgctgagaatgatggtttccagcttcatccacgtccctgcagaggacatgaactcatcctttttttgtttgtttgtttgttttgagatggagtcttgctctgtcgcccaggctggaatgcagtcgcacgatctcggctcactgcaagctccgcttcccgggttcacaccattctcctgcctcagcctcccaagtagctgagactacaggtggccgccaccacgcctggctaattttttgtattttgtttagtagagacagggtttcaccatgttagccaggatggtctcgatctcctgacctcatgatccacccgcctcggcctcccaaagtgctgggattacaggtgtgaaccaccgcacctggccacagcctttcttaaggcaatcacgagacccagcccatcgtggcctggtgaaggagcaagccctaggcttcattctcagtttggaaaaaaccgtcattgcccagaatgtcccatttacacattaattcctaaatggaatgatgggagcgctgggtgctcagaggcttccttttgaggatttgccagctgcttctggactgtaacttttgcagcaacttctgcactcattcatcaggtgcagagcagtgtcttagaaatgagtgagtcttagtgatttcttggagtgtggatccatacacacttacctcttttctgaactatagatgggaagctgctgcaaaaaagcaaggtgcagcccctttcttgtatgagggaagctactgtttaccatccatggctgcttgagtttttagagctgcgtcagatgaataacttgttggtatcactcgtcaatcttagaggcactttcagagattaggaattgtgaccaacaggagagactatctggcattaggaacaccagggcctattttggatcatgctgtactgcttacggtcatgccctgtccaatctgggatgactgtggcatacaagtcaccatggccattgtgaagcccttgttcttggagaccctgtgctccaggtgtggctggttggttccctgtggcaggacccccagaggccccaggggttgtgagagtcaggggtgtgcaggttctgagggctttgctgggtgggccgaggttgagtgggctggttgcagaatcctggtgcccagagggttcttctttgcctgttgctggggactcacgccttgtgaggggacctttctttattaccctgatgaggacagaagagttcctgagaggaagccacaagccgcctccctgacctggcagctgcctgtgtgccctggtgtgtgggttcctcccttcctgggttcatgcagcagactcttggcagtgcaggcctccttccaggggctctcagggctcagttctcatctctctgggtcacactgagccctgctgatccccctcctgtgtggctgcctctctgatgcctgaaacaccttcagctgttagtcccacggcctctcatcacctcgatatccttttctgcttgctttctggttttcagtggctgccagcagaggctgtaatgctcccctgggacctgaccagtagagaacaaatgctatgaagaccagaggcccctcactgctccacgcgtatacagggtgcgtctgtctggacagccgaaggcccatgggtggttttgttttcaaaacacaatgaaaaatgactagtcatgccatattgttagcacctttcgattttttttactgtaaaaatcaaaacagaaatatttggctccagagctctgtgaaccccgaaaatttgagacgggtctcagttaatcttgaaagtttactttgccaaggttgaggatgtgcgctcattaacacagcctcaggagatctaacaacatgtgcccgaggtggcctgagcacagcttggtacgttttagggagacatgagacaccaatcaatacatgtaaaataaacattggttaggtccagaaaggcaggaccactcaaagtggggagggggcttctgacattcttttgagtttctgatgagcctttccaaaggaggcaatcagatatgcacttagtgagcagggcgatgactttgaatagagtgggaggcaggtttgtcctgagcattttccagcttgaattttccctttagcttagtgattttgggggcctaagatttttgttttccacaggtctttttaggaattttaaagatgtatctcatccagtaaagctgaagtccccccaagtggtagctgaccatagactaagcctcctgctgtacggggcacccgctgggagggaagaggtgctggccaaggtgaatagatggtcagatgggcgataggaatgaacactttgccatggtggatgtgctttagtgatagaatttgttcaggagattatctttgttcctggtttgggaaggcagagcttctatattggaattctttgtctcccagaataaaaactctaacatcacctgtattatattgtggggattaaaatcatgcacttgtagccaaacctaggtatgagtgtgagcgtacactgctgacagattgaaatttgacgtccgaattctggttcccaggaaggagatatacacacacacacacacacacacgtgtgtgtgtatatatatacgtggagatatatatatatatatatatatatatatatatatatwtwttttttttttttttttagacagagtcttgctctgaagcccaggatggagcgcagtggcgtgatcatggttcacaacagccatgggcttaagcagtcttcccaccttagccacccaagtagctgagactacagacacatgccatcatgcccagctaattaaaataatttttttttttttttgtagagatgaggtcttactgtgctgcccaggctggtctcagacccttgagcttaagtgaacctcctgtctctgcctcccaaatgttgggattatgggcctgagccactgggcttggcttaggaaggctttttgaataattatcttcctcactcttctttccacccactctccattcaaccytgatgaaccctgctggacttcattacatttctgctcacttgacatgcagattgcagatcaggtgggcgggagctgataacattctcacttggcctcagtttcctcgtatgtccaatgaagggatgcaccctagctctaaaagtaaacattgttctcaacagaagaatctgggcatttgctatcaaacagattcccattcttcaggcagttaattttccacaccacaggagatgtttgtgacatttcccatttctttgaagtctaaggtagatattgatcctttggaaggagattaagttctccggttccatcaggtgtaatgatttcagttttagtgttcctaggtggggagtgctaacccaaacctttcatatgtaggaatgtcatccctctgcagacctttgagtccagatttcatttgtagttgacctttgggggtgacagtccgatatgtgtaaatcgtaatagcccttcatcgtagataccagtttaaaattcattttaggtgagtttccaaacagatatattggatgtatatcagtttaatttgataaacatgcagataaaaacttattacatgaggaccagtgtttgaaagatggcttacatgacctgatgagttttcattttgtccgtttccaaaatacacaggaatgcaggaatgccaccttcattcagatcagacttatcttcttcgcaggatgtggccagagatttatttaagacattagctgtgatgaggaaggtcagataatttaagcaggggcaaagtacacattactgaggattcagcgctctttggtagaaggatgtgttcctggattttttttttcttttttttttggatttttcttcttaatcgccgctctctgacttttttttttttttttttttttgagatggagtctcactctgtcacccaggctggagtgcagtggcgccatcttggctcactgcaacctccgcctcctgggttcacgccattctcccgcctcagcctccagagtagctgggattacaggcacgcaccaccatacccagctaatttttgtattttcagtagagacggggtttcaccatgctggccaggctggtctcaaagtcccaaccttgatcaagtgatctgcccacctcggtctcccaaagtgctgggattacaggcgtgagccaccacgcccagccttgccctcggatcttgaacctcctgtctactcttgctgggctgtagatggacagaggtgtcagtattttaggagtgtgatctctccttttgctcattggtgtttgaggtctgtggtgtctgtttggggagcaggtgtgtgcaggaaggaatctgcactctccacttttgctttcccaacattgtttttttcattctctctggaaggtcatgacggtcccctccactcactcacctctcacatttccagcccctctacttcagacagacttccgaaactttctgcctctcttggggtactttagtatgccctgcagatgtaagctgctttcagaaaaagccagatccwgccacatgagactgcaggccctactagaatctgttctatcccacatctccagttataggtgggtgggaagtgggaattggaattttttccttttgttcagattttcgtcatgaccacgtgtgtacccgttaagactagacaagggagtcaccgctgctgaaagaaaagtcattgtgtattcattttgcattggaggaaatgagcattggggtgctttggtgacagcttggaggagcaggggagtcagtggcatgrctaggcctgggtcccctcatcccgcccctcattcacccgctagtgctgtttgagggccagaaccaactgtgcctgtgtttagactgggtttgttgctgtgtcacagtaacgcaattgcagcagcagcagccgcacccgtgtaacgttcgccaagctgggtactgttggaagcactttgcttgcatttgtgcagcgattccagcaacaaccctgtgcggtagattattgtcccataaatctataagattgattgattggttatctgtaggagacatctaygtatacgtatttatagagcaatgaagaaataagcccaaggctatcccatgagttaggggcttcagggcttctgcgctttgctggcccttgtgctgccttcggtagatggccccggccctgcctatgccttggacactcttcattcgctagcaccgagatggttcagggcactttggagctagagcaagagcaatggagagagtgaggttgccgtgtccacaagtcactgcacagctcaccacgcgggcctggagtgagcctgctgctgttcatcggcccgtagggtctccagcacaataccgggttagtgagcagaaagtagtgcactgattatgtttccattacaccatagaacataacaattttgactgcagagaggcaggcagaatagcttgtccaggaaaataatagtgcgtttgtaagccagagaaagatggtactgtgtggtggggaattctgaaagtcttaagtctgtttctcaactcccctcttgttttcattgtttcaggcaaataatttctgatggacaccaaattggcaggtcaccatagggacctcccctaacctcaaatctgtgtaatgaagtatctgcaacatttccactcatttgagagttccacttttcaggacagtcatagagctgcactgttggtaaactgtcctgcatgtgtgtacgtgcacacttgtgtgacgtgtcagctcgtgcctgcagagactctgccagcagggctgaggctgctgccaggagagcatctggggtggtgtcctacacctcctttccaggagtttctgtgtgcatgatgcacttcagaacctatagtgtcatttgtggtatttttttttttaaatactgcttttgtttattttccctggtctaattttttcagatggtaaatagatcgcgttgttgcatgcgtttgatgaaagtgatatcacagcaaatgcaaaggtgactgggagttctaagcccctgggtgtctctccctcggggttttcatgcagtattgacactctcttctccccaggtgctgagtccccaggttcccctctccccctacctgaggtactgagggatctcacttgctacctgcttggagccagtccagtggcttcacttttaccactcagagaactttagtacacagtcttaaacaaccctggaatgttgagctaaaagggactctgaccctccctccgcaccccaccctttaaaggtgaaagcagcaggtggggtggactcctggggctggggaggccgtgcccctgggggcaggtgcaggagggagcctggctyttcaggttaaattgtgtttcaaaggcagagctcacattggagcacttgatattatgcatttgaaacattgagacacagcttctagtttaaaataaaggtgatagccaaggaggaaagcatggtttattcctagcttccggtagaggaggctggccaactcagacacctaagcagccacatcagacccagagtccgaggtagaatggatattgctaaagctgagagctacagcagagcgtctgcttgaggagctctgacgggctgggcagccagtgctcctggccctgaatgtgtttgaaggagctctttggaaagaggtgcaggcttccggctattggtagacacctgtctgcttggggcaggtatactgactttttgttgcttttacggttatcttcgggtaaagtcattgtgtttcttcttgatttatttatttttttctccagtctagtcatagtattggtttcgagaagtcaaaatcaatgttttattttcagagttctaaatccagccatataaatacttcggatctggcctgagggtttggcagggattcgtggctgctattttagatatgccaggagccttcttggaagtcgctcaccacctggttttctccaattaggctatgagcctgtatcttagaacactcagattagtgtgcctagagtgccaaggtgggggttgtagacaagattctaccccctcctccagactctgctccctaggccgaggtgaggccagcaaggagtctgccccatgcgattctgaggccttggtcccttctgagagaccccagccccgagaggctctgggctgctggatgctggtgccttttcccaccgtcaatcaagcacatgcgcatagggctctgtgcctggccccaggactgtcatatccagggaaaggtcactctctggcagtggatgctaccctgttggtggcaagttagaaaggcacacgttggtaatggccaatggttgccagtgccttacttttggagacaggaattgttacacgtctccgttgcgagaagcaaaagtagatttaacacatctttaaaatccgctgaagactgtaaagatactcatttgagatgtgccaacatttagtcggattctgtgactggtcgtgagtccctcttcctccacacagcaacactggttctaaaacagtcggatagccgtggtcatttgtggatgtgagcacagccaggtcccatgttgacaagtgctggacagtggacaccagcgggagactcagtacaaatcatgttgctttgggcttatgcacatctgcagaaggctgcaagctggggaactgaggggcctcttggtctggggaccacgcctcccttcccttccttccctgtcctgagtgtgacctccgtcatgttgacccctgcactcctgcccgccccccattcacccactaggagaaagtactggatagggatgagcttggggacaatggccagtgacatccaggagagggaacttagaggcaaggcagggatgcaaaatcggagttcctagtagaaacagacatgcagcatattgtgaaatgtttcagagaaataacagcatcacgatagcacattctctagttgctggttatctagttactagtggtaagacagagccagttaacaaagactataaagttttctcaagaggatgtaaaccaagtaaacaaaataaattcagaccccaagtgcgcatattgagtttgaatattcatctaagaagcttttgtacatgcgttatgtatccataagccaaagccgggggctccctggcagatgcccctacctggccaggtctcgtcgtgtctaggtggtgacagccatgtagatatgcccgctgccttgcacctgttcctctggcctcgcctctgtaacagaacgtggcccctgccttccatcttccccagggtgccagtggggaccttgccttctccagcactgggccgtccactttgctcctttgtgcctgcactgccaggtgcacatcgagcctaatctggcttaggaaacaggaggggcaccagctagaaaatgtgacccatgttgccaactcccaaaagccaccaggtgacttccactgccgttagaatgaaacccaaactctgcactccagccccagcatcaaaccatacttcgccctgctgcccctatgctctccccccttgccctccccccttgccttcctgggccatccttttctgactcagcctcagtgcctagccagtgggttcccctcgctgaccctcagccctcaggcccagcacctcagagaagccgatgactgacgtgcaccccgccagcctccctgcttatccttccctgccgcctcgtgtgtcctgcatggcatttgttacagcccgcagtcacaggtcttgcggtggacttgctggtcggctgctctgctgattctcgaaggcggagtcagggtgtgcttggtgtgcgtatctcccttgatgtggcactgcctggctccggagatagcgagggagggagggaggcagtgagcaggacctgttgctgtcggtggtggcatcagtggagttggcaggtactgtgcatgggagagggagtgtggcctgcaggccagtggctgaggcccagtgtggactgtagagtgtcagattccacttgctggcctaggggccttcctgatgtgggctgcggcagtcaccactggggaaggccatgcagaggctgactccttgggaaggaggctctggaaggagagcatgtgcagaatgtttcctgcagtgcctcttgagctcccgcctgagggtttgctcagccggcaggcctagaggagggggctttggggctgcagtgcagtctttgcaaagggttcaagggtcctgaaggtggtggcactgtggccttaggagctggggtagtactcaaagctatccccaagtaggcacgggggctgggcctttatgcctgtcaccagtctatgattggacgtgttctgccctccaggggtcatatccttgggccacaccactcacttctctgcccaagtgcagtctctggcatggggactcagcctagagtgatcagccacctgcactcccagcagccaggtactgaaggctttacccctgaacagagggacaggctggtgcccaccacagtcatgcgaaggcattgcggaaagctctcattaaaagagcattaagccaggcctggtggctcacggctgtagtcctaggtactcgaagctgcggcgggaggatcacgagctcaggagttcgagtgcagcctgggcaacatagtgaggcctcgtctccaaaaaaccccacaaaacattagaagtagtagtacttgctattctcataggaggatgtagaaattagataagagttaactgagaatagatttgaattagcttttattcccactgaaaaaatcagaaataaacttgatttcctctggcataagtgtgggtcctgtgagttgatcctcagcccttacttgggggttaatgacgttcccatttgaaaaacatggcagtttcaatgtctgttaatgttgcaaagcataccaggaacattttataaaaagtaacagaaactaccatgtgattctggaagctgcatagttaactgtccatttatcttgaagtctagtgattcaaagcatgaggaataagatcgggaagctggccagatgtggtggcttacacctgtaatcctagcactttgggaggctgaggtgggyggatcatctgaggtcaggaattcaagaccagcctggccaacatggtgaaaccccgcctctactaaaaatacaaaaatttggccaggcrtggtggctcacacttgtaatcccagcactttaggaggccgaggcgggcggatcatggggtcaggagatcgagaccatcctggctatcatggtgaaaccccgtctctactaaaaatacaaaaagttagctgggcgtggtggcgggcgcatgtattcccagctacttgggaggctgaggcagaagaatggcgtgaacacgggaggcagagcttgcagatagccgagatcgcaccactgcactccagcctgggcgacagagcgagactctgtctcaaaaaaaaaaaaaaaaaaaattagctgggcatggtggcagtgccctgtaatcacagctcctcgggaggctgaggcaagagaattgctttaacctgggaggtggaggttgcagtcagccgagatcgcgccactgcactccagcctctgcaatagaacgagactccgcctcagggagaaaaaaaaaaagaaaaaaaggaagctgctaccttcccaaggacacttgctcctcctcgtcttgctcaggcatctcctgggcacctttcggggcaagtcctgctgtcactgcacagctcaccttgtatatgtggggtgctcttctcctctcctgaggagttatgggtgattaggaagcaaacgcktctcagacttggagatcaaatgaagagaggctgtgtaagcaccaggatgcatggggggttccggcttcttcgcagtttcacctggtttaacccaaaggcaagcaacagggatgcccagggcgggtgagaggtgctgagcggagctccatagttggagaatgtaagtatttaaaaattcttgtgtctattttactattaaatagactgtataacctcaaaaccagttaagaatctttgacattcatggtgtgaaggatgagaagctgggaaataacaaggaccttttcctcgtgtttcctccttaattatgcttgccagtgttttaagcatcgaggctgaccttcgcaggcttcagggtttcagcttgatcaccatgtggatgtggatgagtcagttcactccataatagctcttagaggtgtagaaaggaactacttctttccatgagtgcacctttattgccctatcttatagaaatagtagatgctcatcgtaaagacttacaacaggattgaaattggtaaagagaaaaaggcaatcccctacccccgtccctcagagatagctgctgttgtcagatcagttggatattcttgaagacagcttccttcacgggtgtttatatgtcgtctctgtcagtcagttacatggtgaacagacagcggctcaggttacagacgatctgtagcccagtgtttgtgctcagtatattacacttgatctgtcgtggaacttttttcaagaacagacagcttttgttctggacacagtatttggtggggcctaggtctgcctgtaagcatacatattggcagagcagtgtctcttccacatctgagctggtcaggcagagggccgggcgcagtgggggcactttgctgggtgaaagaggtaagaggtaagtcagcaggggcacaaagaaaccatgcgtattcacaggagcatctgagctccaagcccagggagctgagaggggtcactgtccttcacaaggaggtggcttcttttctggacatcagacagcattgttgcaggagatactgaataaccaacccctctgtgatgtagtcttcaagttttattcccttgggtgcaccagcggaaggtctgtgctgagaacagaggagggccgaggagacacttgcatggggttgtcgacagaggggcaccaggatgggtattgcccagagggaacctgcatgattgttttgtttaccatttttcttgagacggagtttcactgtgttgcccaggctggagtgcagtggcgtgatctcagctcactgcaacctccgcctctcgatttcaagcgattctcctgcctcagcctccaaagtagctaggattacaggcgtgcacccccatgcccagctaatttttgtacttctagtagagacagggtttctccatgttggtcaggctggtcttgaactcctgacctcgggtgatccacctgcctcggcctcccaaaatgttgggattacaggcgtgagccacggcccccagcctgtttaccaatttttaaaccatggcttatgacccttaccctgagcatcagtgacaggggaaccaagagtcgtgtgaggtcccagggtgcacagtggacatttcagtgtgaagggcrggtcgggtgccccagcttccacgctttccagcctggattgtggcatcttggatgtgaggccacagaccaagctcacagggatgagagatggtccgtgtgggtcagccggctcaacagaccttctcccaggaggctgatkagatttgctgagcattacaacctgatgggcaggatttgttttaatcatgtaacacaatcacaaaattagtagtggcaccatgctrtcgctgcccctttcccatgcatgtgctgcagacttatctgtgggggaaaaattatccatgccacctctcagaatgagccccgtccccaccttatacgagaccatcccagccaacacagtgaaaccccgtctctactaaaaatacagaaattagctgggtgtggtggcacacgtctgtaatcctagctactcgggaggctgaggctggagaatctcttgaaccagggagtcagaggttgcagtgaaccaagatggcaccactgcactccagcctggcgacagagcctggagactcgatctcaaaaaaaaaaagagaagtatcctaacttttgtttcattcgatttgccattaagtccggttattttagctgaaccttccccttaggtcagtgccagcccattaacctgagagaagctgggacagccccaggcaccagccagctttaggtctgcgtggaaagggtgttcttactaagagcagattctgggaggtgagagctggaagaaccggaggcagccctcccatttcacagatgaagagattaaggccccaagaggctaagtgactcgcagaaaagctgcccaggcgttccatgtagagcatggatttgaaccagcattgccgcatcgggatggggaggtgctggtttgcttgttagctgtgttgggtgtacatgttgttcgtcttcatgtgaggttgttagaagtagtttagccacattaagtgcccagtgcccccacttccccctgcaatccccgatgaagcaatgcttctctgtgagtgacatggcaggggggaccaatacctagtggactgtctgtgtctgtcacccctgtgcctgggaggggtgacccttggcttcacagactgtgctcccttcaccttgccccayggaccctcccccaaccaatttcttagtctgctcttgtggcgaaaattcagcaacagtaaggagtgagttaattctgattgctctttctgtggtaatcttctggatttatttgtgtctattattgagccatcccttattataaacattaatttcaccatgaattaaacagtatgactgactgagtttataattctttctggaatgaaaactgtcaggcccaattatatccagcccaggactgacagaaactcagcatatgaattgtaaatatcttgtctcctgcgttctttattttaaccagggaaaatgttctcgtgtctatcaacttgtcttaacttcagcaaatacagtggctcttgcatactaccagcatctaagctgcagtcgaaattatcttttaatacagcagtctccaagcttttttggcaccagtgactggttttgtggaagacagtttttccagggacccaggggtcgagggaggggggatggtttgggatgaaactgttccagctcagatcatcaggcattagattctcataaagagcacacatcctagatccctcacaggtgtggttcacagtggagcttgcactcctgtgagactctaatgccgccgctgatatgacaggaggcggggctcaggaggtggtgtgagcttatggggagcagctgtaaatacagatgaagcttcbctttgcttgctcacacgctgctcacctccagctgtgtggccctgttcccagccagccacggatgagtaccagtccacgtccctgcggttggggacccctgttttaatatacatctccacccaaactgcagtaagacaaatagctgtctactcttacatctcakgaaaaaaaaatggctgtgaatttaacctacggattttgttttttcttgcagtttctgacttgtaccttttcataaaatatccctattcaacattttcactttcaaggactcagcagtttcattttaggtgttaaaatgttttaaagcattctcgagatctgttcaaaattctacgtcttatatgaaatgtaggattctggctttggtctaaggtgacaatgttctaccgcttcttaggggtgccaggaacccctggcgggaggccgtgtctccctagtgtgacagctggcgttctggtggtggcgctcagtgtgttcctacagtcattttctcaggttcttgttattgtagcagcttgatggttgcataattattcatcatacctatcacaatttttaaatttttattgctcttcccactttagatagaagctcagttactcagaggctcaacaataaattgaacatgtagtcagcatgtgaaaaccccagggtgggtttttagcaagctcctgaaggcaggtgtctggagattagagaggagaggagcacaggggagccccgtgcccatacctgtggctggttggtggtgtaggcaggagatggtggcctggaccaccacgggcatcagacatccccccccccaccccacctaggctcgcacaggagggacggggaggcaggagggaaagaactggtcgggcaggacgtccctacatgccccctcccttcccctccagcttttctcctactttggtggggtgttactgctggggcatgggaacagcggatgagctgggtcagggggatgggggtctagggcttggggagacctcctgtagatrcaggcagtgtctttggttgcgttgtcttgctacagagagcctgatgtatttgtaagaagactaagaaggttttggatgatggtgatcaggtgcttgttccctttagcaggggaaattggggctgactttttataacattggagctcactatatactagaagttgaattgtacttttttcccctggagttctgtgactcctttgaattctcacgggttaaatgggatcctggatactccctccctctttgtaaaacccctggagcattttgtggctgaaatttacttcttagagccatgaaatgccctccaaaaagtgaagcaccacatccaaattgcattccatgcccaaagtggttaacatccctcagagatgcaaactcagaagcatttttggttttgagagccacagtgctttacccataggatgggcaggccattccttctgctgactgcgtcagcagtccgggctccaggagaaccagcattcgcagtgggggtgtctgcactctctaccaagctgtccaggttcaggaattaaagatggaagtgagagcctgtgaaacaaggaagctatgaggtgtggggctttgccagaagtgccagggaggctgtaaaatgtgttttggaggcaacctcaggctggttcttctggggacctcggtgttgggggracggcctgtttctgtagcttgggatgaacttcttccctgcatctgtgaacaagcttgtactcagcctgtaggttaacaagctggggycagaaggctgtactgcactggacccaaaacctgccctaggaagatgcttgcaacaaaacttgttatcaccttggtttataacagtgagatggaaacgggatggaattggggcatgggtttcaggactatgaagttattatttatgcattaaatattccgaagcagcctcagctaatggaacacagttcttctgaaggaaatgcggaagataatcccagcagtgcaggagagctgtgctccactcctcaaggctgtaggtgggcctctgttttcacattttaagaaggaaagggcaattttcttccttgccgttttgactttcaaatcctcacgccctctgctttgattctctcagacgtgaatcctttaagcagtgctttacacacccacgacaagggcgttcttggggaacaccgtgattctggaggggtattatgaggcactcaggaatgcttttgaagaaactgtaatgaaaatgagggccgggtgtgttggctcacacttgtaatcccagcactttgggaggccgaggcaggtggatcatttgaagtcaggagttccagaccagcctggggaacatggcgaaaccccgtctctactgaaaatacaaaaattagccaggcatggtagcgcgtgcctgtagtcccagctactcaagagactgaggcgggagaatcacttgaaccctggaggcataggttgcagtgagccaagattgtgccactgcactccaggctgggcgacaaagcgagaatctgtctctgtctctctctctctctctctgtgtatatatagtatatattatatatgtatatattgtatactctacatagtatatatttataatatatgtatataatgtataatatatgcatatattatgtattacacatgctagcatatttgtaatatatatattatgtattatgtatatattatatatgtatatattatatatgctataatatagttatatgtatatattatatatgctataatatagttatatgtatatattatatatgctataatatagttatatgtatatattatatactctataatatagttatatgtacatattatatattatgtatatatgatatgctctatttagtgtatattttatatatttatatatatgggggggtggaaatcactatcctctaagaagttacaaacctgcaaatcctctagagcccatttgggccggcaaacttttgccttgggatttccttagaggagaagagagaggacccagtcaaatgctgacgttgttgtgacagattctaagtcgcctcagggctcaggggaaagagccttggaattgcaggcagtggcgtggatgtacctgcaggggtgggcatggtggcatcttggtggccaggtgttcgtcaccctgcactgagagggcctggtgaatggcaaggtcaggggatgctgtcsggacatgtcaggatgggaaactgtcttgtctgtggatctttgaggctgctgaaaaggatctttgagcctgaacttccagggaagcctgaaaccaatctggtatccccagggtttatgttttatttcatttattatagggattcaaggatttccaaataagaaattaaatcctaccattgaaactgtgctggtgaacttctgctaagtcctacatttgaaagtcatcagcggattatgtctgatccagtttgcagcgggctcttttccggctgcgwtgaaatggatttctttattctatttaagactccacttccttcctcggcacagaactgacaggctgtggcagccacagcctcctccgatgctcctctcctctgtggatgtaccatctttcttccattgttgttttgttttatatttgggggctttacggctgctttaaactaaaaataaatgctcctccccttttctgtgctaaaaataatagttaaaatccttgtgacgtttaaggttttcaaagaaaattcccaatttctgagataatatgttgtttttaaaatgtcacctgcaatttcaggttcctttttttagccttgtgtataatttcacgagttttgtctggaatgcgtatttgtggttcctggagccaaacagaattgggggctgggctgggggtgaacgtgacacgggagaccatcaagtcattctaatattggctgcatgctgtgcttctagttgataatttggaggagaaaattagagtccatagctctgctggggaatgagcccacctgccagacgatggctgtcttaatgaagatgaggtcctggctcccttgtctaatgaagaatgtgggggagcctttagcagaaggctctgaaatcccgaggaaggacgcagtggaggcaccrctggacaggagctgccttccctggtccttgcagccaggctcctgcagcctgggaaggtggggcttcctcatctcaggtccagaatcctctgaaagttctcttccttgaccatagtscttgggccctgttcccttgttggtgttgtttgctgaggtagaatgctaagataggccaactggagtcatttccaggattacttcccattctagaatttttggtatatrttggtagtcatatcacatggatgacttttttcatrcacgtttatgtgctgtaggttgaaccccactgtgaaattgccactattcmamcatatttgaccatatttgtgcctccagcacagcagcgagtacaagtagcacatgtgcctgtctccaagcaggaacatctcctcctggctgtggtcagattgatctggcaattttatgtggtttgatggaatataaattgacctgggatgaaaactgactccagtaaagccttctagtttgttttactccatgtggagttagtggtcactgtgagccagttttcttggtttttttttttttttttttttttttggacagagtctggctctgtcactcaggctggagtgcagtggcgcaatctcagctcactgccacctccacctcccgggtttaagcaattctcctgccccagcctcctgagtagctgggattacaggcgcacaccacctcacttggctagtttttatatttttagtggagactgggtgtcaccatgttggccaggctggtctcaaattcctgacctcaagtgatccgcctgcctcagcctcacaaagtgctgggattacaggcgtgagtcaccacgcccggcccgagccacggttttccatccctggtgtggttgcttcatcaggacttggcaggccatgtgttactccaggctcacttgtgcctccagcgcagcagtgagttcaggtagcatgtgtgcctgtctctgagcgggagcatcctcccccggctgtggcacctgggcaacgggacatcaattcctgctctttaatcctacccccaaaggtaataggagagcttcctctgtgggtagttgggccctttcccaggcatcctgccacctccttggcagcatctccttggaaccttacagaagccttaggaaagaattgctcccctcttctsccctccccctccttcccctcccgccgcttccctcccctcccccgcccatcctccaggctggagtgcagccttccctccctcgctctatcccccaggctggagtgcggtggcacaatctcggcttaccacaacctccgcctcctgggtcaagcaattctcctgccttagcctccaagtacctgggattacaggcacctgccaccatgcccggctaatttttgtatttttagtagagatggagttttgccatgttgacgaggctagtctggaactcctgacctcaggtgatccacctgcaggctaatctcaaactcctgacctcaggtgatctgcctgcaggctagtcttgaactcctgatctcaggtgatccacgccccttggcctccaagtactgggattacaggsgtgagccacctcgcgcccgaccagaaatgcttctattttatggtgaggaaattgagagaccagaaagttaaccgaggtcactgtcaaacccatggctcctggctccctgacccctcacacccatttccctctgcgtcctcttgatctcccatggacactgggatggrcagggccaggtgggagaagcagggctcatctctgagggctgcgttatggggtaggagtttagcctcagtaactgcagcactttctgcycatggcaacctgtgctgttttcacatttctcagaaattcccgctcttggagttttacacttgtaacatctgcttagcaaattttgaaaaattgaagatgaagagtaataaagtgtggacaaagctctgcasggagcttgttagaaatgctgatttgaggccgggcgtggtggctcatgcctatattcccagcacttgggaggccgaggccagcggatcacgaggtcaggagatcgagaccatcctggccaacatggtgaaaccccgtctctactaaaaatacaaaaattacccagatgtggtggcgggcgcctgtagtcccagctactcgagaggctgaggcaggagaatctcttgaactcgggaggtggaggttgcagtgagccaagatcgcgccactacactccagcctggcaacagagcgagactccgtctcaaaaaagaaatgccgatttgaaggttctgatttccagagtcccggctgatgctcacctgttgctggctttgctaagcgtcccaggttagtctagggcgagcaggctctgagcaacacagcagataatgagggagggatttagaatctggcattgccaaggaggtcaagggggactttcccaagtgtcccgctgtgtccagaggcagcagcagggagaacctgtcctgaagggctgcagtggtcggcgagcccggcacctgtctagttcttgggaaggatcattactatcaccaacgtcgattgtaaaatacaagatgcttttttctttttttttttttttttttttttttttgcgacagagtctcactctgttgcccaggctggagtgcaatggtgggatctcggctcgctgcaacctctacctyccgggttcaagcacttctcctgcctcagcctccmgagcagctgggattacaatcatgtgccaccacgcctggctaatttttgtatttttagtagagacgaggtttcgccatgttggccaggctggtcttgaactcctgacctcaggtgatctgcgcgcctcggcctcctaaagtgttgggattacaggcgtgagccaccaygcctggcccagacacttctgagaacgagctacatcctctgtgccactggattctggctggtccaggaacacaggtgtgcacacatccggatgtgcatccacacactcatgcgcatatgcccagctgtgtttccctgaagcatatttatccttccagtgttcctgcaccttggaaggaagcaggacagctggcctggaccctgccccacccttcctcgaccccacctactgagtgatgaacaattccacgccagcacagtgtccagcccacagataggtccctgtagtggagtaggaggaaggactattttggtatgcatggctttcgcgaatgttttgttaattttcgtttagctttgtatgaggcagcattccattttgactgggcggtaacagagttgatgaaagtttttaaaataaatactttttaatgggagatgaagagttttggccaattgagtcaagcatttattttattactcttattgccacaaacacaaatatgttccattcaagtgaggatgtatttgcaagtaaaaagatgcttcacattgttccaatgtttatataatcatgcatctttgtttaatggagcactgcttaatttataatgaatattttatattgttagaaagttaatcttatggtggtatgtgttgaaaaatcagcagtgcattgatgaatagagctcattttaattcacagtttaccctctttgttttactattaaagttcatttttaaaacttcacgatttaatttcttatgtgccaaatggaataaaccttaaaaggtgccagaaggtaacaatgaaaggaaaatcatctcatcacccttgacttcagccatctagttcctaaccctaaatcagcacctgttaagttggaaattttaccagaaatagtctcagccttgacargcatatgcatatttattttgttttgttttgtttgtttgtttgttttttaaataacgagatggagtctcgctctgtcgcccaggctggagtgcagtggcacagtctcggctcactgcaacctccgcctcctgggttgatgccattctcctgcctcaggctcccgagtaactgggactacaggcgcccgccaccacgcccggctaatttttttttgtatttttcagtagagttggggtttcaccatgttagccaggatgatcttgatctcctgacctcgtgatccgcccgcctcggcctcccaaattacaggcctgagccaccgcgcccggccaagcgtatacatattttgcacccctcacccccgatacactttttagaaatgcatttgtgaggatcctatccatctctgtatcgcacctggctgtcatcacttgatagtagcctggggamttggggaatccccactgcagtatgttgagcttcagttactggttttactattccatgatgtggctatatccacagttacttaaccagggtgtggtttgttacagtgcagcaacagagtgacgttctgagaagccagacactattggggcctgcattttggagtcatcatcattgacctttcagttttccctggaccattagggtcactttgcagatcctctaaggccacattcccatttttctgcaagagtagtcgataacagaaagaagtgttttccaaattaattggtaatgctgttcactgatggtattaagacacaattagttaccmctgactgagygcttgctgggtgtcaggcccacgctagtgcgttcctcgcatcatctgtccacgggtaatgtttgtctgcagcatgttggggtggtgtttgggtgcacaattatgcaaaattttgcgcccccgatatttagctcccaatgtgtccgtgtcagtgggaggagagtagaggggcagtgactggaagtctttgcgggcagtgcagggagaagtccgcctcccaggcatcttcttcctcagggctcttgggctttcctcctgagctcctgcagatgggcctctgccggtctgctctgccagctggacaggcatgttgtgccccgaaagtctctgccctctagagatcactcagatctcctcctgatctacccagctgtcctttcctggagcagggagtgttcctctgacgggatgtctcactcggcatcgggagacccttgacgctgtcattgcagggcccgtggcatctggtttgctgcacagttgccctccccatgaccccccccccccgcccagaacacactgggcagatgtgccccccactctgtgacctggtgggttgtgctcccccggcgtgtgacctggtgggacgtgctccccagcatgtgacatgatgggttgtgctcccccggcgtgtgacttggtgggacgtgctccccagcctgtgacatggtgggttgtgctcccccagggtgtgagatggtaggacgtgctccccagtgtgtgacatggtgggatgtgctccctccccagcgtgtgacctggtgggacatgctcctcatttgtgtgacctgatgggttatgctcccccagtgtgtgacatggtaggacatgctccccagcatgtgacctggtgagatgcactccccagcctgtgacctggtgggttgtgcttcccaatcatgtgacctggtgggacgtgctccccatcgtgtgacctggtgggttgtgctccccagggtgtgcctggcctccttcagatgctggttttgccctcctgtgtcacacccatggtgtggttagccccttggcttccagccctgcatccatgcggtcctcatatcacacagttctgtgaaggtgatggtgtttcttaacttttaggcatcttatgaatcaggtcacttcttagacataatgtagagtgagtaagtttcagcattggaggacaatatattggaagtaaatcccatgtggaaagagctatttttctatcagtgggatgcacctcctccctctggtccagcccactcgkcatgtgttgcccgagctgccatgtgatcaccaggacaaatgatgactactatcatggggtctcatttatgataagaaatggcatgtggtgggtgtggaaaactgggttgcaggtaaagccatggtcgtttgggtcatctgtatcgggtgggtgcactgtgcacaggcagtcaggggaggcgggggagagtgcacctgcagagggctgggctctgtagaccaccccatggagcttaggagtcctccatctttctgacatagtctaaaccatcctggctgggtcttcagtgtttaatatctttgtgagggtcaaaactctagcaccagatctttcttctgagctgtaacctgttacttacaaacactgaagtgttaacttacactgtgagcattcaaatcttcaaattcaatcatactttttgctgtgtgtgtgggatttcagaaaaatgactattgtastagacaagcaaaagaccaaatgtggaccgacrggctataacagaatcactcctcggaaagctaggtgtgtcctcaaatatctccacacttgccaacaggcacagtcaggagggtctgaagatacacgctccactgaagggctgtggctttagcaggggaaaaatggaaagttcgattttcagtaactttygaagtcrttggayagagcatgtgttaccgaccacagacttggacctggaactccccactggcatctagctgagtgtcgtgaactgggacaaactgatctttctggggtgagagtgacacagggaggcttgtctgcaccatcttcagtgaccttyggatgtgaaaatggcccattggaggcattttgacttggcctttacgtgagttatggtgtctgactttgtgtcctcctctttttcagatgccttcgtgaacagccaggaatggacgctgagtcgatctgtcccggagctcaaagtggtgagtggttccctctggccctggcacctgtgggaagggaggggctctgtgcacacccaagcctgcattcccaggcaactggtcatcgcctggggcccagagtggaagtgtgactctgggtgtgttcctgggaagggccaggtatagttgatagcttgggactagagtccaagttcctgagtgcccctgggacagctatgacagccatgactgccactcagccagggcggtgtctcatgtgcagggcagaggccatcatcatcctctctctcacatctcgtgggtgtgtgtgtgtccacacacacacacccccatgggttgatttgtcctttgcaggatgtcacggaaggctccacacacacacacccccatggattgatttgttctttgcaggatgtcacggaaggcttctgtcatgagtcaccaagctttggtatccatcatttttgaaatgtgactatttaccctgtgaccaagtattggcatgaaattaaaatttttgtcttktacgaacyttaccctttcggtgaaattatgtagagcytcaaattggcacgtgtaaaaagtggtccatcgcagccaccctttccagccgctcccctctaccgtaggwtggaaggaaggggcaagtctaactttgaaacaaccaggttctttgtcgtgaaatatgtggcatttgtgtgtatggttatgtatctgtgtatgtatgtatatatgtgtatatatgtctaatttccgtgtgtatgtttatatttatgtakgtatctatgtatgtatgtatatatgtctaatttctgtatgtgtgtgtatgtattttctaatttgaccgtgaaagcaaagcagatgagctcttgctgttctgcagactccggcatgggcctgcctagtgtgtctgtcctctgcatttctattgatagcaccagatcccctgcggcccgtggactcctccccactgacccyaacctcattgcatgcttggaggacaggacaagggccaggagacaggatccttccggtccttcatgtctgagatgaggagatagagcaacaaagaacttctaggtctttgaagagacttttgtcaccaggaaaagtatttgtttttaaacttaggaaatgaagtacaatgagtgggaggtgccctgaggtgggaaggccctgtggtcactgtgcsgtctctctcattggtgtctgacacacccatccccaccgcaaccgcggggtgtcatcagctgggcccatctccttcccggtgtctgccccccgccccattcctccctgaagktctctgggctgtctctgcagcacttgcccgtgggagacaaagcgtctctcagtcctagtgctgtctcagaagcctggggttccgcaagactggcctggaaagagccgcctctttctgtcttttgtgtgctttgtcaccgcggcactggcagggtgtcttaagcctattgaagccgtccaggaaatgtgcgttgaatgaatggcacaggcttggcaatgytgttaccaggagattctcagaacaatcccgcagtttccgttacttcctgttaagacagccgctgccactcgggtgctgtgatgggcacggaacagtagtcacggtggtttactggtggtgatggtgtggatacagcgctggctctgtgcgggtcgtgttctaagtgctttacaaaattacttaatcctgacaagtgccccatggggagggataggtacggttatccccatttcacagatgaggaaactgaggctcagagacatgaagaacctgcccaaggagccacagtgagtaagtgggggagctgaggtgtgagcctggagctggtgcttccaccaccgcactgcctgacagaactttctcgacggtaaaaacctcctgcgtctgcactgcccagtgccgtcacggctggcgccatgtggctgttgagtgattgaaacgtggccagtcagtgccatcaaggagctgcattttaagtttgattctagttcatttaaattgaaatagccacacagggccagcggccaccctactgccagcattacagactaactgatcgtcaagtattgaaccacctgacttggcagttcaaggtgttacaggttcagagagggcccacatgatcataccagcccataatcgaggatgcttaccaccaaaaacttgtgctctgccggtattttgaaagcatatgattttctggaatatctgcccagagctgtaggagacagttgcgtttgaggcagcatgggctcctcattctgaaacggactgtcttaaggcttgcttcaatttgctgacaccgtgggcttcgatgctgttggttctacagttctcagaacggtcctgtccctggcctgagtgtggatggacgagatcctggcaggcccaccagctctgctctagcccaagtgccttcttgttgtggcatcagcgggcactcgtcctcatcggcacccccagcagatcccttgtgtgctgaggagtgctcagggactgaagaaagcgctgctttgttccctaggcagcctccaagtgcctatagggctgcaattgtttccctcctagcgcagcccccccaggacaggtggcactttaggtcagcgtctcaggaacccagcccctgcttcacaaacgcagcagtgacatgatgtcatggcaagcctccaataggccctttatgtaacattttgcaataaatcttttgaaatctgtcagagaaaaaaattcaatgttcgctttcttctcaagagtggtagtaccatgccttatgttttattttctttctttcttttttttttgttacggggtctcactctgtcacccaggctggagtgcagtggcgccatctcggctcactgcaacctgcctcctgggttcaagtgattctcgtgcctcagcctcccaagtagctgggatgacaggcacccaccaccacatctggctaattttttatttttagtagacaagattttaccatgttggccaggctatgctcaaactcctgacctcgtcatccgcctgccttggcctcccaaagtgctgggatgacaggcctgagccactgcgcccggcctgatgttttctgaagttgtgctgtggtcagatcgtccatgaccagttgcttttggtgctgcacaggagccaaccgctgctggctgcagatgtgtgcccaacagcaaaagcttgatgcttctgtcagaggggaaggcacataggctctggacatcttgcctgtgtaggggacctcagtccccagctcctcacatcctatttgtgtgttttcattgaactccaactggaatttttactaaaagccttgatttccttttcagcaaacctcagggttagtgtggggctctggagaaatcagtttaggaagacattgcattccctttggccttgtgatgtgaagggccgagtatgggttccaacgcacttcatgtgcctgcacagacggtgacccctgcacagaggttgacagtggcaacctcttcctgccttaagtacgtagttctgtgattttcaagacacctcattcctcctcatgtagctctttggctcgctctggattgatttcctccgtcttggtttacttccagcagtcgctccgacagcttcacgggtggcgtgacacacttgaaacggcattttgaccccttattttattttcctttcaccatcaactgttaatttccaccagcgtttcaaattaaaatgatgccatcgtgtgtgactgaggtggtctgtgagatggctgttccagccaaaccaaaccccttcccactccactccaagattgattgccctaagggagaacttaggggagagcttaatctttgcccatcttgttaggtggaagaaggcaggaacgttgctatgcagagaaggcacagaccaaaggatgtttggttttggagcattttcttcctcgagaaagagaaactgatcttaattaaaaatttaattctgtggcatactgttttggattttcccagcatgaagctgacatgaagcgggtgcccttgagcaaaagaataattagtaggtagaaattctccgattatagaggcccagggtaaaaaaagatgtacgtcggattaggaggggaaacagctttatttagaatctgtccacacagcctggcttgagcctggctctgagccttagtaataagcatctcattcactcaccagcagtgcagtcatgcatgtactcatccgttcttttactcggcccgtgctcttgagcgtctgccttgggctctgcattacgcagggattcagagaacaaggcaaatgagacaaggtgcctgtccttgaggaattgtcagtattggaggaagccagatcaacacactgatgtttccaaaataatgtgttcccttgtgagatatccttggggcagagacctaagggagctttgaggaaaggcacccagttgaggctgtggcatcaggaaggtgtcttcgtctcttctggctcctgtaacaaaatatcatacactgagcagctgataaacaacagaaatatatagctcacagttctggaggccaggaagtccaagatcaaggcacctgcagatttgatgcctgaggacctgcttgctggttcgtaggtggcatcttcttgctgtgtcctcacgtggaggaagacgcgagaggtctttctcaggcctcttctacaagggcgctaatctgctcccacaactgccacacctcgtaatacaatcaccttggggattaggtttctttgtttaaaattttatttattattttgtttttattttttgagacagagtctcactctgtcgcccaggctggagtgcggtggtgcaatctcagctcactgcaacctctgcctcccgggttcaagtgattctcctgcctcagcctcctgagtagctgggattacaggcatgcaccaccacagctggctaatttttatatttttttagttgagacagggtttcaccatgttggccagtctggtcttgaactcctgacctcaggtgatccacctgcctcggcctcccaaagtgctgggattacaggcgtgagccaccatgcccagccaggggttaggtttcaacatatgagtttggctgggagtgtgggggtaggacggggaagcacaaacattcctaccatatagttgaaggcttgtcagaggaggtgacatctgaactgatagtaagagtaggtttcggggaatgattgatatggaaagctttagttgcctggagacagcaaggcctgttaggatggggcttggtagctgattgactagaaggccaagcagggagcgggcagatgagaggcgggagggttgtaactggggtgtaagaggacaggaccgagcataggttttagaaaggccactctggctgatgagtagagagtgggagcggccaggactgggtgacagagaacatttggatccatgagccatcactcagacagcagaccacggtggcctgtaaatcactgagaaccttttttccacactgtcatgccaaatttgttctcttatatgtttgtttgttttcttttttgttgttgtttttgttttgttttgagacagagtctcgctctgtcacccaggctggagtccagtggtgtatctcggctcactgcaacctccgcctcctgggttcaggcgattctcctgcctyagcctcctgagtagctgggactacaggcgtgtgccaccacgccttgttatttttttgtagttttagtagagatgggatttcaccgtgttagccaggatggtctcgatctcctgacttcatgatctgcccgcttcggccccccaaagtgccgggattacaggcgtgagccaccgtgcccagccctgtgtttgttcttaatagctattggcttcatcatctacttaaccaacgttccttcctccctcctgtctctcctcctctcccctttatttccatctctcctccctcccatccttcttccttgtcatccatctatccatcgacccatcttgtgtttaccaggactttgttggagccagggactatgacaagtgtacagattcggagctggtgtcttggcccgtatccagagacagagatcttggccctcggggtcctaagtgtagtgggaggtggagcccagggcctcaccagccactgtcaaggctgtctgggggtgaggggaaagcagggaagctttcccaagagaaagtgaagccctcctcaggtgaaaggggaggggtgctcaggtgacaggagcagtgaagtgttcttgyggcaagttcatggacctgctgggcctgttagctgccagcaaagttgtgtgcgaggatttggaaggagacagtttgttcctaaaatgtttggagttgggcctccaggcagcaggagtctcccacggcttatgaaatgaaggagtgccactttctcatggtcactttgtttctaggaacctctctggtgttctcgggttgaaaagcaggtgcttgcaggcagagagaggccctagaggctgcttccttgatccgtgcacactggagagtccacactgaggtggcagcaaggtgcccaggagggagcggactccctgacttccagccactgggagtcggggatggcctccagctttctggcttgagaggctgggtgtgatgtggcctcagaagctgatgaggagactgggagagagaggcaaggtgtggacccatcgaggcgtgaataccgcataggtggcgtacggatgtatataaagtcctggtgggagctaagtaggggcgcctggagctggggtggacggcggccaggggatgcgatttgggaataggcagcttttttttccccccacatccaaccttctatcaatgagttatgattccagagtctgcagggtgtctcctgttaaatggaatcgcagctcattgagagaaggttggatgtggacaggcgcatgttgggacattagagtggaggatcagctggagatgtgaggatggagccctgrcgagtcccagtatgtccctgcagatggaggaagaacccacagggctgggagggaggtagaggcggaagccagtgtgagagttggaagagagtgtcttaacagcagctgctggtgatggggccaggtcagagcgagacaggctagtggctttgaaatggaagttgcgggtgacctagtgggcagtttcctggtagcaacagggccagagcttcagataatttgagtggaggcaggagggaggtcaacaagtggaaccgagagcaagcggggtgagtcccagctcagggaatggcaggtggccttaatgagcacctgtgcctggggatgggtgccttgtgatgttttgggctttttaaggaatcgattagatcatgcttaaatttgatcactagcgatgttctagtgggggaggaaaaggttaaaatgcaggagatttttgatgagcagcttcccagagaaggcggcatggggggtatccagctcccaagcacagggaaagggaggctccctgtaggatcggccacttggaggctgggaggccaggtgtgtctcctgtgtcaacagggaggcttcctgtgaagaatcccctggaaagtcagccttgccgccaggttactgctaggacagaggccctcatgtcaccctccctcctgagggtcgccttctaatccagcacaaacgagcacctttgccgtctctcccagcagccctggcactgtcccctttttctcggagatgccttggtgggtcctgtgtctgggaggcaggtgtgtgccctcctcgcctgtgtggccggcccctgccttgctcctccacccccaggtctccccacactgcccttttctgctcctgttgtcctgcccccaagtctaccctagactcatcccctaaagatgctaccatgcatgggtcctcgccactctccccacgtcactcacctctgccctcgggtgccacctcacctgctgcttttcccagtctctggagggtgcacagtagatgccggcgggctaactcaaggaacacagccctgatgtaaacaatgtgcttgttttctggaagaatgccaaaccagtgtttataccagcattgctgatgccgttgcagctgttgaggctgaygagaacgtgagatgttaattaagagtgttggactcccttttactccaatggaagtattgaatgagcttgtttttggccatccagccagtgcttggttatgtttgtgtttaggcctcctgtctattttagcctcttagtatttgcraaatgcyaaatagagtgatttgatgatgcttaacggttgtccgtttctgtttcagggaattgtgggtaacttggccagcggcaagtctgccctggtgcaccggtacctgacgggcacatatgtccaggaggagtctccggaaggtatgctgtttggcaggcagttgcaaacttaagaatgtagttttttaaaatttttccttagcatattataaatcatgactttgatgtatcacaggtcaagaaagcaataaaacataccaagcggtaaaaacccttaagtatgtggtttcttctgtagtatttttagcaaacccgttatattcactttgatatctggaatagcgcagtagaaccatgaaatactattgaatttatttcttatctaattgttctgtcctttcaaatgtcctttttaatccagtgtccttcttatccattgttgctcctttaaatattgactggacattcctgtgatctggatattgaatttatacataatttgtatgtaatgttacttagtcatagataagagccttccgggataagacgttcagattaccaccaccatatgtttgagtatgtttccccccttatattataaacatttaataatcattttgcatgagagtaagatttttttttttgccattaggcatttgcttcttcagttaacatgtccatattttattttttgccttaaataaaattatgataatggtaggaagcatttagctcccgtgtcccctaacgaaggggtgtagttgacaagcagttttctaaatgaaattttctctccgtgtaactttgttaaatccaactctgagacactgaatttctggttccttctttttcttactggctgttccattctttgcagatatggatgcaggtaactattcattttcttcatggcagcgcttgtcttgttttggagagagaggaaaggcaccactttgtactgtagcgttcccttccctccttgttctgtgtaccatcctgttttgtttcattttatctttttcttcagttgaacattccaccctgttttgtcccttagttgtctttttagcagtagtcccaagcagcttcacctgttccctgtaacacctgtcctagcatttaactcttgtcctgaatactgcggaaccgttcggagaagtataaaagtggcttgaggctctgccaccgttttgcagaattgtgtagtcatgtcatgaacacctcatgcatcaggaagagaccttccatactgaaatgatgatctaggaagattagaggtgataatgaaggcttgtatgtaggggtcaataggagaaagcttgcctgttcactgagaaatgcatacagatgccagaaaatggcatgatttggagaaatgagcaaaggccacattttgycagggctctgtccctgggttttgacggcttttatttgctcctttgtgtcggaatatgaattttagccacggccagctggtgacaccttttagagaatcttttagagatttttcctttgggttttccacttattttcaagggctagctattgtagaggttatacagaggttaactcacctgcaaatgaaatgaccaccttttctaagtaaatctactttcagggccctgcaactctgtggatttcaagctgggaccacaggaagttacatgagtcgggcctggttttgttgctgttgctctggcagtctctggccctggggttcaggtgtctggtggggcagcgctggrggccctgggtttctggagtaagaacaaggaccacgactcactcatggtggcctttctgctatatggctatttggtcatttttgtggcttttcgctgttttccctttgggcattcacagtgtgttccattgtatttgggcccagctgggatgtcttttgcagtgcataattgacccttacatgttgactcacaccaaagcatttctcttgaacgwttatacatcaaaaggaaggattgtggggtgacctaaactgatcactaacatccctgcttctttgatttttcaagtaatgcattttactgcactgaaatttcatagtattgtgtatggtttttaaaaatacattatttttaagagtaggagcgtgggtgagtacmttcctttcttcatctgcaaagtggaagtagctcatcccctccatggggccccatgcccaaggcttcctgggtcaggggaaagatcatgatccctgaccttttctcatgccctgcagcagccctccctgggcatgtggcctctcaccttttgactcgaggtcccaggkattgttctgtgggagtgtgaggagctgacagcagcagacacccaggtgcaccccagtgggtgtgtgtctagggcccctgggtgctgaaagaattatgaatacatggctccttgtgcctggaagcytcttagtcctgctgaattcatgcttctcatggctgagccacctttcccgtgtagaaccaagcaggtggccactgtctttgcccctcttaatgagaccagggaatggacttctacttcctgttcatgtgactgtgtgcctcatgacagtggcaggagggagccataacttgttgtaatgtcacttgtaatgaagggagccatacttgttgtttgggaaagaaaacaaatgagaagccgtgtttctttcataccacggtcttgccatcctgaaattccctctcatgctcagggagcctgtacctggaaagtgatttcaatttttgtccagtgagttagtgttgatcaattacccatgctttgcttaattgagaagctttaggtatagagtgttgtgggtttgggatataatttactgtgttgtcacctgggtgtgtggagactatcaaagggatgtgttgtcctckgggagtgctggaggctgacaaagctgatgatggcccagcctcacctgtggttacttacccacacaaaggtgagggcactcccacagtggtgggagtggttggcgcccggttgagggattggattttgagtgagctctgtggccttcccatttcttggtgtactgctgccttctcatcagacctcctttcctcttacaactgctagagcgatcaactgggcagctactttgaatgaaaggcattttgctgtgtatctgcctgtccagatagttccttggattctccctgcgcttcttaatgkctgkgccctgttcttctgatttaattagtgcgtgagtatcctttatgtcataatcctgacccgtggctgggatatgtagactgctgggaggggtgagggtgagggccttcctgtcttcaggggagagctctctcgtggtagaaacatttctggtgcagagccgtctccagatccaagcctgcttttcctcagatacatcagatgcattttagctccatcccagagggtaatatctgctgtcttttcgttgtatgatgcattttggttgatattttattcttgtagtgaagagagccaactcacaagatttagattattttattttatttatttatttattttgagatggagtcttactctgtcacccagactggagtgcagtggcgtgatctcagctcactccaacctctgcctccaggattcaagtgatcctcctgccgcagcctcctgagtagctgggattacaggcaccccccaccgcgcccggataatttttgtatttttggtagaggcagggtttcaccatgttggccagactggtcttgaactcctgaccttaagtgatccacctgcctgggcctcccaaagtgctgggattacaggcatgagccaccacgtccagccaagacttagataattttaaagatgcagttcaaatgagggaaggatataaatattctgtttttcaattagtgaattaacaacacaaaagtgggtaacaccgtagggaacttgtgattccatgaaatcagtcaaagagtaaacctcttggattgacagattccttaatattatgtgtgtgtgtgtgtgtgtgtgtgtgtacacctaggtgtgtaatatatgtatgtgtacttcagtcctagcactgtagtaacgaactgccacacacagtgtggcttaaaacagaaatgtattctcatagttctcagaagtctgaaatcaaggtgttgacggggttggttccttctgcagcttagaggttgaatctgttctatgtctgtgcggttctgatttaattagtgtgtgcatatcctttatattctaatcctgacccatggctgggatatgtagattgctgggaggggtgaggtggtgagggccttcctgtcttcaggggagagctctcttgtggtagaaacatttctggtgcagagccgtctccagatccaggcctccttttcagcagatacatcagatgcattttagctccatcccagagggtaacatctgctgtcttaattgtgtgatgcattttggttgatattttattgttacagtgaagagagccaactcacagatttagatgattttaaagatgcagttcaaatgagggaaggatgtaaatactgtttttcaattagtgaattaacagtgcaaaagtgggttactccatagagagcttgtgatttcatgaaagccatcaaagagtaaacctcttgtatagacagattccttaattgggtgtgcgtgctcacacgtgtgtgtgcacatctgggtgtgtaatatatgtatgtgtacctcagtcctagggctgtggtaacaaagtaccacaaactggcttaaaacagaaatgtattctcacaagtcggaaatcaaggtgttgacggggttggtccttctgcagactttgaggttgaatctgttgcatgtctgtgcacagttgttctgatttaattagtgcrtgaatatactttatcctaatcatgacctgtrgctggtatacgtagatggctgggttatgtagatggctgggagggttaaggtggtgagggccttcctgtcttcaggggagagcttctggtggctgtcagcaatccatgctgtttcttggctcatagactcctaaccccagtctctgcctctgtcatcacagtgttttcctggctatctgtgactgtccaaactttttcttataaggacaccagccattggatttagggcccatcctcctccagcatgacatcatctttacttgatcccatctgcaaagaccctctatccaggtgaggtcacaccataggtcccaggggttagggcttgaacgtatcttctaggggatacaattcaacccacagcagtgtgtgttatatacctgtgatgttctccagggatgtccaatcttttggctttgctgggctacattggaagaggaagaattgtcttgggccacacataaaatacactaacactaacaatagcaaatgagctaaaaaaaaaaaaaattatacacacactaaaaactcatgtgttaagaaagtttacaaattagcgttgggccgcatccaaagctgtcctggttggcaggttagagaagcttggtttagacggtcgctgcacttagaactgttggagttggccccatcacttggtggtggtcatggttctgccagtgatgcttttgcaagctctgctggtgttctagaacctcacaaggactcatcggctggcagtgaccttcacacctctgaggacaatttcacagctgccgttcacttcctataaagagaatgagatgaaaattagttatttgccaattgagccctattaatggctgctgattagaatcgtgtgacattttgggtgtgtaatgtgacttccctcgtggtgtgtttatgtgcttaatattcagcgtcccccaacacagaccccacatgatgccactcagcttttaactctcctttcaaaagagaaaaagtcaaaggaaacaaagctaggatgtccagtattatgtggacattagataggaaatgtggacctgcccaagacacttcaccccctgcaggtggggagagtgtggcgtcctcctgagatcttttcaggttgcagaactgagtcattgctctgagacccgttccccaggacaactctctctgtgtcacccatggcatcacaggcaccctgggscatgggccctcccgagctgtgcaggttagcttgtgtgccagaaggacctgaggaccagaaaagctgaaagccagcaccacgctgagatcgtggcacacctgaggagggcagaaaggtggccccacaagcttcccaagatgaaactaaactgtatatggattgagtgggagcttttatcgttgkttggttggttggttggttggttggttggttggttggtcgatcgacagagacttaagaatgttcatagaccaactccaagctgcaaaatgaaagtaccgagaggaaggtgggccatctgagagccgcctttatcccagatctggaagaaacccacatctaggtgtgaaagtggcaaaaggagggccggggcctgcctgccactgaggcccagcggctgcctgcgagggtcagtggtgtcgtagcctgctgccgccacacagagggatttgcagggaagggccttagccaggcatgatgtgggagcgttggccctggcattcccgggtcttcatgagcttaattcagcaggggctccttccttcagtgatggaawctggagtttctgactgattcttaaccaactcaaaattttaggcagaaagctagctccaaggctgaggcagccctgaatgtgcctaggccaacagccagcgagctcctggccrggagcctggtaatggggatggctggtaaaggctgtgccggccctgcctccctcccagaagggcgaccctccagccccatgtccaggctctcccatcttcccagctcsggccacacataggcagcagctgcccccatgctctgtcccagagacggaacacactggtcactgggagattagcctccctcattcattttcccgatagaatatgatagctgaggtagctggaagagtatggtcaaggagctcaaggcagctctttcactcaggagcctgccagcgtagggcaggggaagtcagtgccctcccagatggaaaaggtacctgcggtggtggggggagggggagttccctatgtaaagaagagtccaaaacagataagggagactgaagaaacctgaacatccagtgctcatgaggaaaagctttaagagaaaataccaggtgctaagagtaattataactaccaggtaaggaccagtgagaaacagtgggtgagattaggctcgacagttccctaactcaggaaagtcgagtttctgagcataagtcataggaaattctcaaacatacttttgctttgtgcctgggaagcaggaaagtacaccagacccacctcatttcttacatctctccaagagaagcctttcgcttgtctgtttggtttatttggttcacatcagagtttgctaaaggcttggaggttctgtaggaaggaatgagccgcttcacctcctggagaaaggacgtctcgtttccagcatgtcgggggtcaggctgtgctgcactgaggctgaagggttctgggattttccactgtgtgtttggtttctgttgcttgttccaagctgctgacgcggtgtgctggatgagagttctactggccactggcttctggcctccagggccagctggctgtacagccacctgcaagtctttgttcccggggttagccttgccaccctccttcaggactgcctagaattgtttcctgtcatcggggtagtaaatgtgttctcaggagcacgtgtatcttaaatatgttttaacgaatgtttacttagtttcttagaaacaaaacgtggtaaacacccagtcttattttctgggacacatgaagtgtgtttaagctgtcagctccaaaaaccctttccaagtcaaataacttaaaaaaaaaggttgtcagctaccactgcatcccagatgttagagtttatttctaaagctgttcttgggtgctgtttaatgttccagtggaaaaaaaaaaaaaacacctgtaatactccagtaacatttgactagtcgtgaaatctagccatttagatttttcaacctcaatttgaccgttagttgcaaccaagtgattataaacacatgataattttttaatgagaattatctgtaaacgttgagatgatgagcctgctgctatgttggtttaatagataaagcagaagtcagttcagccatcttcactgatgattttcagaattaacctgatcactcaccatggaaataccattcccctttgttcttgtcttcctatgtgtgtgacagtccctaacttgacccctggcatggaagccatcagtgaggatcaggtgatattgtctaaaaataggtaaaggatgctaacattattattagatgttcaaaaaaataataaaagggaagcatgttctgtttcattttgagcaagaaaaaaagccgtaaaatcagaataaggagatagtcatgtttttggcattgatgaaattggcaggacraagtgtgtttttgagttggctgtatggaactcagaatgtattgtcccatattgttataattaatttgacaagaaatccagggcttaccaaaagccatactgggcctgcattggagcctgtgttccagagaaaatacctttctgaataagtaactgtgatgcagggctgggacttacacccggtctgggagcgccctaaagaggacaagcccgctggcttctgtggggagtcactgtctcctgagggcagcgcacagaggctcatgtgtgtcccttcactcacagagcccaacaacagcacagcacatgctgttgacacaactgttgctttcctaagaaacctcacggcatcagatattttaacaaaaccgttctttaagaggaaaatggagactagagcctagaaagtttcacgtatgtaattacaaatcatttttcctagagaaattttaccccmaaagtgttctgaggctgtgggtgcatttacctgtttattgcggattaacagagccattgaatctatcccaatggaaccaccatcacacactttcacctgtgttcactgctcctcccgtctgcccatgtctttggccttgatcacgccatctctctggaagcccagctccaggtccaggaaaccagattatagcagaccactgtgcccctggccagggaaccgcctgctctggtctggaagccccggggccatgctcgmtgtgttagtcaatgctcttttggttgcatgagatagttgaccaacttaggttagctaaaatagaaaggcagggagggggtgggccagtggtgaattattaacttcttaacttgcatctctggagctgccaaggggatggatttagttttagaaagaccctaatctcctgatgcactgaagttcttgaggagccctctcccccatttcttgcctgtgttgggtgggcatcatgcccagcaaggtctccccacttggtagcaagcccttcatggtggtttcggtccttagtgctcagatgtggtgaggagggaaaggtgaggatttttgtcaatagctacagcaaaagactctaagtcagttccatgtggcctcatttgagtcaggtgcttttccctaaaacaatcagtatcacaggttggaggggatgttttgattgttctgtcccttcgggtggggagatgaggtcagcctaattgagctgagtggcttgagcaggagtatgatagactagggctgggcagaaggtggactccagaaaaggccgggaggcaagtcccaaccctgtgtcttcagggtttgtccgttttaaacattttagccagggtggggctggggggagggggtgttgtgcaatgcagttctctttcctaattcacagatcacgttacacccagcttgcacggtttgaacttgggtgctaaaggagaagcacctggggtatgtttgaattcaccccaaagctacctctggtaagtgtctccttgtgacttttacagtctcacttgggctgtggacctctgacattttcaggcaagtttttgcttcttaatctccaatgctgaaagcttagtctttggaatgttatacattgtttggatcttaaaaatgtcagctcacaaaataatgtttttacatccttcctccaacatcatcaaccgcattagctcaccaccactcctcctctccgcttctcccccaacctgtkttatcggtgtcaggaaaggrgagcgatcagtctctcaggaggtacccatattgatcataatatagcctttcttaggcgtagcagtccagcaatcagggttcaatggtttcctctggaaggtagcatactgaaaaagacgaagtgcagagaaaagacagggtgggggtgcagcatgtctagtttgggggcctggctgtgggtcagaatggagagattgacacttcagagaaggccgggaatgaaattgaatgtgcagagcacacgttccactcagcaccgattagagctgggattgcctctcgcaactccccaaagaaaatgctgcgtccttgtaagaccgtgtctgcccagtgggggcctggacactaagtgccacttctctgcccatggcaaattccaagggccaggacgatggagacaagggaagtagaagttgaaagaaactcccaacggcaaattaggtcgagtgccagaaagaattacatcaggagaatctgagatgtagtgaaagtgcccccaagctccccgctccatttcatgtgctactggctggctgtgagatctgaaaaggactgggcccagactctgtgtgtgtgtgtgtgtgtgtgtgtgcgtgctcttaaatcartgtaaattaggctatatacagctgccaataatctgcaaaagatgacagtttcatatgattccaatggcttaaactaacaaattcatgaatgattgacccagaccagaaatggaaacctgattcaactcacagtgtagtcctttatccatgcttgttggcttctggaacgcacagtgttcaggaggattctgaggcagggtctgtgtgcaggaggagtgctagtgtgagagctgctggtgcctgccctgggtccgaaagctggtggtggtctgttcttgttgtatgagggcagcccatgtcgccagcatttattttctgagccccatttcttaatgttgtatatttttttaaaaattaacaccaccataagcaagaaggaaaaaatcaacacttgctctttgaaggccaaatacattgaaatgaaagcgtgcctagtggagcaagagcggggcggggaggaggggaagccagcctgcagcattgccctctagacactaagaagaagggagtaggtttaggttggatgaagaagggaggtttggagcctggacgagagcaggggttgtggaggaatggtcaaaacccaggcgtgatgtgaccacaccatctggcaggggaccaggccagctgctgtgtgggtcttccatgtcccagggacggagagaggagaagtggggttggccaggcagaggcatgataagagtcagagtggctgggctccagggctccagccaggctattagcaggagcactggctttggagggggacctaagaggacagataggggaatccccaggccacctctggaccttgacattgactaatgggatgagctgctggaacccatcaccatgaagccccctgcactaactagggcgtgtgccccttgaggagccgcatccgcttattgggcctaagaaaaactgattcccaggtgtgtttgggcygtctagaaccatgtgacctggcagccacttcaacttgggcagcatctcggctgggagccccagggagcctggcagtacctcagtggcagatgcagctcgttccaagatgttccagaggcaggaggttcctggaagaaccactgggccttgcagggtcagctcagcctgagagccagtgaccccctcccccaggaggatgctgtaggggcagtctcacggcggtctcacctctgccacctgtggatgagaggctggaccgggtcttggtgctttccagctcagggcgttggtccacttggttattcttggggaccaaaatccaagctaggatggggacagaggcctggagacaacctgctggcctccttccattaaagccattacagtgtcaccacaggattgtaagaattacaaatgcgttttccagagtccccagagaaaaaggagtctggcagttagaagagtaaagtgcatctgtcaacaaaagaaataccaaagatgagactacagcagcgacttgtcacctcttccgtgttgctactgcctgagaacagaggtttttagtttctttaaagggttgtaaacataaaaacaaagaaggatacaacatgcaaggcctaaaatgtttactttctggccttttacacaggcagttcgccagccccctaccctacagtatggaaaaaaggcatagaacagtcaaatcacgtaggatttcttrgtttctccatgcaggctcatcgaatagcaaccaycctttcttagtttcttgaaacaagtaccttatttacattcagagaattatatgtggacaaacagctcataagcccgtacttttacatactcacttcctgaattgcatattgaaaaagagagttcatgtaaagccgattattatttaatctaaagttatgttcacataggaagcactagtgtagagaaatagggtctgagggacaaggagcctgtgtgcccgtgtcggcagccgagtaactgccaagggtcccctgcttggcactctgctgtcccacttgcttcctgccctctctggattctaacacttgtgccattgtgcatccgtctcaggtcatggtgctgttacttggtgagaaagcattatttaaataccccagatgaggagttaggcactttctccagttttgcaatgctcttttgtttaccttttaaaaaaaaaaaaaaaaaaaaaacgagacaaggtctcactctgtcacctgggctggagtgcagtggtgccatcatagcccactataccttgaactcctgggttcaagcgatcttcttgacttggcctcccaaagtgctggtattacaggtgtgagctaccatgccatttaccttttttatgcttaaaataaatgtataaaatattaaaaatcattttcctcccaagaaccaaacgtgtattactaaatatgtttagttgaccatgcaggctatttgagagacagtgggagatgctgaaatattcaagcaccactgttttggtgggtatcggaagattttcaatcaatagtttacttatttggttatgtattaggttgtattgggtggggccaatcattatgtgactatttttttcttcagagtggtgattgaaaagcagcccccaaccgttttctccgagaggtgcatgctgagcctgcctgcagcttacccccaacccccagcccctagcccggctctccttgtcttacatgagtcagtttccttctgctgctattctggacaaaaacctctatcaggacagagaccttgtcttgttcaccctattcctggcatcaaggctgtgtctgacatgtaatggggatggctgtttgtttggtggtggttgagatgaccaagatgttcttgacctgtgtagggtggtagtggagaaacaggcacaggcccttgtggtgtagttgcgaaaaaggagctcacactaatgggaaccagattgtatcattggctgagtatacagcagatgcgttcccctttgttattttatcacttgcttacctggaagctctggtctgactttaggaacatgccacacacttggataaacatggactcctttactagagatttatagaatctttttcctagagccatttgagaagcacttgtccaagacgtgctattttataggctattttgatgtaagggaaaagacgtatcctggatcttccagaaagcatggaattatggctgcgtattaggaagaggcctggctttcctgtgggaattgaacagaagacaggcatctctcatgttctggttgttgcagttttgcttcttctgttcattgaattagcgtttcagagctctccatgtgtgagtttccatttggaaatggtatagtcatcatcgtaatgtagcagtcattcgttaatttttatgagccacttgtgacgtttcaggaagctgacagccgacatggattagctcatttatacctagggaaacagaggcaccagaggccacaaaagctattcagggtcacacagcctatgtgtgaggtttacataataaacstcaaaaaacgcaggctctaaggaacaaaaaggaagatttgagctgggtggaggctccttatctctcctacaacctgagccaacaacaccccatcacttcaccccaaagtgcgcagggaagaaatggaaggggcagccgtggcctcatcttttgtgctgtttttctccagcacaaaaacctgtgtgctgtttttctgcagaccttggttttctcatcttgaaagttgtgaatctgtgtcacattttcctggtgtatcgcgtgcacttttgatctgcggattcagatctttctgcgtctcaggaacattcctttgtcttttatcttcgaatagtctttgagttcttttgttgtggatgtgttgtcagagataccatttatccttttgtttaggtccgtttgtcaatgaacttctctcttaaatactttacctctgtctttttaatctcattgactgtgtctgtttcaagccattcctctgtgtcagaaactcagctttcagccttgtctcttctgctccttactttttctaattttattcatcagttccccaaatgccgttttgatcctcagatctggacgtttccattttatctcatattgtttcaaattctcatactggaggttctcgtctcctggaatggctgttctttcttaagtcacactggagtgggaagcggttgtaagggacttccttctgctttttgagctttgttttcttctccattgttgctttgtttctcttctgttcccttccctccttcctctccccaagcctctcccgccttcccattttccctgctggggagcctttgcataatgtccccagccctgctcttcagccttcttggcttggacctctcttcccagacattgtctttccctgagaccgatgctgaccrctgggaagacttctccctcattctgagtcaaatctaggctgttgggagcccgtgaccgccctgcttcctgtggtgggagaaggtgagggagaggagatgctctcatcytgagtgtcctggacgagatgggccagaccattctacccacactcccatttgccrgacctcagccacctcccccagccagccccaggggtgttgggggcatctttcgagtctcactgcccacgctgtgggagctgagactggatgctgttctggagatcccaggatttactgagcatccatgctctgccatccgtctagttggagggagctgcctcccgttgaaagagtctgcccttctttagggaccagggctctgctcttcctgggaatttaccacatcctcttccaggttcccttcacccatcctgcggggtgggaggaatatatcattgttccccttgaggtgcccccctgcgtgggtcacttctcccgctcaccaggcaacacgggcatcttctttgcctccggagagcctttgccggccattcacttccaaggctttcttatttccattcctcagtcaggagacgaaaaagatgaggccacggctgccccttctgtttcttccctgcgcactttggggtgaagtgatggggtgttgttggctcaggttgtaggagagatraggagcctccrcccagctcaaatcttcctttttgttccttagagcctgcgttttttgaggtttattatgtaaagccgtgccccttttcmtgttggatggtgaagttccttccttctggctttaatgtttcccccttgttttattaggaaaggaggaaaggaaattcagttatagtgaagttctaatctgccatcttaacctggagtttggcttttttcttgttctgtgttccttttgtaccttacttagatctcggttaaatgaaaccatgagagaccgtggcctgcccaaggaaatcgtgttaagtgctcacttcactgcgggtcagaaccccggagtgtttcacccatggaaatagtcagcagtcgccacatgcrgggtcctcactcactgctggtacctttgtgtagtagttactttgtattttacaatgtaaattaaaaaaaaaagttgggagaggaagtgaaatctgatttggctaaattttgtaaacaaagatgttaccaataaaacctttttcccagtgtataaataatatgtggtccaaaattccttttaaatgtcacaatacaaaacttttccaaaaccccaacattagtgactgacttcagtatttttatcaaagttaaatgagccaaacttattttttacaaatttctggcgcattcatgattgaaattttaaatattctcctagggaaaaacgagggctgattgtccttttcaaggtatccatctcatcccacttgttaaaaataattagggaataatacagtttgcagattttctcccgatgtcatcatggcactcagtaacaaggaatattgtagatgaattttgaaaatgtttttcctggaagagaatcccaaacgtgtggccgaaagggacccaggacctgccagccatgctcctcctgtctttctcccttccagtctgaaccccacagcgctgggcggttgacgaggtgtggccagcttgcatctgctgaaagaaccggggtggccccactgcatcttgatcagacactgccatgargtccctcccctctctgatggcaaagggaaacagtgggctctacacatggagctttgaagtcaagagtcattttcatccttagctcaggcatgaaaaaaaaaaaaagaatagtaaaaattaaaaaccctttaaaaagataaaaatcaacagtaaaaaatgaaagttacagacaggtgtctgtctttttagtttcctaagcacagtgatgattattggagctaaagacagaggccacccttcccaagtgtgagtggagtaaggataagatagtcccgcctctctgcctgtttgatgttggccctgtggatgctgcaaaacgcagcaaacacggaggctgccggctttgtttctgtagggcttgtcttagcagaagttcacatggaagagaggaggcgtaagaagcagtcagaacgtctggattggagtcttggtcctgccgcgtgctggcygtggagctcttgctctgtgtctgaactccttttcctcctgagtggatttgggtgttgccagtgatgtttgcgtcataagatggggtgagggctaacggagatgatgtgggaaaacaagtgctttgtatcctgccgcgcactggccgtggagctcttgctctgtgtctgaactccttttcctcctgagtggatttgggtgttgccaatgatgtttgcgtcataagatggggtgcgggctaacagagatgatgtgggaaaacaagtgctttgtagacgatggcgttggaaggcacactgtcgttgccatagctgtcgcttggaggactgttaatgatacgttgatagctttcagttcaattagccaaaatgacagaaatgccaaacatctgttgcaatgttgactcccaaaagggccctttttttggaatgggaaaattcagttttctctttattttctttttcttaaagcagaaatgacagcatagatgatctccctctccgacttgtctctgtgtagactgcacttgtgttcaagaggctccgctgtagctcaacctcgcgtgagtgcagaaacttgaaggaacccagttgttttacttcccccagcaccccaaatttaaaactggctctcacattgtgagacagcattcagaatagtaatcgtgaaaggctatgaggacttagaaaaaggtatttaaaaaacgaaagagtgtagctgtatccttttcttcctggtgcgctgttcattcacggtgaacgcacccacttcagcatcttggtggaaataactcagttccaccttccatatacttttctctctgcagtgtgggatttagggagaaattaagacctcgactcgcttatgaatacaagctcaagggcaaactaaggcacccagcgcagtttccacatgttctgggaaccctgaacacttgccttggggtgaaccagaaacctaatacattgcacattgcacttgaagttgagttcagacaagaagatgggaccgctgtatccccaagtagctcgggcgaggtgagagcactccattctgcttcaaactcagtgcagaaagccaagcccagaagggatgcgggttccgttctcacctccctctgctctaagctgaggattccaggtgatgctgtttacctcctgtgatatccttgtgtcctggggaagcacagatttcagtgagactgggactctgttttcccctctcactgagatgcrgtcacagctgcccagcgacctggttccaccttagggtcaggcagctgcgaccgatctgtctggttcctcaccctgggggtgcccgccgttgggaggtgctrtggttccagggtgggcgctggtccctkcccayggagctcgcctagcacctgttcacaggtgtgcctgggccagatgcatgtctgacagggacatcaggtttggggagactgaaaaccatttttgaaaatgaagttatgctgatgtcatttaatvgtacgtcatcataattggcagcagagaaggttgcacatcactcatggcagatccattacmtgggccatgggccaagctgtgcaccaggtgctgggaggataccggtgggcgaaccagacctgcaggaaaatacatggaaatggggacaaaacaggcatttcagaagctacattcagcttgaaactggatgtaaaatttgatggtatcctctaaaattctggtggaaaaaagatctccctttgggaggctgaggcaggtagaccgcttgagcccaggagttcgagaccagcctgggcaacacaatgaggccccatctcatctatccaggtgtggcggcacatgtccgtggtcccagctactcagggaggctgaggtgggaggatcttttgagcctaggcagtcgaggctgcagtgagtcatgtccgtgccaccgcactccagcctaggcaacagagtgagactgtgtctcaaaaaacaaaacaaaacacaacacaacaacaatgaaaaatctaatgactgggatgagatctgatgaaatggtaggttgaatttaaaatggtgcaagtggtggtgcctgcagagtaccagcttgttgccaacgatgctgtcatcctaaggctctccttctgtggttaaagtggttcaagtgtagaaaatgaattttaaagtgttacctacctgccagcccagacttctcaaggcccagtggtcctattgagctgaacctgctcccatcagtagtgccctgcgggaccttttgaaaatctccccagtaaagacattcttgctttcatacaacctggctgctggagcacctggctgaattttatcttattattcacctttgagttcgtggcaaatacttagcagtatttaatttttgctttctgatttaagtgtaatacgaaaaaaaatcatgcaaatcaattaccagtatctggtgtttgaaattgtaagatgctgaaaagaactgttaattatactctgtatctgcsrggggaatgtaaactgactttaggattcgaagagaccttgctgatgagagaaggaatcactgctccttttagaggcaatgaaagttgggcctggagtcctttgcttgagatcacaaagccagagacttcaggagagcagaaatgagaaggctcagtgccctcctagggaacctttcgtaacttgaatattgtgattcagccacctggaagcttcacttgtgaacgtgactctgcaaaaacatgttagaggaagcaaaggagaggatggacgtgaaatccgtcctatgcrtgctcacctgacatgcaacagggaggktcatctgccagggcgtcacggtcattccacgagagctgggtggtgacgctccccaagttcccactcctggagaggtaggcagcgagggacactggcgttgcagggcccctgggacaggctccactcctcccttcttgctctggaggtgacacagtctagkgatctagtgaggaatgggacctggggccagcgtgcttggacaagacgaagcctcatcaaagttgaaccttagggttcatcaagcagggagggcttccacatacccttgtatctggggcaaccatcagagggcagggctggagctggggccctgtagggcactcagcgtccggagggcacagaggagcacatgtggggctcaggacacagggtcgggacggtgtggcggcgaggtccctctggctgtgatatatgttaggggaaggagggactgaggccgggagtgggcacgggcaggcaggaaacttgtgcagaaacctagcaaagaagtgtgggtgatttcaatgaatgtgaggggtagggaagggagagcagagggagattaaaaacacttgggggtgagataaatggggcagggatggtgaggatccctgtttgctgagctcctctgtcccaagcagggttctaagagcttttcatgcattaactcattaaggaaggctctgtttaccctcatttcacaggtgaggaaactgaggcatcgagcagttgagttacgtgctggaggtcactcagccagggagggctcggcagggatttgaacctggtgggctggtgcctggggccacacacagaacagggtatgaaggagaagattcttctccaaagaaagaggaacagatttccttttcaaatgttatttttctttctttctttctttcttttttttttttgagacacagtcttgctctgtcacccaggctggagtgcagtggcgcaatctcggctccctgcaacctccacctcccaggttcaagcaattctcctgtctcagcctcccgagtagctgggattacaggcccccaccaccacacctggctaatttttgtatttttagtagagacagggtttcaccgtgttggtcatgctggtcttgaactcctgacctcaggtgatccacctgcctcggcctcccaaagtgttgggattacaggtgtgagccaccgcgcccagccttaaatgttatttttcttaaaacagtcaaattcaattcacatcaccaagatacagcaggtttccagcatctctttttaaaaagtttttttaaagggaaataatactactatcactgttgcagacttttctgtcgtaagcaggcttattcaatgttaaatacgacttttattaaagcaggttaaaagaaccttggcagaaatttcaaataagactgggtcgggtactgttcagggtgctttgtgtcaacttattactcctcgcctgctaggacatcatcccctttgcatctggggacactgagatggggcgaggtggggcaagactacacagctgtatgtggcagagccagggttcaggcagagctaggccagtatcggggtctgggggcgaccgtctgcagcaccgtcacatacgtggggacgtccacctgtgtcagatgtttcccagcttgtttcatgatgacaacagctctgctagaaaagcatttcttttttgcctacgaggactctcgattcagggaccctgagtctttgggaccctcgtgcagctggggctcaccctgtctggacccagcggcctgactggcctggatgtgtcccctgctaacgggcctcagcctgaccatttccagtgggccctaccgtcttgtttcagtgactggggggacagcaaaatgagagtttatctgctttaacatcaaaaggttttcttcattgttgtgttattgaatgaactgaacagcagatttatttgctttagcaaatgcggctgcctgtgatggtggcrtaggtgttgagtgtgagcacacgagcatggcaggagctcgcgggaacgggccaacgccccactgccccagtcagccctctgtggcctcagagggtagctgcccgtctggagggcctcggacactttcaggctgggatggggactctgattttttgcttctcaggcactgatgtggttcagacccaggattctaggagggaaggttcccgtcgcaggggagggaatcagacgtcgctctgggcggcagtggagctggcaggcagcctctgggctctggcagcattgtcctctgggtccagcgatttggggtttagacagggtttctggacggcatctgcacagaggagcggaagacaagagctgggaaccgatgcgtgccttccctctttaaaacaagagtttcgaatccccatgagggttccctagcgtggtctcagagcccaggatctggagggggacgtctgtcattggagaaggcagaggagccagggtggaatccttcccgctgcccagcaggagcagggctggcctagcgggccgggctgggcactgcagcaaccttgtaccatcccctcctgagagcatcaggggccgggacgtccaaggtagcaccaggcccctcatgcccgcaccccctcctcatggtcacctctgttcctgcagggtcccggtggtctcccgctaaccccgcgtggtctctaacgcctcctgtcagccgctgctctgctgtctccacccgtgcggaggtcccatccagtagtttctgtctaacccatgtgtagtagtgaagcgtccctccctaattgtggcctgtgactctggaaacaccattctcatgatgttctatgtctccctttcaagaactgggtttctcttgaggagaatacaggttctcggccctgtaatttaccaagaggttgcagatcaggcacctgttaagcatgaaaaatttgtttcagttttgtgaacccaacaagagaatgacaattttaatgttctctgtttcccagtgagtgagaattcctgaatttacatagaaagcccacatgagaagtccacactaattggccacgagtgtctggcattgcgaaggaagctgtgccttccaactggaaacgcacaggggttcttaaagacaaacatttaaatctgagttcggctctgttaaaattcagcatttgctggcaacatcctaaatactcagttgcctccagggcgacagcctagggtgtatttttccacaagcgaagcccacgtctgtctgccctcctcactctctgttgttctcgtgtaacgagatgttttgtgtgtgtggcaggtggcaggttcaagaaagagattgtcgttgatggacagagctatctgctgctgatcagagatgaagggggccccccggaggcgcaggtgagtatacatgcatgccccaagcctgctttttttccctttgttttctaaggtttgattcaagaagtgcttctagaaatcggtgacttggtttccaaaaaagtggaaaccccataaaaaatgtttcctctcactgcatttttttctcatctctaagaagctaattctttttttatttttttcccagactaaatcctgcagggaagttgggtttatgtgatggcttttcactttctgtgtttttaaaaaggcaggaaacgcacactctgccctggttggggagcccagttgaaatgacatctggaaatttctgtcgtttgktttgttttttggccttttcctttgagtggtttgatctctagagcagtgagagttagagagcttgctgggtgcaattgggagtcccaccttctctctgtctctggtaactacaggcattggcccctctgtgccgccctggccttggcccaagcaaggcagtctccaccgaaagccggtatgaagcatattatgatttctttggaagttcctggaaagatggtcattctggaaataacaaaacatgagtgtggaagatctctttttttggtttatttaacctgctttgttttacttacagcataatttaccagttaagcactttattattattgttattattattattgttgttgttgttattattattattgttattttttattatttatttattttttttttttgagacagtctcgctctgttacccaggctggagtgcagtgacgtgatctcggctcactacaagctccacctcccaggttcaggccattctcctgcctcagcctcctgagtagctgggactacgggcgcctgctaccacgcctggctaattttttgtatttttagtagagatggagtttcaccatgttagccaggatggtctcgatctcctgacctcgtgatccactcacctcggcctcccaaagtgctgggattacaggcgtgagccaccgcgcccgacccatttaaacacttcaaaggagccgagagctggtaacggctagtgacctcaaatgcaaacggaatgtcagacattttcttggcattatttcctggacttaacctttttgtgaacgggcagcataggattgtaagatggagaaagtgaaagatactgaatacaggacttcttaggcctcaggtctagtactccacaggttggagggctgtgcggttatacagaagatgccacagatttgccatgttgcattgactctgaccattgacagtgaccattaagatgtaccagtattcgaaagaaggatgctgccaattaaactatgaaacagccgcaataattaggtgcattctgatttcaaagctgttaaagtgtgtaacattttgtttcttagcattaacgataccatgaacttgatcataacaaggaaagaccttgaagacgtgttaaaagtgaaaacttagttacaaagcagtttgagcccatgttcagtgaccgtctggtagtttatagtatggcagggcaaagttagaggtctgataggatcctatcagtcagatgctgataaaagtcagctctttcttagtcccactgaatgtataggaccgtgtttgttctgctacaaaggaactcttggaggcaaggtccctcctgtggctggtgataggagaaagaagtaggtaacatttagaatcacctgagttgattttccgttttccccagcacataaatgttttgagtgactggaaacaagcttttttctccacaactgaagagcaagtcttaccagtatatgaagcacaaaagcttaaatatagagaaaaatctacagaagaggctaggtgcagcggctcacacctgtaatcccagcactttgggaagctgaggcaggcagatcacctgaggtcgggagttcaagaccagcctggccaacatggtgaaaccccatttctactaaaaatacaaaaattagccaggcgtggtggcacgtgcctgtaatcctagctgtttgggaggctgaggcagcagaatcccttaaacccagaaggaggtggttgcagtgagctgagatctcaccactgcactccagcctgggcgatggagcgagactttgtctcaaaaaacaaaccccaaagcatagtttcagttttctgatggtgaacatgttagattggggggttatttattgggtgccccccacacaagttgctggggaagtcagaatgcacccttaggagatgagagccacagttcacgtttcctccgggtggatgctcagatgggcttcagctcccggctcgggaactgaggtctggttccgggtcagccagtactctttatgggcgcagtgggagtctgctcctcctgctttcttagaagagacaggaagagcctttctcaaggcagagaagaggaaaaggagatgccttccgtcagccttggtcctggcactctctgtgggagctgctatcacgatcttcccaggtctctcccggccttctttgttttcaagtcctcattctcatttaattttgtatttatcactagaactttgggttaagttttaccatgtacatgttttacatataamtgaatgcacttttcacttacatgcagaagtcagagtttaacctgttaaaaacttagaccaaatgtattagaggtgataaccttggccataaaaacctatctaggaactacagcttcttttagggaaagcagacgggatggatttcggttttgtttttcaaatttgcacttggaaagagaaggatctttgttgccagatagagctgatgtcagatgtgctgcgctggttgcagtgagtgtgggaagtctctgccctgcaggcagcctccactcactcagctccagttttccaagatggctgttggtactaaatgaggtactagtatatgcctgacagtgtgggtatctgtcaaaagaggatgtgatgtaggttcaactggcaagacaagaataaaatgaatacggcaaagcaagaacaaaatggcgagagtgaggctattgtgaagttttcttccctaagttttgttaatttccctgaaaataagtagtcatttctttgcagaggtgcagcaggagttcagccaaggatgagcctgggttgaatctttacccttcaacagagtaggccagccgctgcggtagcgagtgggaaggactgaggggtggggaggttctgagcaggcatgaggggtccagcaaggcttccttaagaggttgagagtacagtggaaagccttagggcttgaggggctctggcaggaggtgggtctggccttctgtctgcggggccgccttggcaggtcggggcagcgggcggacaggccaggagcatgaggaccgcggggacactgtgtggtttgtgtcctctgaagacagagtggcttgggtgggaacaggatgaagggcccattcccaaggggaacaccaggcatggtgtgctcaggaggaggacgtggatgccgtgacagtgtgtaaaagtgacagtcaaaagtcaagcacccagtgtgtgaccgaggggattcctgcagccccctgctgcctgccgccatgcagacatctctgttcttaatcaagcctgctcactcagctcctgctctcctccccttcttctctccctagtttgccatgtgggtggacgctgttatatttgtcttcagcttggaggatgaaataagtttccagaccgtttaccactactacagtcgaatggccaactatcggaacacgagcgagattcctctggttctggtgggaacccagggtgagtgatgttcgtgtgcagattgttttgaaaggrwtctaacagttacatattttcagtatggaggagtttaaaaaatgctttaaagaaggaaaaattgcctactgaacgctcacttttttgggaaaaattatggaactgaaatgatcacatttcctgatttgattctatggtgaaaccactcatttaacaacctgaaaacaacacacacacacatatcccaggtgctttatgaaaaataaaatctattttcccttgttttctggaaaaaaaatatatatgtgtgtgtgtatatgttttgtatatatatagtcaaatacatatatatattttctgctatattttaattctctgttctataaaatgatttataaacaatctattaaagcttatctttcagtgcaccttgaaaatagtgctgattttgaacatagagcagttctgtttattaagttctgtttgtcaccgtcttatgatctgtatcttatttttaatctgacaggcccctcagacagagaatccaactgggcacatttcttgttttctctgagggtcacttcgaacttggtctcttagtggagtggccgtcacatggcctgagacacaatgtcctcgctcttgatcacagacctatggttgtgctgggtctgccactagggtctaagatgtcacrtaggatgtttgtaaaagtcagatggaggttagctttacaactgctttgtcagaaatatgggtaacatacaaataatcctatcaggaaaaattgtatatcccttcatttttgttgtggctatgaatagactgttttgcgaattcttttagaatgagcctatctgacatgcccatccatgctctgatgtgagacgcttctctttaggacgtcagctgtacatactgcactaggtgtggtctaagtaggaggttgcccaggcagatgattggctgcttgatcacgaacctacaaaagcccagataaatagtgtggcataaaccacaaacattttccagccagacgtggtggctcacgcctgtaattccagcactttgggaggcccaggcaggtgggatcagttgaagtcaggagttgaccagcctggcccacatggtgaaaccctgtctgtactaaaaatagaaaaattagccaggcatggtggtgcatgcctgtaataccagctgctcaggaggctgaggcaggaggatcacttgaacccaggaagcagaggttgcagtgagctgagatcacgccattgcactccagcctgggtgacagagtgagattctgtctcaaaaaaataaaaagccgggcatgttggcgggtgtctgtaatcccagctacttgggaggctgaggcaggagaatcttttgaatctggggagatggaggttgcagtgagccaagatcgtgccactgcactccagcctggtagacagagggagactccatctcaagggaaaaaaaaaacaaaactataagtatcttttcagtgtgctagatgagagatgttagagttgggcttcctggagagcacctcccccaacttttttttttttttttttttttttttttttttttaaagcgtacgtggtcgctctcactcctgaaaccttcagagccagagctctgtttaatcctaacacagaagggaggagggattcttaggcctaatgcrccctctagtgttcaccaggagacaaggccgcaccacccaaaagtccttggttcttgtgagaatgcagagttgccgtatttgaggtggcatcttgaaaatgcctaatcgtgttttaaagtggatgctcatccacagcagattctgcttaaagctgccttgaagtcgaatagagaaattccgaataagctccccttcctgcaggcccgaccgtggcatttttgagcagggtccttcggggctgtgtgtgcagacaccactcacaggctgctggagctcaggaggtttgactttaggactcagaatgggcttttgcttagactcactgtgaaaagtgacagtgaagttcccagcctggaaagatcccctgcgatcargttctgttctctgagttctgagtacacatccatgttccatcagtaggaagggagtgtctgagatcccgggagttgggaccacacacacctgcgtgtgactggctgctggctgggtgaccttgacacctgggactttggtggggttcaacaggaattcccagaagacactcagtgcatccgtgggtatgtgataggcatcttaacaatggctgcttttgttcctcatatttcaatctgcgaccagtgttccagggtcctgcctggaatcctgaaccccaccccccactgtccctgcccctggaggcagcgtatccctctgagtctcctgcctgagccaaggggcacatcgagcctcctgccagggtggctgcttagattctcgagaaaccctgatgaagttgaagtccttgagtaaaagaaagtacccccatttattcccatgaattccatgaacatccgttgatcggatgtggaaagatgcccaggaaggccccaggggagtgtgtgcgtgtgcgagggtggcctctggggttgggaggtaagtcagccccacaccctcccggggtgaacaggtaagctggccccacgccctcccggggtgagcaggtaagcgggccccatgccctccctgcaggactcctcttagctgggccacccccagatgaaccagaacgaaaagttgcaatcagggctgtattcctcacctgcgggattctcttggtccttccctagacttcagggagcaccccagaaagcctgatggcaggaagctggcatgcacgtgggctctgagggtccctgccgcgacgcttgcttcctgcgtgcagacttgctctccgtgaagcccgtgctcggctgctctttcaggggtttggcttcctgggatgccagagacaaaagagggatcaggttgtctaggaaggcacctggcatttctcttcctgctgctttggggtaggcagcgttagaggtcagagcatatgggatgggaaagaacggaagaggaattaggttcattgccaaaggattcctgggctggggtgaggcctccrcccgctggcgggaggggcagctctgccagcaggagctctttctgggcagtagccaaggactgcacgaatgttcataattgggcaagatgggaatgaatgaggtaatcatttaatgtttgttaaacaagttctgttttaaagacttgcaaattaaattgatttgagggagaagcacgatctgtaaaaagctacggagttaaaagtggaatgaaaatgagacaggtatagaaccgaaatgcgagtgcagaagcccgttttggtgcagtggcagagattcccgtggtgcacctttgaagccgaaatttgacagaaaccaagcgagcatgccgctgaggacggaggggctgcgggattgctcggccgcaggtcagggtctcatggaagctgggtggatgctatgtggcctgtgttttcaaaattatcctagagcattgaaacatcatggacttgtaacttctttttacaattaaaaagaaatgtttatacttaaaaaaaaaactttcttttcttaaatgttgtgaaatgcaagtcagatttactaatcagcaagacaagaaggcaggacgaggtgccctttgaccgtatccctggaacgggggtgcagcctatggaggctgtagtggtgattgtcagagaagaaacccttaactgcagagttcacttgccttccagtaacgrggaaacgtcagcccaaccctatttcatagggctaagaaaataacatgagaaaagagaaaagaaaaaactgaataaattcctcaggacatcactttttaaatatacttcaaaaaatgaagttctcaaatgccctttctccacaaaaataaaatgtcaaaggtggtcgctctgttgtataactttgctgctatttctttgactggtggagaaatcctgttggtggatttttgtttaaagagttgtttattgttttctttggcataagagccttcaagccctatgaaaaagattcaggttaggaaactgtctctgaaggctgggcgcagtggctcacgcctgtaatcccaacactttgggaggcccaggcgggtggatcacttgaggccaggagttgagaccagcctggccaacatggtgaaaccccgtgtcgactaaaaatacaaaaaattagctgggcatggtggtgagtacctgtaatcccagctacttgggagcctgaggcaggagaatcatttgaaaccaggaggcagaggttgcagtgagccasstcacgccactgtactccagcctgggcgacacagtgagactccatctcattaaaaaaaaagaaaaaaaaagctgtctgtgaaaagtcctctctcctccctaagccctgtggctgttcacattccagctcctcatttctctgttccacgtgccactgtaactcaatagtaatggaatggatggggcagggctgggggtggggaatcctggcagctgagcttaaaaaaaaaaaaagctcagtttcttttttaggaarctggtgccgacatccctgtgcagctgctcaaacgcccccgtgtgcacacatgacttagattggggggatccaggtcacctgtgaccctgagggggtccatcaaaacctcaggggactcgctgctcccctctccacacacctccctcccacccctctaggcctcacccctacatctccctcatatacaccagctgtcctgctgccctctgcctcaggcgttctgccccaggcagtgcctactgcgccccacctgctgcaggtgagggttccctgacctcttgctctaaaacccagagtcacccaagcctcctgacctccttcccggcatcagttaacagtgtggccatcttacattcagaaccattcatcacattcatctttcttttctgcttgcctctctggccaactagaatgtctgtttcatgagagtgcagattgtgtctgtttcaacaattcactggggtatccctgtgcatagaacagaaacaaaccccaaatgggggctcagtgagcatttattaagtgcgtcattggacaagtgaccacacctagaagaagaatgccagtgtagggagtatgcttagccacctgcgtggtgcacagaagggggcctgcacatagggactgtgtgtgtggtttttcctcctttctaaagtatgtatcctctagacccatatttaagtctttttccttctttctgaacattttaaaattgcagtttcagaagcgctcctgtaaaacaaatatctacgaatgaataactttctcttgtgtttgagtctcttagttgggaggcaaacgatgctctacaattccagattcataaactaattacatttctgctgagtaaggtactggttttccgtgttgtggggagtgtaggaagtatttagagctgtcattgtcactgtgccgttactttttggtcttctgttccagatgccataagttctgctaacccgagggtcatcgatgacgccagggcgaggaagctctccaacgacctgaaacggtgcacgtactacgagacgtgtgctacatacgggctgaatgtggagagggtcttccaggacggtaaatgcgcgtggctgggagtttaatttcagttcatgatagacgggaggcacttcaagaagtcagtcctgcctgcacttgtgcatgtgggtggtggaaatatgtcgttgatgggtgggcattagtatcgagagcagtccattccagaggcaattctcaggtatgtttcatataaacagtgctgtgttcagaagagacaacaaggcatggcttgagaacagcctggtgttgggtctgtgtgtctcctatggggcctttttgtgtacaggatagaacatttcttgagctgttactcatccatgtgctctgtaaaacttgtttgtgagcatttctttattgtaattgcccattcttaatccagtcccgtcctttaaagcagtttaaatatttgatattaggctttgagaagagaactgaaaggaggagagagagagtcaagtttggacctccccccaccaaaaaaataataaaatgacacgataccactcacagcagagggtgaggaccagccttttggaattgtttttaggttattttattcattattgatcacctaccttcaggaacagccacaaatcagacagaaaattctcctaggagagcatgaggttctgcaagagggtcacatacttgtggatgatcatagcgccagacgtcgtctatgagagaggagcctgtgcagatgcgtggggtgggcgggagaggtggcgtcaccctggggataggagggtctggggtaaataaggactgatacttctaaagccagtcttttcaagttggaagcttgggagaggcatggttctggcagagggtccccttgctggtgggagtggtggaagtcacttgtagggtcctctccccttctggtttaaatccatgggggcagagccacctgtccccctgctctggtgcccagggggttgtcgggggcagagcagggcagccacactcgggctctccagagagtgctggagccgcttcaaggtgatggaggactcgccgcgctctgaccttgaagacccacggtgaaagcagtggctgcaggactgttcccgggacttcctccaaatggggcaattttctattacatgtttaaattagtcttcagatgaaattgtagggattctgtacattcactgttcaactcagtttcaaagatgacatcagttctcaaacttcacattttctttcctggagcagtgaggttcctttctaagcctgccgtctcttcccgcgcatctctgcctctcagatacttacctgtttttcagcacgttggtcctagttactgcttcatggcttaggtttcttctcgccttatccagtgccaatgctgaagaagcgcagggtcccctgaggatcagcacaaagtcgctggggtcccacagccccttcttccctccactaacgtatatctcgggcacctcctgctgcctctgtcgggagaatgtcctgtggggagtaaacctcatttcaagccgtgctggtgaacatgagtgagatgttagtgagacttggaagaactgtgcagggaggcccttagagctcttctgagaggtgcaccctaatggagcaaggtcactgtcggccgctgcgctgccgaggcccctgtgaatgttgaagtaaagcgtcgtagatgaagggtccccaggcccgtgcatgaggccagctgcctgttttcataaatagacttttcttcttttttttggagacagagtctagctctttgcccaggctggagtgcartggcgtgatggcagctcactgcaacctctgcctcccaggttcaggcaaatcttgtgcctcagcctccccagtagctggaattacaggtacacgctgccacacctggctaattttttgcattttagtagagatgggattttcaccatgttgcccaagttggtctcaaactcctgagcccaggcaatctgcccaccttggcctcccaaagtgctaggattataggcatgagccaccgcgcctggctgtaaatagacttttcatgacrcagagccacgctttgtgtcgatgggctgcagcgggtttgggcccctctccagctgtgacagcagagatgagggtctttgcggcctgagaagcccagaatattcactctctggccccgtgcagagagcttgccggtccccgatgcaggatatcagggactcagttgtctggataagtttagtttccacagtgactcctttgcttttgtatttatcacggttaacatacatgagttttccataaattgatgagtgcttcttataaaaataatgttgtcaattaatgaatactgggggttgtcaggatgatgctgccttcctgccaaacagcctttgtacgttctggctgctctaacaagacccagtggcttatacaacagacttttacttgtcctacttacggaggatgggagtccagggccaggtgctggtgggtgtggtgtctgctgagggccatcctcctagtgggatatgtgtttgcatagtggagaacagaggacacaagccctcgccagtcccttcccataaaggcacttaacccatcacagggttccacccttgtgatcagtcacctggcagaggccccacctcttattcccctgggggtcaggatttcagtataagaatttgggttgagttccataccacacccagcacgttcaaggcagaggacaggcagccacccacctctgtgttggaagcatttcgttttcttcaggttgggggtggcaagaggagaataaggactgatatttctaaatattagtttaaaatattcagaaaaagcgtttccgttactgtgacagctcatgtcgcacctccccaggtgatgctgtgatgagtgtccgttttcatgggcacaggagatttccgttccagtttcgtattatagaaataatacactctcattatgtattcggattttggctgggcgcagtggctcaggcctgtaatcccaacactttgggaggctgaggagggcagatcacctgaggtccatagttcgagaccagcctggccaccatggcgaaatcccatctctactaaaattgcaaaaaattagccgggcatggtggcaggcacctgtaatcccagctactcaggaagccaaggcaggagaatcgcttgaacctgggaggcggaggttgcagtcagctgagattgcacaattgcgctccatcctgggtgacagagcgagactctgtctcaaaaaaaaaaaaaagtaggattttatggaatttgaaaagcaaatacctgtgaagctacaacttccgtgactattgcgatttttttgtccttaaaatattttcatatgaagataacatttttaaaataaaatcagttactttgtatattttatatcatagttatatggtatatggtttcttatttgtatatgtattttcatgtaaatcacaaacactctcattgttagtgagaaaagtagttgctgagtaggagctttattcagtacttagcaatccttaataacaaagtaaaaatcctcaaggaaagttaaacattgtaaggtttatataaagttgaagaaattgaggctcagagaaatgacatagcttgacccaaagggacacagcctggactggatcccccatcttgggacctgagagcctcgacttaaccacagcaccgggacattttgtcattaaaatggaagcaaatcaggtcctggggccttaagaacacaccagctttgcccacaggtctggggagggccttgcaggggatgcacccagccagcagggcccctgcctgctcgccgactcagtttattcacatttcttgataactctctggcttcttttttgccctagggcttactttgtttatttactttttatacctgtatatggtagaaagaaaacataaaggaaaagcgtgtaatttctacataatgtttggcttgtaaataaaaaaaaaaaaaaaatccagctgcttccattgccctgcggaggccatgttcctgattggctctgtaccgaggttcatttaaaaggccagggacctcattctttcttctccaacatttgacttcttagtgtcttgtaacaaaaggacattgtaaaaatgaatggagaaaccttgcattcactttttgttcgcttgtgtggtcctgtttactttgctttcatggagtttccagatggctactggcaagtggctgtaggtgttgggaagcagcctagcaggctggttcatccacccagtcactcgttcatctgagcaccagcttcccacacactgtgcgtctggtcaggggctagaggcagattgggaagcgcaggcagggtcccttcctccgtgaagttaaggtccactagggagggtaaacatcaaacggtcacccagaaacatgaccttgtgtcttgctcaggggtggaaaagaagtgtggcagcccaggctgctttctgggggtggagcgttckcgctcctgctcacaggcgagtttgtgtggcttgcggggctgggtgagctggttccacaagatggtttctgcttgacctgggcagctgagccggacgtgggctgtgggtacccaaccgtttggattctcagcagagccctggggaagggaggcactgggggctggggcgggctggatgtgcggacttggcagctgggggctgcaggtccgtctgcagggactgcacagggctctcgttcctagattgcttmacagccagcggctctgtgcctgtcagattctgcatggctctgtttgcctcttcctgcaactgggaaataacctatatacaagtttttctatttttaaagttaaaatggtgatttcagtgtttggcattaaatttttcaaaagtccctgttgatttgttctcctagggcctggatacatgaacatgaaggattacagaaaaataaagttcattccatgtagacattgttcctctggtcctacgatccctccccttccccttcccttttttcgaggcagggtctctgtcacccaggttggagtgcagtggcacgatctagactcactacagcctctacctcccgggttcaagcagttctcctgcctctgcctcctgagtagctgggattacaggtgtgcgccatcatgcccagctactttttggctatttagtagagactggtttttgccatgttggctaggctggtcttgaaatcctggcctcaagtgatcctctggcctcggccttccaaagtgctgggattgcaggcatgacacactgcacccagcttgcgattcttctttaaagagacatttttcccacttcatatgaagaagcagctttctgagtggcagcaagcagctcttctggacagacagagtgtgtgtctgacatgggactgtagtcaggtctccggaaggtcaggaagggtatagttttggtgatgggatttttcagcctacatgctgaaaggtcacctaaaatagttataacttagtgacaaaaataaatcctcccttcagaaggccaagtcatgttcaaggtggtagcaagctgtgtataggtagcracagggcccctttgagcattacacgtgcaccttgggaggaagagagtggagagcggrctctgcctgtatattcttggagatggtgcattcagcactgtcgttccctgcagttaggttttggagagtgtaaattttagcctgtcttcaaatgctttgagtttctcgtcttcctgagtagcgtgttcggagctttctctgctgcgggtggyggtgccacagaggaacacaggggcctgtgttgtggcatctgttcaatcggggagacaggatcagggtttttttgttggttttgacattcttgagccaatgcaccctaacttttattgggcatagtttatgattgttaaattatggtgtctttgtggtagctgtatggcatgtgggattttaaaggcccctgattcctaaagaaagaggggtttccctttcataggcaatcaggagtacaacctgatagtggtacaaagaattgttttcatttcttctccaagcagctcgatgccctttctctcttcactccccctctcctagaatgagctgataaagatgtacgtgagtggtccacagtgtggttttatgcatggattgtttatttgcatcccagcaygttttgtatacagcaggggtccccagtcaggctgcacaggaggtgagcagcttgcaagtgagcattactccccgagctccgcctcctgtcggatcagcagcagccttagattctcctaggagcacgagccctgttgtgaactgtgcatgcgtgagatctaggttacgcattccttaggagactctaatgcctgacgagctgaggtggaaccgtttcatcccaaaaccatccccatcccccacctgccccccaacccctgatcctcagaaaaattgtcttccatgaaaccagtccttggtgccaaaaaggttggggactgctgctatatagaatttaatattcttgcatgcattttctgaaccttctagtcacttgttaaatcccagttcagaacatcacattagatatatgatctgcactgtgctaggacgtgctccccaccaaaacgtcagcgtcttaagcttgtattcatatgaccataggaaaacctacatgcagaactttgatagtagttgttagaccaggtcaagatccatgtcaaagagataaattacaaattatcatctctctgcttaacggtctccagggccagtttggtgatctcacatagacttctgtcctagaacagatctgcattattgtggagggagagacagtaggttctaggtgtatgggaaagctgggcagtggcactggaagggcgctgtgtgccaggtgctagcgctcccgggccctgtgtgccaggtgctagtgctcccgggctctgtgtgccaggtgctagtgtggccacagccttgtggcttattagggcttcctctgttcacacgctgtgtacatcgtcctggtggatgggtgtttatctggtagagtagttcctggtctaggcagatccatgtcagtcctttgacctcattgcccctggctttttatgtttgtgctgcagttaacattctggaaagcacttttatagaagccattccatttgtcttttgtcccttcccagtaacggctcacctgggcctatctaacccatgccgagagcccgagctgggagaggttgcatgatttttaccaaggttgtgcgggaagtcagggagcctcggtgtgctcttgatgctttgcttccagagattgaaatcctggtgtgtgcaaagaaccccatctcacattaaatggctgcagctgcctggtcctaattacaggagtgtccagaaccaggggagctatgttaatgagtccgtttgtgcaacctaattgcacgcactagagcatctgtgaatgtaagcagtcttctgggcctcttctcctgggtcctgcatcatcttggaccattttgttttgctcacaccacagtccttgtgctgttaaaggatgtatcagttaagcctattccattctttcctgaaatcagcttaattttcattgtcggggtggcctgttttatgatttgtttttgttgctatttttttctcctttattacagattagattggaactagtgtgtgtgtgcatgcgtgcrkgtgtgtgtgtatatgtgtgttagcgagggaatacttcaaaaaataagattttttacacttgaaagcaagccatgtatatgtgtacattaggcacttgatatatgttgaaaaggtggattaatgggtcattaattgtccattttttaatcacttgtagtaatgactaataattatgcaacaatttaacggcttatgatgtaggatagtggatcttattaggcccagtttacagctgggactacattgttggaaatgctgccttcccagaggtacatggtgcagctggtgtcaggcgaggccatcatttcccgtttctacctgtggtcttggctgtgcacctgtactcatcactgtccccgtctctacaccctcaccccctccacacattgaaagtcttatttctaagacttcctgggacagatgggtggtagatgtgtattgggacagtatgaaagaggttcagctgcttaaattacacttcattaagggggttcatatttgaacattttctgagaacaaagatgacatgaagaaagtgacctctgtaaggctctggcagcacttatgcggtaccaatacaaatgggggttgggggctgagcagaaaacattcttcaagagttaaatgatcaagtcacgtaaggcgtgttgtttttgttttgttttgagacaatgtctcactgtcacacaagctggagtgcagtgacacaatcttggttcactgcaacctctgccttctgggctcaagccgtcctcccgccccagcctcccaagttgctgggattacaggtgcgtgccagcacacccagctagtttttgtatttttagtagaaatggggttttgccatgttgcccagcctagtctcgaactcctgagctcaaagcgatccgaccgcctcagcctcccaaagtgctgggattacaggcatgagccatggcacccggtcatataagggggtttgatgctggtttgggagacattctggtgtcgttagccctagggttgttgatgtcattcttttttttttttttttttttttgagatggagtctcgctctgtcacccaggctggactgcagtggtgtgatctcagctcactgcaagctccacctcctgggttcacaccattctcctgcttcagcctcccmagtagctgggactacaggcgcctgccaccacgcccggctaatttttttgtatttttagtagagacgggstttcaccgtgttagccaggatggtcttgatctcctgacctcgtgatccgcccgccttggcctcccaaagtgctgggattacaggcgtgagccaccgcgcccggccctggcagcttcacatgtagggccatccagtgcatgtgagaatctgcagatggtctccagaagagccacatctgacctgcctagtagcttatctcccagcgaatgggagaggtgcagacctgctgttgactgtaaggagacttgattcagcctgttggtgggggcgcacatgtgaggaagaagccttggtgggtttgtgtgggtctttctcttatgccatatccctggtttatatttggatgggaaaatacataaatgtttgatggtgatcatttttatgaaacatgacattgtcaactcctttcttcatatgcattttcgaattcagttcttaaccaaagaagctctttctacaacagggttaaattataaactgaaatagcaaattaataccaaaactaaaataaagctttttgtatagtaaaccatacattcagaggtttaaaaaaatccaacaaaatgaaaaatacttttgagttactatttttagaaaaaaattagtttgggttgaaaaattcttaccctcrtgaagctataaaagcacatgttttactgatgagagaagcttctggcacatcaactgagacaaaaatcttccatattcactcrgtaaatacaaatacagaagatgggctgggcgcagaggttcacagctgtaatctaagcactttgggaggctgaggcaggcgaattacctgaggtcaagagtttgagaccagcctggccaacatgccgaaacccccctctctaaaaatacaaaaattagccaggcatggtggcgtgtgcctgtagtcccggctactcgggaggctgaggagggagaatctcttgaacccgggaggcggaggttgcagtgagctgagatcacgccactgcactccagcctgggcgacagagcgagactccgtctcaaaaaacaaaaccaaaaacaaaataaatacraatgtgtaagatagaattcgttatgaagctacaccagacattttcaggastaatttgagaatgtgcttgaggtgattatccttaaatcatccaagtgtttttgaatattatttcaattatttcatcttagaartatgaaatcagcttgtttcttgtttrgagttgccctttctttttattattatttcttaattgagacaggatctcgatctgtcacacaggctggagtacagtgatgccatcatagctcactgcagtttcagactcttgggctcaagccatcctcctacctcagtctcctgagtagctagcgctactggtgcatgccaccatgcccaggtcatttttcaaaatttttgtagagatgagggtctcgatgtattgccaaatccagtctccagctcctggtctcaagtgatcctcctgtctcagccttccaaagtgtgatgggattataggcgttagccaccactcccagcagcccracttttaaaggattctctctcagtctatcgcttgatttgcttaacaccagccatttaatatgaaaatgtttaggtgggggagggaatatcttaattatcattgtgctccatacgctacagatggcacctgctggccttagcaatatggggtcaagtatgaaacatgatagagtgacacccaaggaacctataaggaaaggaattttgattctttcagaaataacaggaagaaattatcttaaaatcttaaggttgatgytgcaaacaaccagagacaataaataaattgttatttagtgatgttgcagaatattgtgttaatagagcctgtgatctcttctggcaatttcttaccctaagtctgggatttttcctgctgtgcttctcttactagaaacgttaagtgtgcacagatgctcatacgtgtgcagagaaatgcctgaattaactctcacactgccaacattagatcattaaacacactattagtaartgttctctattttgattttcatgttaagactcatctcttttgctcatagaattaattttatcaatgacatagaaaatggttattttaatacttctctgcactgcggtatcatagctgtgttttgccccaggacttctctctaatgacttgagccagcttgaattagcgtgatgtatcattaatgcatacaaatggcttttatttttgttcataatctgttcataatgccacggcattctgctctttctaatgtttttaaaatgattaagtagtgatgtactttttgacctagttaaccctccatggaatcgatgatcaaaagaataagagaatattacttaactaggatagtcagaagttgttayaatctgtagctgatgttttccagttattttgaagttttttataatttttttttccttagggaatatggacataggccgggcgcacagtggctcatgcctgtaatcccagcactttgggaggccgaggtgggtggatcacctgaggtcgggagttcaagaccagcctggccaacatggtgaaaccccatctctactaaaagcaaaaaattagccgggtgtaatggtgcatgcctgtaatcccacctactcgggaggctgaggcaggagaatcgattgaacccaggagccggaagttccagtgagccgagattgtgccgttgcattccagcctggggggataagaggaaaactccgtctcaaaaaaaaaaaaaaaaaaaattgcagagaatatggacatagccatgtggtccttttttctaagtaaacttcactcatcgaggagctacccacaaaccactgggttagcagcactgaatttgttcacttgatgaaagatgaggaatagtaatcctttttaagttgtgaagttctttaacctcagaaagggtggctttgtctcatggactttgatattttttgcatagtccttgtaggktgagcctggccagacactggctccaagaggatgtgaggaattcaggctccgagcagatcaggggcatccctaaaggttgggttctggaatcgggtgagtttgtgtattgaatgcagagcctcatcgaagcgttgtgacgaggagagcgatgcactgacggccttaggagtctccctgatataagcaaaagtcagctggraagagtggatttcaactttgttttcctaagagaaaaataggccagatgtggtggctcacacctgtaatcccagcactttgggaggytgaggcaggtggatcccytgaggtcaggagttcaagaccagaccggccaacatggcgaaaccctgtctctactgaaaatacaaaaaagaacttagctgagcatagtggtgggcacctgtaatcccagctgctcaggaggctaaggcaggagaattgcttggacccaggaggcagaggttgtggtgagctgagatcgtggcactgcactccagcctgggagacagagtgagactccatctcaaaaaaacaggaaagaaagatagattgtaaaaccttcagtgagtacgttggatgttgtgaaatttgccaaagagaagaaagatgatttttaaaggatataaaatatggaaataaaaaccactsacaacactgccacccgggggcaatgattgttaaggctcgggtgtgtgtgtgtgtgtrtgtgtgcgcgcgcgcgcacacgtgcacctgccgtgtttgaaaaaaatggactgtcatgcattgtgagactttatagcatactctttcacatacacrtggagcatccctaatctgaaaatccaaatcttaaactggaaatgctccaaaatccgaaatgttttgagtgcagacatggcacacaagtgctcacgcagaatttcggattccaggttttcagtttagggatgctcagcctgcaaatattccacaaaaaaaaaaaaattaaaacaccctggtttccaagcattttggacaagagatccgcgaccgtgaaacttttcccaccctgtggttattgatttttgcacggcatttccttgagcaaacagaacagcttttggacccagtctccaattagacatttggttggrtttttatccctctgtatttgatttagatgagtgcttccgtgcatggttttctttactgaaagctgtgtctctgtccttcctaatttcccgaggatccatctctggaagtgagactgtgtgtccacatcctkcagaatgttaaggctttgaatcctyggtgttgactggccttccaggagacctgtcctaattcagcgttctccagcagctgccctttttctgcacctggccacactgggtatattcattttgaaaacctctatcagtttatacacagaagtattatttcatgtaagtcacccccaaatatgaaaataagtccacgtcctgtaatctgttttgttatctgatttcccacctgtcctaggtaggaaaggtgtactcctgaggatgacacgtgggacccaggcagtccttgctgctcttacagatgcgcgcttttggggtcatcaggcggttgcaaaggtgggagcagccgtgctccccagaatgctgacagcacagagcactggtctgaagatctgtgtgyrgctgtgatccgtgcgtggctgtgacccgtgcgtggctttggcccgtgcgtggctccggcccgtgtgtggcggttgcccrtgtgtggctgtgacaygtggaggcgaacttccacggcagaagtgccatgcttccgtaagctcttccgactggttggtaggcgcttttatcggcacatragcaccttacagacaaatatctgaagtacacttcaaaggaggcaaagaaaaagcaaaactgccagttccttgagcatggctgtgtgtcgttggtgctctgaagggcttgagaatctctctctacccttcattttcatgcacagaaacygaktttcagggaagagctgtggcccaccacggtcgcttcagcccctccccgttgcccatgtttattccttttctgcctttcctcattgtccatctggactggggatcttggtcacgtagatccatgtttyccaggcacctaaagcacatcccccccactttggtgatcgtaaaaatctgttattccatgtttgaaatatcaggatttcagaactcagtsactgacaggtcactgccacaacagctaaagaattaaaacccaaacatgtctccttatctctgctgcgtcctgagtcggctcggctgcctgcatgttcccacccctgatgggggcacctgggagcgcccgtgggrtgggggcayctgggagcgcccgtggggtgggggcatctgggagcgcccgtggggtgggggcatctgggagcgcccgtggggtgggggcatctgggagcgcccgtggggttgggggcatctgggagcgtccgtggggttgggggcatctgggagcatccgtggggtgggggtatctgggagcgtccgtggggttgggggcatctgggagcgtccgtggggtgggggtatctgggagcgtccgtggggttgggggcatctgggagcgtccgtggggttgggggcatctgggagcatccgtggggtgggggtatctgggagcgtccgtggggttgggggtatctgggagcgtccgtggggtgggcgtatctgggagcgtccgtggggtgggggtatctgggagcgtccgtggggttgggggtatctgggagcgtccgtggggtgggcgtatctgggagcgtccgtggggtgggggtatctgggagcgtccgtggggttgggggtatctgggagcgtccgtggggtgggcgtatctgggagcgtccgtggggttgggggtatctgggagcgtccgtggggtgggggcatctgggagcgtccgtgggggtgggggtatctgggagcgtctgtggggtgggcgtatctgggagtgtctgtgggatgggggcacctgcgagcgcccgtggcagctgctttgctttccccatgggtggtagtctcacgctgcccccacaggcccggcccctccagtgggaacatgtgcctgcactttttagtcgaacatgtaaattaatcagcagcagtccagcctaaaaagagaagctgaacactgttcgtttgggggctcatcggctcactgccgcgtggtcagtcctggtgccgtgagcacagccaaccggactgtaccacatgttcccttctccctgggctgagcaatcgcttccccgctaaatgttcggcagcactttgccttgtacgtgtctacgtctgcaggaggggctgtgactcatccccagccaactgtattccaagcacagccatagttcagagtgaatctttatggtctgtgaattctggagtttcagaaaactcyctcattcaacgttgtgagtaaaccgtaagaaaaaatattgaacaccaacatagtcatctgggtactgggaaatactcccatgcccgcaccaagatttcattattcaatgaaaagtccaaggtagtgcttacatttctggcctgacctctagatgtgtagaatttcagagctggaaggacagagaccccacctagctcgacccttcccttcacaggtggacaggaccggtcttgtcagatagagtgtttagtagcaaggcaggtgctagaaattaggtctgtatcttttggctgcacagttcgattcttgttttatgaatgtcgtacttagaagccattggctacattaaaaaacttggtagtgagctaaaataaaatgctcctttaagttataattgtttttagtaaaatttaagccattttaacacagggtgcttggattaaatgcagtacgataacacatcgattatttttataagctaactaataaaaattcacagagcgttttctgcatgcaacagaatatgtgggtaayaggacattgggtctgtgacaaggtctgagctagaaggaccgtatggcccatgaagcacagtgtatgcaagtgctgttgtaatttagtaaaccrccactagggggcattgaaagcgcgtctaaggattattctcctgcgcaaatkttttccttttgctgtcaccatggagaatacagatataataaaacacactggtttaagagaccatttagacctgtaataagatacactccgtaaagcgtgtgaagttactggatcagcagcacacaaatgcagaagtaaaaaagtttcattcattggaatgaggaggagaacacaattaaaaagatgaaatgttatattctgtggttaaagaattctacattctgtggttatatattctgtgattttgccctgcatgtaactttacagaagaatcaaagaaaagttggccaaagatacaaagtttttcttttgtatttttttgagaaggagtctggctctgtcgcccargctagagtgcagtggtaagatctcggctcactgctacctccacttcctgggttcaagcaattttcatgcctcagcctcccgagtagctgggattatatgtgcgtgccaccacaccggctaattttttttttttttttttttttgtgagatgtagttttgctcttttgcccaggctggagttcagtggtatgatcttggctcactgcaacctctgccttccagattcaagcaattctcctgattcagcctcccaagtatctaggattacagcccgccaccacgcctggctaatttttgtatttttagtagaaatgggatttcgacatcttggccaggctggtctcaaactcctgacctcaggtgatctgcccaccttggcctcccaaagtgctgggattgcaggtgtgagtcactgcaccctggcctgatacttctttatagagtataataaatggacttattatttagcccatcattctctcttaacagaatgcaccaagagtttctctggcttgagtgattggccaggcacctcacgttagcgtctgcagccttgaatcgggaggcaggttgggcgcaggcttctcgtgygcaccagcgagcacccgggccaagcgtggaggctctgcgggctgggggtccggcccacaccatcagcctctgygcagccgttgcttyttccgttgaccaaagccatgaccttacctttatgcagtcgtgttcagagagagatgaagcctcaaaggcaaartcagactgacactcctgggagcatgacgggagttgatcattttttggaaatgtagatattccgtttacaaatctaagcaccgttaccaagagtggtaagtttctgcaggcagtaggacctttccagaggattagcagstgctgtgttccctgtgggsttggcagtgggctgggggcacagcacggatgggattgtaatgtataccatttatcttggtatagaatcttscagtttcttgtctttttttttttttttttttttttttgagacacagtctcgctctgtcgcccgggctggagtacagtggcgtgatttggactcactgcaacctccgcctccgaggttcaagcaattctcctgcctcagcctcccaagtagctgggactacaggcacccacgccatcatgcccggctaatttctgtatttttagtagagacagggttacaccatgttggccaggctggtttcgaactyctggcctcagccattccactcgcctctgcctcccaccgtkctagaattacaggtgtgagccaacatccctggccagagtcttctagtttttgaaggtttttttcttttccctcttagtttttcttaccctaagatagagggcttctccctaccagtttttcgtttgtttattgttttcaccctttattttctctcactacacaaggttcattagaatttgagaaattgtagcatctcatattagaacactttcaatttctatatttgtaaaatgggactaattgtattttcagtacctcaaatgagaaatagatccaatcacaaactcagtattcttcaaacattttctctatcagaatatgtacaaattgaatgtctagaatttataaagattttggagaattttactactttcagtatatagagtagtgaaaatttggcagaaagtcatgagaaaagaagttaagtaaaagtgggtatttcatcagagcggagagccacattccccttaggagggtagctttctcaaagtagtcttttagtgccaaaggacaatgttttaccatcctctaagatgtagggcattctgtggggagccaatgggtagagctggggcccaaggttcaggtgttgcagtcgaatcagtaaactccggcggcatccagggatgtgcacggtgccggggcacattsacagaacctacctgcaggtgggcacggctttgtagagagggtaggcacagccgccgtgggatgaagcctgctcccagcactgttagcggttgacagtgttgtcggggatctgggcagccatgtgggccaggccccrgtttggccagcgctgcagcttcctctctctgattcatcgagttcccagatctgtttcttacagaagaagaaacacctgctgccgaaatacagtttgaaaaaccctgatctcagaaataggattcctgatgacagaccttagcaaatattccaataattataccaactgtactaaagatcccagtactcgagtaattcaccataaatgagtgaaaattattcaactggattagaaattgccagccttggatccttttctcagatattttgttttcctgggtattttccctcttctgggttcttagtgcccgtcccccgtagctcygtcacacagtcctgttgctgctrccttggggcccaggcgtgtcttttgtcccccagtgcctggcacggtgccctccaggagtactcctgggattggtggcaggtcatgcagtcattgctcaccagagccaggacatgcctgggctgctgagtggggcgtgcccaactctttctgctttgagttttctttttcctccagtggcaaggtttgcgtggtcttcactcttttgcagaaaattgttggcattgcatcattggcttatgctactaaataatgttttaaggaattggagttttgcgaggagatggtgacaagcctcactcaggtctttggtttctgtcctccttcctgggcaggccctttgcccaaatggttgttaaagaaatgcaaacagttagttgttccgttcatgctgttgcgtgagataagttaggatgctcttgaagaagtttagtgacattcagaggaaatccttccaacacaatatacaattaattgctgtaaaatatcgtggtcaaaatctcggggaggcagtgaaaaaaaaacgaaagcagtgactaaagggcatctccaggtgccgcctctcacctggtcctggatcatgggggaggcacaggcgacgctccgaggcagcctggcttgtgttagctgagttctgctttggcacaggggagggaggacatggccctcrgctgccaaggagcatccagtcctttccaaggactttggttttccagagttacacttcacatgtatttctattaagatacacacttatgtatgtttcatatattagcaagtgtatctcatatcttctgaatacacacatttaaacatgtttttgtgattaaaataacttgtttgtaaaaatacaggaaactgtaagacagcaagtaaaaatcacctataatcccacctcctagtaataacacatatatayacacacacatttttttctttctttgtttcttttttttttttgagacggagtctcactgtatcgcccaggctggaatgcagtggtgggatctccgcccactgtaagctccgctccccgggttcatgccatgccattctcctgcctcagcctccccagtagctgggactacagacgcacgccaccccacgcctggctaattttttttgtatttttagtagagacgggtttcacagtgtttgccaggatggtctcgatctcctgacctcatgatctgcccacctcggcctcccaaagtgctgggattacaggcgtgagccaccacgcctggcctctttctttttgagacagagtctcactctgtcacccaggccggagtgcagtggtgccatctcggctcactgcaactgccgcctcctaggttcaagtgattctcaagtgggggctccggagggttcctgcattgcccatgatggatattcacgcaatcataaaatctcctaaagtagaagatttaaatagaagcttaaactgaaggacaaggcttagaacactcagaatcatttcagacttttatttaaactgcttagaaaagctggtggattttgagaaaaaaattgcctttcatggattatcacagtcagtgctaggataattaagctcaaagtggcagattccaatgcttcaggaatgtctgayccctgtaccgagatggtgtggtragcaggaagatggggtcccaaaagatactcaagttctaatccctggaattgacgaatattatattttgtgtccaaaatataaagggtctttgcagatgtggttaagaatcttgaatacmttctgattgggccctgaaagcaattgcatgtatccttataatagggagggagaagggtccacgtggagcagaggagtttgaagatgctgcctggatgttgggactaacatggcccaggagtgckgccgccgcaggtgctgggaggcccacagataactgctcacctgtagtctctgggtccggcatggcccccagcaccttgtcagccaagtgatggcgattttggactttggcgtccagaactttgagaaaattaagtttctgttgggccactgggttcatgggaacttgttagagcagctgcaggaagctaaggcagatggtcagaggcaggccgcctccagagggcttctgctggggagcacggtctccaggctgcgccataggtgcagaaggttcaggtgcacctgaggagccttggggccactctggggctcccaccacacgtgggcacagctgggagcagggcacccccaggaacccacggacctgccacasgatgcagccagggtgacctaaggcatgtgggcgtgcaaagaygacgggcgtggcttttcaactggagacatgccggtctctgccctgtggaactggtggccgtgtgttcacgtgacttgagagctccatctgccctgtctggtcttccccgaagagtgatccccrcctggagaggcttagagcccaggaagctgaagcgaggagaggctgtgtgactccggccgttgtggtgggtgctcatctgcgtcagttacatcttgtgcagtcaggggctccctccttccttcttccaactcactccttacctccccctcttcccagcactcctgtctctccccagtgttagaaatgagttctgaatttctcttcaaagaatcagtatgtcgttttaaccttacaatatttcatattttaatcattcatcctttttacttgtttcgaggcctgtgacaaaaaattcagatggaattacataactgttctgtttagaaaatagaagtaaatgcaatgttccggagctgacatgtttcttgtttctttttttttttcttttcttatcttttttttttttttgagttggagtctcactctgttgcccaggctggaacgcagtggtgcgatcttggcttactgcaacctccgcctccgagttcaagtgattctcttgcctcagcctcccaagtagctgagattacattaattaaccagccaccatgcctggctaattttttgtatttttagtagagacagggatgtcggccaggctggtctcgaatcctgacctcaggtgatccgcctgcgtcagcctcccaaagtgctgggattacgtgtgtgagccaccacacccaaccccagatatttcttataatccygctaatgacaagacaagcagagctgatgctttatgacagaccacactgagaaactctgatttctcttgacgaacttccctaaagacagctgttgacaaatagctcctcaccagcaggcgcatgtattccagccccatcagatctccatcttagctgttcctcagtcagctaccaagaagccagcacttgtaggttatggcttgtggatggataaactctgggctggaccacagagtcctcccattcatggtgcttcagcatctcacttagtcagttgacccagctgtgaaatggatctgccttttcttgattatcttcttctgggaatgcctytcatagctgaaatgtgtctgtagcttgggcctaagaaggtgggtgacactgaacacaaggcagagagttcattgtcacaggactgagcacagctgagcggctgtgaccagccttcacatrgaaccagccgcgagtagacaggcagaggccgccctcggagcctgggatgcaagcgggtctctctctgaccttcaggaggtcactgagtccttgtgggccctgcattctttatgtgcccagtaaagctgtcgggatggctctgtttgattttgttgggatatggagtgaaaagcaccaagctgtctgtagccactttttctcccctctgtgttttggaagcagatcaacttactattgttcctggtggagggggtccaggtttttggccttttgagcaaagaattgaacaaaatgcacaaacaaagcaaggaaagaatgaagcaacaaaagcagagatttattgaaaacaaaagtacactccacagggtgggagcagccggagcataggggctcaagaacccagtaacagaattttctggggtttaaatatcctctagaggtttcccattgkccatttggtgtacaccccatgcaaatgaagtcatggcccccagtcagtctgatttgttgcagaaagcaaccaatccaaggtggaagtgaggttacaaaggttacacttctatgcaaatgaagatttggcctacggtcagtctgattggttgtggaaagcaaccaatcaaaggctgaagcaaagttacaaagttacactcctatgcaaatgtctgattgattggttgcagaaagcaaccaggtggaggcactttcagttttccatctgccttgcagaaaaggcagggagggggttgcaaagggagcagcctcaggtccttttgttacttaggtgtggaaagttggggttttcgttcgatttagttctaggaagtcagcgtgaatcggccttaggttccctgcccccatactctgttctactacctcactatagattctgatccttttaaataatagcgccagttcattcattagaaacagtggttggacctgggaatggactggtgagtcatgtcctctcctatggaagtttcctgagatgggggctggttttcttcggagaatcacagtttatcttctaattarttgagtgccctttgttttcctttactgtccttgcaccaaaaaaagaaaaaaatctcgaaaatattgccaacatttattgaagagacttttttcttcttttcttgcttgagatattttacgtttgaagacaatcaactcttcatctcacctgctggtccattcagccaactttttttccccctctaagatttttaacaaaaataaaacaggaccaagagatagcaattactactactattatgactacgatgaacaaaagttaaatttcttaatctcagattgttttactgccttgcaattaaatatccagatctaggagaaaactatttgtagaagtcttgaaaattcaactcataaataaatgcccttattcttgatattatagacatttcttctgtaaagtatggcacayctataaactaaaaatgcacatctggaaaatccgtaaggcagaaattccagcctccccyatccacagccatcagaggagtccctcacacacctgtcgccagcccagggctgggaagatagaggtgctgctgcagagggagttccatgactcacccctgcttccagtttttaaaaagggctgagtctgtcgggttgagtacttcccttccatcacggcaggcagtcacttttcccaagtcagcgtggacttgggcaagaccagtaggctaatgggaaaataagattccaaacctttaagtgtagtagcctaaaaattgctgataggaaagcgatcaaggactgaaaactgtcgcatttaaaatggaaatgaagccagggctctgaagtagagctgggcctaaatgcagtgattaaaatagtcgttaggctgctcgcaattaccctagatgcagcaggctgcctgcatctttatggcggtactttgattccaatcagagatttcacatgaacttattttggtcttttcaatgamgtctcagagtagaaaacagatgcagtcctaaagtaattactaacctttttatcttgtgaaagagaattcagatgagcgagatctctgcggtgggttgatctgagtgattggcgcctgcattcactcgcccattcattcacctcctgtgcttgtcaccaggctacaaaaacgaagccaccacccctctctggtgccaraatgtcagtttggggaaagctggagctcccttctgagagccaaatttatttttttttatggaagagattcccctgtaaattctgggaaagtttgagagaaagctccaggagtagtgacraagcaaaaggactgggtgaacagaaggggcatcggagattgtcctgtctgcctgcagccagctggggaacagagaaggtgagtggggacagagcccacaggtcctgcaggtgtccaggaaccaaccagtgatgagcagtaaccaatttgggattcctgtcccagactgtagcacactctttggcacaggattttgtcatggggtgtgtcaccctcaacgaaaggaggtttgcatcggtatagcctgtgtttggtgccctgatgactgaaagaattcctgtgagatcattttgtgccagccaaaagtgagttgtattagcggaagcataaaaagctgtcctcttaaatcataggtgtaatgacgtcctttccaggacgagttaccatagaaagctttttaaacaacatttattttcctaccttctgaacctatttcttaaagacaaaaaagaaaaataaatgtactttgctctgttattgtcagcctagatttctctgtctgccaggagataaagccttaataattcacggccactgagaagtgtcatagtccttcctcccaccccgccccgagttaagtgttaaccccagtacatacctggtcacgctctaatttagtaatgatgatactttgctgttataaattttctctggggacttgcggggatggaagagcctttactttgtcttaaattctatgtacgtgtaattaatcaaaacattgattaatacccctggaagtatttcaaagatagaaaaacattggaaacacattttaggaatttctgayataagttttcaaggaggttgtgcagaattggtaaagagaattgagtatgaagayggcctgttgattccttttaagcgtttaagtttttccgtgcctgggattgccttatgtgcaaccgccagcttctgtcstttgaaggttttcctaagatattttcctagtttaataggaagtgtggacatgggacattgtacggcttaggagactgcgttgtgtttggttttkaatatatattagatgcgtgaccctccctcttaagaactgattttgctttgagaagatctacaagggccaaaagtggacctgtttcaaaattctggtcacagtgtctaggatgtggtgaattctccatcagtgtggcttaatgaatgagagtgacaagggaggagggtggggctccaaggcctcgcaggggtggtcaggactggtgttgcctcctccctcagcctctctccccctacctactgcccattcggaagtccaggcctcctcctcagtcactgagactgctttgtcagcctccyscttctgtatccaggcagatgaccccacactgaatctttgctgtgctggcctctgctcttgcctgtgacagagctcagataggattctttcctgttcgaaagcctttgatgcctccctagcacctaccatagtggtttccaaacttgtttttggctgtgaacccctcttgtcgagggtctcctaagttgaaggccagtgtgtaaggcagtgggcagtgcagggcgccagtatttccgccctctgaatgtggcaccacctgtcccagtgggcgtcactcgctcatgagcagctattcccagagagcctcctgtgttgcaggtgctatgccctgcagggagcggagggccctcccccttccccttgcacaccttgtactccaggcactgcaagctcgcaccctttccttagcctcaaagccttgctctgagcgaaaacctgcccgtccctcaggcatcggcaccaactcggagccccttttccaaaatctcgaggctctcctagccctttcttggctgcaacctctctggcttttccgccaaactggaatcagcctcggagcaggaaaagctggggccgtgctcacctttgcttccctttgctgagtacatggtgagttcccagcacgttttatcatgtgagcgtctgctcttgagaggccaggctggatcctgcagagaaacgaggaagtattagacagaagtgatgctgggcgcggtggctcatgcctgtaattccagcactttgagaggccaaggcgggtggatcacgaggtcaggagatcgagaccatcctggctaacacagtgaaaccctgtctctactaaaaatacaaaaaattagccaggcgtgcgcctgtaatcccagctactcgggagtctgaggcaggagaatcacttgagcctgggaggcggaggttgcagtgagccgagattgcgccactgcacttcagcctgggtgacagagcgagactctgtctcaaaaaaaaagacaaaagtgatttcctgagctgctccgagctggagacagaaccagcagacatgggacagaagaagaattacaggtgtgaagcgcccgtgtggggctgattcccacctgcctcctcgttatcagcaggcagccttgcgtctgcctctgggagcagaaaccgttgtttcaccagcaaattacgctggctgtactcgccatgtcctgttgccatagaggacgagtcacagctgtctcacctgcacccctccaatcgccttctcagaatccgacgctggtcctaagtgccttcagctgtcacctgagcacgttcaagcctcctgcccagcaccttcctagagcaccgccattggcataaggactaggtaggcagatgtcctgataaaggtgcacgctcaagtgtttgagacgttaacgaatgatggctgtgatgtaattgactcagttgacacatacagagatagaacaaatatggcaaaggacttgtatttattggatattagtgggtttatggggtttatctgttgtatgttacattttctgtacctttgaaatgtttgtagtggttggaaggaggggacttccttggcccctcctggctctgccctgagcccgctgccctcaccctctgcctcagacctgggcgatctcatatctgtgtgtttcaccgaggcactcacatttctggccactgagaccctttctctgagcttgagacttaaatatcagctgtgtccttgacatcacacctgggccccagctgggtggcccctctgtccctggctcaggttagacccctgggccactctgactcccctcccttcctccctgtggctgcttgagcaccaggttgtattggttcatgtaccttgtacgacccttgccatcagagccctggccccagccaccatcgccccgcctgggtttccttctgcactttccactttgggtatccacccatttcccccagttctttgaccagtgcagccagcagggaattttatttcacgtctaatcagacagcatctctttagtgtctttctcagaccaccactgtgctgtgggtcctgagagccagaaggttcttcgaggttcttaagagtccctgtcctcatgcttcctgctccgtgctcttcctcctgccccaggcccctcactcactcgctccttatctgtgagcatagagctccagcttctggcttcccagggagtgtttcttccccctctcctccctagttcagttctgaggtcggaattcccggctaccatgtggctcccctgactggagacgcagtgccagggtcctcatctgggaaactggtgatgatagaggycctgccagtgcttggagcagggccccacacaaggtaggactcagcatggcctggagatgacggtggcctctgatggctgtgttcttggtctagactgtaaaccccatgggatcaggaacaaccacatctagaccctcatattagggatgccagcccgggcaccacatctttgtcacctgcatctctrtggcctctccagccccgtggcagtcctcactgcaggaggctggcaccctctctgtgcctcacatggatcaactgacttccctcaccaaccccaagaagcatatcctgtgtgtatgttttacagataaggaaactgagccacaaaagggccaggtaacttggtaaagatcatgcaggtcataaattgcctcactgagctgggaacccaggcagtcagcttcggcgctccccaccyctgttaggcaacctatgaacatttaccaagaacacagactcatctgcaaggaagcctcagtaacttgatgaggagcagctagaagactcgagggagaaaaatccttgtagacacatcagtggattcaggtgacttgtgttatttttaaaatacagcctcgccaagatacaattcacacagtctccaacctaacgatttagctctgcttttaagactgtgttgggtttgactttttttgaggggcctcggccactcttgggttgtttgtaatctaaaaataattggggatgaatattggttacatttcatcccgtaggaccttagtctgtctggtcaccacttacccctccaggctcttcgaatgccatatttggctatgtgagaatttgtcagagctcagctcagcactcagaacccgctggctctccgggttctgcccttcagctctgcgagtccagagcccaagctgctccttggaaaagcggaggccactagatggcagtaccgccctggctagaggtgcccttggggctgaggctcagacatccctgcccctggtttccttcaggtgagatcatcagtaacctacaggctttgcagactgaaggtgaaaaccagttaatgtgctacatccattttaatttgaaagatacaatgaattaaattaggcataaagtgaatgtgataggaaactggaagctcatggctgaagcctggaccgctgtcagaactgtgcagcctaaagccgggacccctggtagctgctttgtaaagggcagcagcagcaaaatcctcaccactcgtgcttggaatgtacgctgcaaagtttgtacttaacagcaaatggcataaatagcctctattccattaaagaattggactgcacaatctccttagagaaaatttgatgaagcggttcatgcaagacctggagtgatggtatcaccacgttagcctaaaagagtgtttgaaataggaggtgacattcctggggggggctgcccctcccacctccacccctacctcctgttttcaccatttcttgatacagtggtgcctaattttatttcaagaagaagatagtttgttgctttttttctttttttacagctttaaaaaataagttgaggaatttaggtttaagaaaattaatagctacaggtaactgcaaaagatatcattggcagatgcagcaaaatatatatatatgtatttccacagaaaattggattctgcccataaaacttagtaatactaataaagacaggtcattaccagttttaagccaartaagcaaactcaaagagatcttctgtcagtgtgattcktggtggttttttatttttttggagaagtgtaaatcagctttagtgcagcaagcacaccacagatttgctgaaatcattcctgccccttctgacggtgggtagagttgctcggccaagtaatttacagtgctgtggcaaggtatgtttatatttaagctgtgcaacggtgtagctaatgagaaagataagaaatttatagtccttggtgattgataggattactgcctaggcattaattgaaatctgagggatcacagctgtgggtttaagttgggggaaaaattacttcaagtaaaggaaaacttttagatttgcttctgaacattttgaagatagttctcccgctgacagtctggttggtggtagaaacagttgatcctggccgaggctggggtaattatactgagataatgatggtatctgctgtgtagcctcttcaaggtaggtggtttataagtgtgggaaaaaaaattaaatactrtggggtttttaaatggctttaaaattttacatgtataagaataaaattctctgcagccactctttgctaaatattstctggacaatkatttaagacattttaaaaaaagaaacccaaactaataatgacagaggcaaacctgtgatattagtcattgccttaaaatttccactgattatatttaatctgggtatgtctaaagtaatcttacagacctttccctacctgtcattttttaaatgtaccattcttgttgaagctcagtcttgtgaaaatgtctaaattttcccattaagtgcttaaaaagtaataaaactaaagtcattagacttcactcatcagagctatattgggagaaatattctttggtgcaataaatctgtccaggggttcgacattcatatcccttggattcattccctggaaatggacgtttgaaggtaaattgcttaagtagggcagtttaaatttttaatacaatcttattgtaactgttatcacatgattaaagtgcaaaggggccttagatgttttgtaagatttataataaatgctctatgatgccttttctgtgctgaattatggatgttatgacagttaaatgcttataaaggccagaaaggcacaaatgaagagttgggtctttattggagactaaatcacacttattgaatgcagacagtttttcactggacacgtgttcattcctagattcacagtctcggaggcacctagaagccttcgtaagccaaacagtatccagtgcctctcttttctaatgcagtgggctctggaagggtaaggcctgagccaatggaagctgttttgaaaaatacccaaatagcaaattattgttcccatcaccagttggcttttttggggggaggagggacttttttttttatgtaaataatctcatcagaggcctgattctctaatggatgccgctagtgtatacggagtttccgcattccttttgtagaatcaaggaagcttgaagctacgtcttcatgcatcatgggagctgtgatgccctttaactttctagacccagtgacacaatgtggttcctttcatgttcactgtttggccatagttgattggaattgttgttttaaggcctagtttaactggacagcaggactaactcttcatttcagaaggaaggcctgcagcccaggagatggagctgggcaggtgccctcctcacgagaggctacaggccagacgcagggcaccaagagcatggcatttgattcaaagccatggttgagtggattttcaatctatttgaaggataactttggctactatatagtatttacactcctgcccattttttttttttgtattttttccatcaaaagagaaatctgttttgaaaacagaggtaatgtctttaccatctttctcatgtatattattttttggaggaaggaaatagccagttttctatactttgacaatgtcaccatttgccatctaaaatttcacaagctgtaatttgccttttacttacatatctcatccacagatgtatttgagtgtccacagtgaaatggttgcattactttcagattacttcctttaattctttagatgggtgctaatggtttgggttattaactggcacagatctgagttctttttgtctatgcttgttgtttttttcccccttcaaaatgaatttgcaaaagcatcactagaaaagcttatgtgtaaacatttatgctagtaatagataaaaggtgctgtgtagcagtaccagtgggagaacgctgaagcccagaaggaaagtctaccttctttggaataactgaataggagtcccagtcacctattcccactttctctttaactatcacccttggatggtattgaggaaaccgtattgcatgcctaattttcacagcgttcagtattaaggtaaacctactgattgtgtttaagttgaagtataccttttccaagtagctgtgtaactggcagtgacagaataggtgttgtatgggaggcagcattttcagctgtaagtgcaataaattgtggtttgtttattttagtttttaaccttttagactactttgtgatcggcaggagattgtgtgtgtgtgtgtgtgtgtgtgtgtgtstaggttgcagagtgaggatctggtcagtgattgacacttgttttcaaagtgttcaccatgaattttttttcttaaataccatttttctcagtgagctttgaaccatgatgtcaccaaagacaaagtgtttctcaggcttttcttagtgaaagatactttccwaaggtagtttatagcaagatttggggattaaaaaaaagagttgaatttatggcctgaagagtcattataaccttttacctatagctaacatttacatacctcaggtcaaataaatttagatgtrtgcttaatgttctaaaagctctttgttccttgctcatccttggccggaccagagaagttattgataatcaggtgttgctttctttgtggtaggacatcaccatgttctcatagagtcctgttaggaagcagaggacggactgctgtgtgtcactgtggagagaaaaagaccttgtgacgtccctgtcatcacaggattctagtatcttgttatgccagagatgtggtttgaaaacttgtttttatggacgtacccrcaaaacattatgctctgtggaaagaggcacgcacagaaaagaatgattccatttatatgaagttctacaacgggcaaactgattggtgatgaaagaaatcggaagaatggttgccaggaagtgagaaggagggattggttggggttgggggtggcccagaggaactcctcagggggatattttcatcgtggcttgggttacacggcatctgtcaacattcatggaccggtacaactaagatgttttgcatttcacagtatgtacatttaatctcaaaaaaagaacctaatagttaatcacgtgcatgttgaaatgtgtgggagtgaactgatgcctgcaccgtagttgaattgcatcagaaaatgaaatggacggacggacggacggatggacggacggatggatgggtggatagatatataataaagcaagtatgtagcaacatgttacaattataaaatgtagccggagtggaaggaggtgttcgctttcaaattttttttgtatgcttaaaaaatgtgttaataaaatatagggggaaatcaaaaaaattgttactacattaaaaatgtcattgtaggtctcgtacattaagatgggtccagataaacctaatttaatgtgatgtgctttctcacaagtagaagtgtacagtataatgaggagccacaatttttacaaaaatgaatcctgccagaattaaaaggcatacatgattctttgaagaatttcactaatgcatagaaactgcggtaacagaaaagaatactttgacttcctcactattcctaaatcacagcagattacagattcaaaatcaatcagtattctctgctgaactctaattaacacttaacattattagtcacaaatgtgaaatcttgatcggagatggcctcaggtattctaaatgtaaataaaattaggtttagatcccttttaattacctgaggtgctgtgagcgattacaatggcaattgataaacttaatttcttattaaagcaaaaaaaaaaaaaaaaaaccatgaaaagtttctctctgctatatacttaactcttcagtagccatggcctatgcaaaaaaaatttacctggtttatatgttaatcatatagaatttagatcgttttaaaaatgtttatgtggaccctcaaattcatcatgcatctcctaagtttgtgggtaatgttactataacatcacaaagggcaaaacttccccagaggaacttcacgtatcagaaaaggtaggtttctgggaggtaatgctggttaagtaataataatggatgggtgctggggagagtattacaatgacttaatgcacaaagccctgttgaagaccaagtggaaatctgttttgtcatctcatccttcttcctaattgcatcacaatacattgtataattcaacctgtgtgtcactgtcacttcttcccgtgcacagggccaccgctgctggctcattattaacagagcagggaggagacgaataattctctcaggttccaaccaagacatcttctctcccccactttaagaagaaaatgtcttttttatgtagattgttgtaaggataattatttctggaaataggaaaacagcttcagttgtggtagatacatccatttttcttaaaagtgagaagctatccgaaggagagtgtgcctgtgagaaatggaaagattacagaagtttctaaactccttcttctgttggtgttcatatctaaaaataggaagcaaattagacctgataagttgttaagcctatattaatcaaactgtgttaattttttaaaaagaaaaccaattattgcacttaactggatctgtctcaaggttcctgatttcaaaatcgacttttggcctttacgtcttacattttcccttctttagaactcttgcgtctcctgttcctcatttatcttgatcttctcatctttttttctttataattttgtgtagtttcttacctggaataatttagcataatctatttttctttaaaattttgtatagtttctttagctggaataatttagcataatccatttttctttaaaattttgtgtagtttctttagctggaataatttggcataatcagtctggcacgctatcatgttgttggtggtacctttttctctttgtatgttttaaaatcctttgccagtcactttttctgtattctgtcttcatagtttatcgtattcctttgataccaccatgtttatctgcacttatcttaggtctttctttcattccactgacaaattgtgttagtttactttgtaaccccaaatttgggccttttaaaaaaaacgtggatggaagagggaagtcccgtagctttgcctggcgtggaagagtgttgaggagcctcacgtgcagattgaagaattgccgggtgagccttcaccttcaggggrtggcagaaacatttctgctccaggatcatcaactttctctgcgagacagcttgatgagttgagaagaagtgacaggttcatctttcccttctttgtttaagtcatttatctttgagatccttgcctgccatctaaattgtattgccaatttactgggatattcacttgcctcgtcttggaagacgctgatttgcatccagcttgagaataagtgagagagaaagttaatcatctcctggccttttgaacagatttgtactgtgtttaattgtagcatttgaaatgttacatattttctaatgagagtctatattcaactcttgtgttaacctgtatcatgaggagaatagcacagtgacctagtctagaaagctctgctcttcggaagatctttaatttatgctttttgcatatctttctccatttcagattaatctaagctatgttagctgcttttaaattctgcctacttgtttttgatgatgatttattcaattaagtggaataattaataatgaattatagttgggcatggagggaaatggtacactcagctctctaagagattctgaaatttttatcgagattgttgtaggggtaattatttttggaaataggaaaacagcttcagttgtaataagtccatttttctggaaaatgaaaagctatctgaaggagaatgtgcctgtgacaagatctcgtctagtttcttgtgccctgtgacgagaagagcacagctctcttactctgagcaggtgaggtcttgaagaagcacctcattaataaggtcctgaagaataagttcatttgtttatagggttcaggagacccctagagttccagtgagaaagcgtgagctccgtccattggtcctcctggccctgccactctcttccccgcttgttctggctcccgtattcttgacaccttttcccagcatatgctagttttgtttccatcaggcttccttgagggagctgtcgccccccaaatcagggtcttgacaccagctcctgccactctgacacatacttaggcagtgctcagagtcgagctggcctggggccgtggccccacaggcttgtgatcagtgggctccggttctcacttcttgtctttgagttctcaggcttctcccctctcctgttgtaagagttgagctagcagggkccgcctctacccttggctgctgcttccaaaccatgtgggtttcctatgtcatgaaagcttttcttcatcacgtgctaatgacttcctgttccacaggcgtaacactttctaatgtttcattcatctatctgagtttttcctgctttaagtgcctcttctatgtctgtgcaacattcattaatttctcagtatttcccccttgcagattattccttctttgtctgcatcatagacacacgcctctctttatagcactttctatatcccacatgctgccacttatctaacacattgggagagaaaggtgcagacaaggtgtgcaggaggtggatgtgatgttgtggttggttggttgacattttctagatgatgcagctggcagatttgtctggatttcacaatctcccacatctagcaaattgcctggcatatactagttgctcaataaaaacagtcagtaaatgggatgagtgagggatgctataaagcatagtaaagaaaccttccttgacacattaaagggaaaagcagccaactccacatattaaagaatgggcagcaacttgcttggtttctgtgaggacttgcttaattctgcattgaccaagagcaagctgaagagcattctgggatcaagaagatgaccaagtacattgtgggaccaagagcaagatcaagagcgttctagaccatgagcattctgggaccaagagccatgaccatgagcattccgggaccaagagcaagcaaggccaagagcattgtaagaccaagagcatgaccatgaacattctgggaccaagagtttgaccaagtattatacattctgggaccttcctaggccattggcatcaacgctgcagcctctgagtcatgcatgcctcatggggtcatcctgacttaacctgatgggtaggacttacttgagtagggcaggaggttttgaaaggacatgatcatacacagtacttagctcaagtgcacagagaagcagagtgccatactgggaccctacggtacagccagccggagacacagggttccagacacagcttaattccttcacgctggagtatgacttggatgtacaaactcctaatccctaaggataggaaaagacctagaagatttgaggattttaattcaggaaagtccaccaaaaggataaacmgctaggagcccactagtaagccaggatggtgtggtgcggatcttggatgaggttagctgagtttgaaaactggagaaggcatggatgagagcaatgctgagggaaggtgaggcagggtggggagaggagtgggagggtaggtgaggcggggtgaggagaggattgggaggcaaggtggggcgaggagaagagcgggagggtaggtgaggccgggcaaggagaggagtgggagggtccatcggtgtcgtcagtgcacatcccggtgcttggaactgactggtgggcgtcctgttggtgcatggggcagactgaagcctgagacatgacccccgagggttctccagacaggatcatttggagccccttctttcccaaatggtggggagaagtgctggcggaagcagaatggagccctcagaagcgcgcattcagaccggcagtagacaaaaccagctgcggggccacaccacgttagggtgcttttcggcatctctcagtggggtgaacgtttgcatgttggtgcttctgaacacaggatccctggtcctcctgaggcctggagcctggcagttggtcagctccctggcccctgctgccctctagcccagggtgactatgggaacagacattcctgatttttggcagctcgactttgggattaaatgttaaggaactattgtgctttgaaggagtgcatggaagaggaagggatgtgtgtttcctgcagcgtgatttgaagtcccctttaccacaaataactactttataccagaattggatacacatattaaaaatgtcaaatacaccatatttgtttcagcacagggtttttgtttttgtttttaattatgttctttccccttttctctgaaaggaaaagggaaatcccgctgccctagacatggtagaaatttcccctsattctaaaattctgaaattaaygtcagcagccttgactttgctctgtcctgaaggtaactgtttattacagtcggcatttaaatcccccgattaataggagcaattaaacaatagcttcatttccagcaaattaacaaccctaataggtaattgcgacataaatgaagataaatttgttttaatacaacgagataaaaagaatacagacaagaactgaatttcagattaagaattcagacttcagtacttcaggaaaaacttaaaagcttcactagaagaaattwaagcaagcttggctttttaaccacagcctattttagattagagggttgtttgctcaaaaaaaaaatacatatatatagtcatattttgtgcttcgatactcagaaggtaaggcatcaaaggattactttgatatacgcaaggtaagtcaacaaaggattaccacccaccgaaccctttctcctgctggcttgcttggggcatggcatgtcctaatgacttactcgagcagttgaatcttggccacagcttctcattaggctttcagtgacaaggaaccaaaaagcaaatgcatagaagagcatttcctatttacacacccctaagttaaatttatgacctgtttagttgcaggatgtcttaccttccttgttagtatttgttctgattggaaaattactctgatggtttagaatttgtcctgttgaaatgtggaagtagctggaccagacttgttcataaatgcagcatccatgtgaaggatgggtgggaatcggtagatttggggtgaatagctaagtgctgattttaaaggtagtggcaaaaaaaatgatgaaagcctcttctagaacaaggataatgaatttctccttgtggggtcgccgtgcttatgggaagatggaacgtacattaaagaaattttcggagtttagctaaaactgtatcactgagcttgtatcaccttatcagaactcattttggtagcttagaatcatcagatgacacataattagcctagaattctgtgtgctgccaaaatactaatccagtaaaagggtagagggacagttttagatatgggagtctcaaaacaaaatatatgtgtgcttctcgggaaaccgctggaaccaggctgctgagttcagcccctgaggctctttcccagcccctccgctccccacacccctgcacactccctttcttgagtgtccaggtagaaatgacctgtatcttctaaccaccccaggtatctttccaaagcatagatctcttcacttctctattcaatttgaataaccccccattgccttaaggayaacttcacacttgccactcttctctgcatatcaggtccttagaaatgcatttctagttgcctgtttcagcatcttctcccactaccttcttataaccttcccaccccagccccactgttgactcatccattcattcatccagttgktgtgtgcccactgrgtgtcaggcaggccctggccccgggaagttaaatacagcatggcctcaagcatttccagaagaggtcccagctcggtggaattggcccattgtcttggaacatgggctgactgtactctttagtagacggcacagtttggcaggatctccgcaggtgtgtaagtgccaggctatgccatgggtcccatggttcactgattgtcattaaggaacatactgtagccagaaaacccaagagaccatcatggatgtgtgtgcttcctcacatggctatgatttgacttagcttttctttatcgctgaaaacacagatcatatgaaaacacatttaggagatgggcttgaattatcaacaatatagagtacaccttctttaacatttaactttgagattttcatggtgagaaaaattctacatatttcttttcactccgaagtcacacattctgaactatatagataatttggtaattaatttcttcttaataagatagtttaatgatcactttactgtgatttaaaatggagttgagacgttaggggatcttttatttgttactggaagattacagccggtagtggctttcattatttatgggagggtctccaggtaagccccctatggttcgaatggaagattctttctttttcttttcttttcttttttttgtaggggcgggggatggattagggacaaactgtccctgatatgctgatatgccctgtccaaactcctgacgcacagaatcgtgataaacaataagatggcacgttgatttgatttgattttttttttgagacggattcttgctctttggccagactggagtacagtggcatgatcttggctcacggctcactgcaacctctgcctcctgggttcaagcgattctcctgcctcagtctcccaagtagctgggattacaggcacacgccacaatgcctggctaatttttgtatttttagtagagacaaggtttcaccatgttgaccaggctggtccaaactcctgacctcaggtgatctgcccgcctcagcctcccaaagtgctgggattacaggtgtgagccagctcacccagccgggaagagcctttcaatgaaatgtgaagtaagtgtcacctttgggtggagacaccaaagacagagacaagacatgcagtgccctcagctgcataaattttgcttttaaaatattttygtggagtaaaattagtgtttagtctcatgtgaatttcatcagtgtgtctatggtgagcatttaaaatacggttttattggaggtgtggttcgtactttataatccctacctaacagtgcttactcggaattgctcccccgcctcccaagttactggcctcactgtgctccagctttcccagtagcagaggaaccctcttcccaaacgtgggctygatttacaccgagtcattagttgtcatctaatggtggctcttcagtgtcactgcaatctatacgctttctctgtgtcttccttagttctctgcccccacttttccccacccttcacgtgtcatctggtcccccacaaagcttttgcatggggttcatctgcctattccaggagagactatggtccttatccagtagtactaatgtgsggaaataccaggagtggacaagccaccttccccaaacatgaaagagcccagttttgctaaggagctgttgaaaaactggaaatagaacagcgcygtggtaagatttgcctttgaggtcgccctgtggtgtgttaggggcatttaggggacagtcagggagactcatttggaagttgctttggtcaccagctgtggaaggataagtcttagaccaaggcagtggcagtgaagacgaatttctgagaaactctggtggttgaaccaatcatctgttaggtctgttctgtccatggtgaagagcgggttgtgccatcgactgagctagaaaacagacgagaggcaggtctgagagaggctaggaggcccaggctgggcggcgcggacttgaaggcgcctctagcagatccaaggggagatgccgagttggtcattggctacacaactctagaaggcaggatgtgaggcagagctcttcgtggcagtggcgatcctgggagctcctggcactgaggtggtgaccgagacattcgcgaggaggttgcccaggcagagggcatgggaaaaaggacaccaggaggatgccagggaagcacccgcacttcaggagccagcaagggaggatgagaaagagaagttccagccggaggaggaaaaccagggacgtcagggttcatggaagcccgaggaggatgcagaagaggaaaggagggaatgacgaggaacgccacatgctgctcagaggtccaggaaggtgcgacctagcctctggaccactcccagtgaccatggcaatggcaggcccagcctagggattgcagagagcaggagaggcagagtcgagcagcatccccgggctttccagaaggcctggctgggaatggggcgtggcacacggtgtaatccgggcagccttggcgagcacctcctgtgtgccagtcaccacactcagtccttttcagcattttgtttagttacccaatccatttcatttagtcacccaagtagaagttagaaattgatgacaaactgagggtgcagggcaaaagaacacatgattcgtgctgtggaaccaggacagtctgttggggtgctggcagggtgttcgattgccacatggtggtgtcatgagcagtcccagagccgtcggattgctctggtgcacttgctgcctggtttttctcacctgcaaaatgaaagagctgacaggatgaaatgagttaatagatgggaagygtgggccgcctagccctgctcagcctttgagcagcaaaaaggaggaagggggaggaggaggagctgtcctctggttatagagggcgtgaggttggcccggaggctcctagtgtgaccaagggctattccttgcctcattttgtgtgatttagaaacaagatggaagtagaaattgggcattatgtcaggatttaatgaagtcttgtttgggagctgttgtcttatttttaaccactaattaaagggtgctatttccctctatagaatagaacatttacagtttgtggataaagtaaatgtatacctcactttttttgttaagttcttaaactttttttttattattgaagaatggaaacatacatgaaagtgtatttgggcttaaaaagttgtcacaaaattatcctcaggtcaaggagggcctatttctagaccccagaaacccctgtgtcctgtcccaggcacctgcctgctctgctccctgaagatgggcacaattctcccttctgaccccatggtgaggccagcttggttttcacctttatacaatgtacacacacacacgcacacttgcacagttgaaggggctagttagaggtatcttttatctgttaacccaaataaaattttaaaattatagaggaagtgacttttaaaagaacactgagcattactcttgggagtctcaggagggtaattaaattggtagtgtcagtagtaagcgcaaatgttttcagtacccgttgacaccgttttagatttgggagtagctcatgtgacagagtcatagggaagtgtgctgcccaatttgagaaaagatcaaatctcagtgacaaagcttccagattttttttaaattaaatttaatttttttgcgatagtctgactctgttacccaggctggagtgcagtggcatgatcttggctcactgcgacctctgcctccccggttcaagtgattctcgtgcctcagcctcccaagtagttgggattacaggcatgcgccaccacatccggctaatttttgtatttttagtagagacgggatttcaccatgttggccaggctggactcgaactcctgacctcaggtgatctgcccgcctcggcctcccagagtgctgggattacaggtatgagccaccgcgcccagccgcttccagattttttttaagtaaatccacgtgattgtgtttctgatctatgcaccaacacacatttacattgaacatatttatgtctatgcacccacacacatttacattgaacatacgtatttatatgaaacaacacatttatttcttggataatcaaatatagacaaaaactcaatggttataaaaagcttcccagacagcacagtctggggtaatattcacatgttaaacctattaacatttaaatgttctaaatagtatgagtaattaacgattacagccacagaagagcagctccctcccgtgacattccatccattttctttgagttgtttttttggggtgggaatggaggggggttcctccactcacatagacacaccaagcttttccctctaggagattacccagcctgctgctgggttgtgtggggaaggactgcggatgtcttggatggcagttgtcatactagttttttgcttccccaaacaattcatttagggatgtctttaagtgaggcgcccagagattccaccccgtccctgggacatcaagcaaatagcagcaacagccgttggcaaatttgtggctatttgcagcattgactctgtagtcagtttgcattttcaagatgggggagacatgggcagacattacaaaggagtcctttccccttcctattcctcatgctcccgctcctcctcctgaagtcagatactttttgttcttcattaaagttttcccttattcgtatgggttaccctgtagttttaaagcattcaagcagtccgtatattttagaacaatatatttataaatcattttctttccttgatttgtgtatggaagcaggaaggacataacaggtagaggggaaataggacaaatatgaaaaaaaaatagtagagtttaaaaactactaccagttaccggatgttgtgacttcattttattttttaattaatgtggtagaatagtaattaaatggacagaagaattttagcagttaacaatgctaaatactcatactttgtacatcctgtctgtagtttgatgagaggctttgttgtagaaatattctctttactcatgaactgactcttcctagactccatagaaaggwtagaacattcatttgcatttgaagtttcatacaacagtcgtttccataacatatttgacttrtcttaggaagtttctcgcatcttcccttagtttctacaaatgaaaatgtctgcaaagctctcaaagcatgcatcctagtcctatttaattctgacatctgcmcatttcttacgaatgtaaagtcagtgtggccatccagctgaatagtaactctgaagctgggagtaaaatcagatttcagtgtaattgataatcaaagccccttattgstatttttcaaaaacaaagtagcaatactttagcactcacccaggcaattatgatttttggctaatttacttttggtttttgcaatttcaagatacctagacaacacattttgcatctgttgaaatcttagattttatttttgagttcacataatgactttaaaatattctaataaatgtcttcaaagaccccagatcaatatgccaatggttctgagatgacagagtgctgcgatattcctctgtaatttaaacatgattagctgatgaaggttatgtgatatcaatacactaccggaagataaattaattgatatcatcctttsaggatgataagaggcctattggaggtgggatgtaactaatgaagctgcttcttcctctctgtgagccattttttatatattgcattttcacttaatcatatttatactatcattcatttacatgaaacccataggctgtggacaaaccagtttcttattaaaattgtattcatttggaaaagaaattatctgcaaacactatatgggccccgtctacgttataacctattgctggggagagatgacaagttcctttccgtggacatcttcgaaaatagcaactatctaggcaaagtcaaggattgaatatcattgaacttaattactgctagtccccaaagacacacatctattcaaatcaaaagtgtagttattctgcggcagtgacaccattggtgtaggaagagttttctaatcgttgacttcctttccaattacattcagtatgctttatcagcgagcctatttgccaagagaagttatggctggttgaatttagatttgtattgattaagataaacttacaatgtgtgcagtcatatatttaaataaaaaaggtctttgatataattacatctccttgaatataattctctatgatagcttgtagagtgaagaggatttctttaggctttgggggaaaaaaaaagatttttgtctttccaaggggtttggttaaattgccctgccttatttaggattatttttgttccaagtaactggaaaaaaagatgattttatgagaataacttaaatgagataggtgtgtatttttttgctttacattcctctgaggtggtctgtgcagggctgctgaggccttctgtggagttgggggaccggctctatctgtctcccatgtggctcctgttcccagtgtcgcctcgtgttccacagtgctgctgaggccatgtaacgtttgtgcatttcaggcaacaagtaggaaaaacatacgagaatttaggcaaagggaggctctccaggaagatccttaaaagctgccctgtgatccttctgctctcatcctgctggccagagcttgtgtacctggccatgttcrgctgatgcgggggtgggrggacgggaggaggctctggcaaatgtcatgtttattctggttgtcatttgcccacctaagaaccaggaatgctattactgcgaaagaaggaaataacagatttcgacaacagactgatgatctctgctctgttcctgaatttggaaattgattgacatggatttctttttgtctgtgtgtccaccagttgcccagaagattgttgccacaaggaagaagcagcagctgtccataggaccctgcaagtcgctacctaattctcccagccattcctccgtctgttccgcgcaggtgtctgccgtgcacatcagccaggtacgttaggtgacatgagaagtcagactcttagaaccaaagacaatatgcaaatagtgttcccagccaatgctaaggttgattttttttttcttttcaactttataagtaacagcatgttgtaattgacttcacattttcttcagaaactgctgtggccaagtgatttttatgggaatcattcttttatgttttctgtcttcatgctgcctgtgttatgaggcatgctggcccgggtggtgatrggaggtgtgtgctgcagtcctcgctggtgatttaaaccacccttctctggtcttggtcctagtctgcttataggttgaacagttgtgagtaaatcttaatggccaatctcgctttatacttaaatttggtagtggcattcaattataattaccatctcccttaggtcccatagaaactgctatctttccataacaacattttgcaaaagtatttacttggaagcaaatgaaataatggtcactttgaagaactcaaccaacaacctcctaaggaaacagttgactttgtttttgtctgtgcttgttttttgattacgtttcttgggcaggtattctattggcactgtttttttaaggacatggtggaagggttcggtgtcgtactttcagtttgcttgggaagccagtaagttatggcatgtattgtcagagcctgtcaaggtacagtcatgaatgttcatgctggctgggctgagtggcagttgcctgtaatcccagcactttgggagctcaaggcaggtggatcgcttgagctcagtagttcaagaccagcctgggcaacgtggcagaaccacacctctgtatctacaaaaaagagaaaaattagctgggcgtggtggcttgtgccttgggaggctgaggtggggggatcacctctgcccagcrgaagagctaggctgcagtgagtgtgattgtgccactgcattccagcctgggtgacagagtgagaccctgtctcaaaaaaaaaaaaaaaaaaaaaaaagaatgtcttcacttgctgtgtttaattttctgtgaatcttgaaatacttttcaaaaacacttagattttccaggtgtcattttcataatgttggctgtggttctgctgatctagagcagtggagggaccatagaatccctttagtttaaccaacccctttcattttcagaggaaagagaaaataatcaaatttgaactctcagaaatcttttaagttaaatgaaagagacttctttgtcttcagtcacttttctcaggggatgccactgagtgagatgattggcatgttccaggatgagactctgtagacatgacactaatacacctggcaaagccatagacgcaagtcagccattcycatgcatcccttccatggggctcatgctcacttgttggttatgaccttgcctaagtggaggtcttgggttcctgagtatgtcgttaatgaaaccttggattttaatcatttcagacaagtaatggaggtgggagtttaagcgactattcctcctccgttccatcgactcccagcaccagccagaaggaacttcggatcgatgttcctcccactgccaacacgcccacgcccgttcgcaagcagtctaagcgccggtccaacctgttcacygtgagtgtcaaccctgggtggagatttgaatgcgattcygaagcgttcccattaacgtaaacctggttgccacatggttcagtggtatttgtagaatctcaactatattaaagtgaataacattgatttctgtggaggactaagaaaattaagagaagcaaagatttggatgttgagtagaatgggaatttcttcatgtagacattcctgacttcgtgtgtctgaaatgaagagctgggggtgtgtataaaggcacttgttatcctgtggctccagctaaagatgtgtcacagtggatacaaggagatgacaaaactctaagattcccagatgtgtgtctctaaccgttcagatgatatataagctattactgtccacaggccctcttcttcttctgctggggtgcctggcgctgccctcggggtggaggtgggggactgggaggtgcttcctggaggctcattgccatgaggctctccacttgggttttttgctgtagagcatgttgaaagcagagatgagctatctgggttcaggtttataaattcacaatctgggtgcactcgggcatgcattgttccttttttttttttttttcttttgagacagggtctcactctgttgcccaggctggagtgcagtggctcagtcatggctcactgcagcctcaacctcctgaaatcctcccacttcagccttctaagtagctgggaccataggcactcaccactacgtgtggctaattttttttttttttttaaagaaatggggtcttactgtgttgcctagggtggtcttgaactcctgggctcaagccaccctcccaccttgtcctcctgaagtgctgggattacaggcatgagccatagtgcacagccagcatgtgaagtgcttgaaaactccctgggtgattgagatgcagagaatctctgagctacagaggtggcaaaaatgctrccagcctgtcccttccctgtgcatagcagacattaccaatcaatctggattctacacagttgagccgcaaactccaggcacagctgctgtcaggtgactgaagcatttggacttgagaagaacgcttttcctccctggatcacgcattacaagtacatgcttttgaaacagtgcttctgaaccagggtggttttgctctccaaggacatttggcaacttctggagaaactttgggctctcacaacaggagtatgggagtgggaaggtaaaggttctgcagacgtctagtcgtgggtagcaaccaggggtgctgcaaagcatcccacagtgcataggtcagcccctcacagcagggaattatccagccccacatgttagtggtgccctgttttaaaccatctgacttccattttggttgattactgctgacccagatgcaaagctctagaggggtggctgggagtcagatttgctgcccctttgtgaatctgatcttgatgttacattgcgattcctgccaagtctgggagatcccccgcccctctgccacatgtctggggcagtctctcattggatgctcatgactgcggaggcggttgccagctgcacacaccccctcgtccccagcctccccttgcttttgctagttgccttgcgccacatcagctcccacagaggccactgctgggcagcagggtgaggactgatcagacagaccaagctcccatcccggcctccgctgctgacggatgtttgaccttaggcaaattacttgacctctctgggctggaaaccatagtacttctgcagtggggcttccgggaagacttcctggaggaggcagaagagatctggtggcattgcttccatggttttctcactccattgatgctataaaatgatttctgatcgtgttaagcatatgtgatagattaggaggtgggtatttaggtttctgtaaaatacaggtgagtatctcacatgcttaaattagtgcatggataacatgttttattgggcagtttcttcacacacaccgagaacagcagcagtcacctaaatagctgcttcccagctccgtctaacacctggagcagcccctgtctacccccaggctggggggctttgggttgaagtgtttcctgctagaacaggctgcacagtgactcggtggcttgagaaaccaatagccaaagatgcagctggattgagagaaggtgggctgtgggcaggcggcctgtgccccgggaggaggggcgggcttgtcatcgtggtggtcgagaacaccttctgtgtctttgttaagggagtggaagggggagagcactcattctcagacgccttctgagggccacattttctgcttgttgactttgctttctcttttaaggagagaaattttaaaaccacaaagtatctttaaaaatgagactatttataaggagaataccagcaccttcccatcccctccctttataagctctggaactgcagtgtgccagaaagtagtatcccactgggtacctgacaacccaggtgacttagggaggagaacacttgaaggcagagagaatcaaaataacagcccatttaataaatattgacttaacatctgctctgtgcacagccctggttttgctcagtgtctaggaggaagactcactgccagagtcaacccatgttcaagggaaagcgatttagggtgaaggagaaggggctctgcacactaggaggagagaccctgttgctgcggattcaccctgcagacacacaggtgcacttacaggcatccatgaagaggccgggcagggcaggtgcagaagccagtaaaaactcattgttacagtgaccaaaaatcaccattaattatttcaccattaatgtgtcacataatataatggtctgcctatggatctaagggtgaccagtgtttgttatctttctccttaatcttggaaaataaatttgagatcagatcagaaattgaatccagctgtcccatggcattagtgggaatagaaatttggagtcataaaagaagctaccactgcaataggtttgcattgtggcatttaaggaaaagacagtgaaagttctgggcagggatccatatgttggtcctcagtgggtttgacactgaacaaaatgatggtggtgatgatggttgtggtgatgatgatggttgtggttgtggtgatgatggttgtggtggtgatgatggttgtgataatgatggttgtggttgtgatggtgatggttgtgatggtggtggtgatggttgtggttgtgatgatggttgtggttgtgatggtgatgatggttgtggtggtggtggtgatgttgtggttgtgatgatggttatggttgtgatgatggttgtgatggtgatgatgctgcttgtggttgtgatggtgatgatggttgtgatggtgtgatggttgtggttgtggttatgatggttgtaatggtggtgatgatggttgtgatgatggttgtggttgtgatggttgtgatggtggtgatggttgtggttgtgatggtggtgatggttgtgatggtgatgatggttgtggtgatggtggtgatagttgtgatggtgatgatggttgtggtgatggtgatgatggttgtgatggtgatgatgatggttgtggtgatggtgatggtcatgatggtgatgatggttgtggttgtggtgatggtgatgatggttgtggtggtagtggtggtggtggtgatgatgcatgcggtgtagtcttaagttgaagttcctggaaatagtaactccactagatgtcagtgtcatccaaggaacaaaaagaaggcaaattaattgtgaaatcatagcaattaagatattaaatttttatcatgaccagttttcttctatttttaaatatgtaaaattgaatagactcttcatccctggcagttgttggtgattataggcataaactgtcaaaatgtgtatttatttggaagtgtctagtcagaggacagatgcatgatatgcagacaatcttagtgaataaaaattcgtgcagactgggattgtaacacccagctggaggggcactatccaccttatttattagaacatcataaagaggccatagttaattaagtaatgcatgtatcattttttccaataccattttacacattttataaagtacactgtaatgcactgctctgggctaacattttgtgctcccagatgtttgtttgcatatattcatatacaatttttaaacaaaaataaatgacttttttataaaatagtacaaataaaatctctgtattagtccaaattatatgttacatttgcagtaggaattctactttactaatcaaacactgagttatattttatttcacttatttctttggaaaaaaaacaaacattaaaagactgtatccatttaatccctagtttggtaatatgggttcttagagcaattaatttagtttagcggccctagtttacacgtggttaaagtgttttattagaaaaatttttcaaacatacagaaataaacacgtgtgtactcaccacacgcttsatcaaatacaagcccttttctgctacgctgctactgcaagaaataagcaaatcctaagtaaaagttgcagctccttccatgtgcctccagaacacgtttctcctgcctgtctgcctagggatcagcattaacctgaatttggtctatattatctgtgtccatgctgtaaacttgttctagtgtgagtcttgaaattatacattacatggccttgtccattttcaagctttataataacgatgttatttatgtgatatttttaaaaagcttaccatataatgttgataccattaaacagagccaagtgcacccaggaaccaaagattgtgaatatacattgcccagctcagaaacttgccataaaaaaataaggcagcaaaattcatagtgcgaagagaactgtttcaatggcatttatttgtttttgcagaggagctcctgggtacctcccctagtgtgttccagcagccgttgacttagccactggttgaaagggggtaaacgggcttctctttgatacagagggctcttggcaatgatgcgcttgttcctgtaggcaggtagttagttgatgggagtgtcctccatggcttctctcaccacggcaggggaagttaaacatttttgtaaagaagcaggtgataattggattaccttaacctttctttcctctgcatcgagtgtttgttggaggctaagcagttactatggtggcttgctgtgcgttgacttaaaatctgcagcccttctgggtgtgatctgctgctgttccatttctggcagtgtgcagcaggctgtatgcagggcagggtcactcctggcagacgcygtgggtgctgagggctgccttgtgtctgatgattcctcggatccattccagcatcacggaaggatgtgccattagtgatgaggtctcccaagttagcagagaaaggaaaccttactgggaatttgtatatgctggggtgtctatgtccattggatttgatttagtctggttgttggatttaaattttatggatacagcctgatgtagacaaactaattgtggggctgaggtacagcaaactcttttgcctaacatcttgccactgttcyttcccgaaattttagttttttgactgtctccggcaaattgttaaagttgtcaggaaatttttgttttatttttgcaatgaagtcttaccgaagtttcagtctcttttatctcagagtgtgtgatcagatattgagtttggtggttcacagttcatgttctaaggtgtttacagcagggcaatgagctatttcttcccatttcaagtggaatctgaaattctgctctgagaatggattggctggggggacagatgagctgccttgttacaggaagatgttaatttttttaaagtttgttttgttaattattctggtttaattaaccagaataatgaagatggatttccaaatttagaaatttagaatttgtaaaattcccaaagtactcttaaatattttttgttaattaaaaaaaaatttttttaatgttatcactgtgtgctttgaaattcattttaaaactaggaacctcaggagccagcttttctcatcaactgtgatgtggagaaaagaatttaaggctattgtgtagctcttactatacagtattaagaattaattaaaaagaaaaatgagcccttgacaaagaattgataaatatctctattttccttctagcccaaagggttaaccttacgttttatattcttctgcaacttcatatttgttgcttgatttattccctgtcatctcattctaggcatccaccaacctaagggggaaacaagtgcacagtgcttggcacgtagtaggtgttcaataagcatcagctcttatcaccatctgagaagcatgtttcctaatgagcacagctgcccaggagagtagcaccctttgaagtgctagatctgagtttccatcatgggaactgttctccttgtcctcctccttaatttggtagcagcctcttctggaatcctaaatgcgtcccatcagcccttgtttgtattatgacccatgacattgcccctttaatatgtatgttttttaaatcagctgttccagctcacatccctttgaacctggattccattagcttttcattgtagcagtggacaccacaaagtctgttcatttcatatatcatctcagatttgaaaagcacgtgaaaatgtttctccattttcaatattgtgtgagtaatgttcccattgaaaagtaatggagtgaagttgtcacttgtcagcacagttattaaggaggacgagtctccaatctttctctcataataaaataaatctgtcagaaaatcattgtgctcacactttctcatgccatcgagagaggagactgagacgatggagctccttcagttttacccaagtcaaggtgcgcttttggttggggcttccctgggttaaaggtcaccacccttcctgcccggtggyagccactcgycgtccgcagcacgtcagcagtgcatcggagataattgactcaggaccttgtcaaataaagctgttcattatttcccaaatactgacctttcgtccaaaggcgattatcaggggttttttttccccttcattattttttgtggtattgtccactagcttaacttcgaatttgccattttccaaccatccagaagcaaaaacggaaaatgttaacagcaccttgatactaatcaagagtgtgccgttaaatcgcacagctgactagtcaacagaattttaaaatcattcaaacattaattaaatacatatgttgatgtagtagattttccaaataaacattgagcagccccttttttcctcggctgtgtgaactgcagctttcaagtgtttttctgttgggcgttactttcccatatggcccattggtttctagtagttgaattttgaactttttaaaaaagaattaaaagataattctgtggtggaaaagtcagggggaaagtttagatgattctctttaaaaatgatgagtcagtggagatgaactactgagctgtctgctcgtcggacgtgtctgtgcgcacacatagatcgcgcatgttttctaaatgtgtattggcaggaattctgcaaacaggggcagagccccgtctgtgaaccacagcccttacccagatgccaactttccttttgctttgcagtctcggaaagggagcgacccagacaaagagaagaaaggcctggagagtcgtgcggacagcattgggagcggccgagccatcccaattaaacaggtgagcagcctccccatccttccctccctgwcgccggagatacacctcaggtcttcctggagatgatgctggctctcgcaccaaggtctgtctgatgtgctctgttgatgaatgtagaagtctctcacttgacatcaattagcagagttcctgtgtgtattcaaatgggatcattagaatgagaagagggaacggagacaacagacctaatgaagtgcgggctgcccgcctgcatatggagtgcgtttccaggctgagagctttcaaaggctgcctttgtagcacggctttgattgggccgcgggccgccgggcaacaggggtaactcagatcgcctacaagagccccttgtgatcacaggaacagcccgacgtggccctaatttgctctcacagacggacatctgaacactgtttcaggctggtttgtaacaacgaggcaattagttgtgataatcatagccggtgtgtcagctgtgcgctcttgtttgtaatttgctaatgaaggaattgtaactttgattaggttcggtttcatttagaccttattatataaaggaacatttacagctgtaatgtggggccttaattaaactttctcattacacaacaggacttgaattcaaccatttgttttggcctatgttgctagcctggaacagggtttcattagcccagaaaccagattcyaaatcactttatatctccaataagaaaaaaaaaaaaccctggagtccacgtgtgacgtagattgtggtttgatttccaaggagaataaaaatagagttcaaccccacacagtggcttctgaaatgtcatcttttggtttgttaaagaaagccaattgatttagagtgcatccttcttgrgcagaagcctctgtgggcaggagaatggctccgcctctcaggcacagggcttgtgaccggtgtgcacctccggtccagctcactgctttgctctcctctctcytgcgggcacctacacagcatcggtaatcccttaggaactgtgtaggcactggctkcccttaaaaaggggagagtctttccacacatrgagttggattattctggtggtkcaggtttcgtccatttgaagcaaataggaacgcagccttagagaggggccagccagtgtcagcgtgaagatgtgggagaggaaggggttaaatagggccacagcatcttgggtgagaccagaggagggagtccacagagtttcccaaggagcccaggaactactgcaaaaaccacacctctgcccacagcgtaaccgaccctgcccgggagcaagctttctccttccgtgctcacagggcacgcctttgccaggcagagaagaaggaggcctgcaggtcatcaccaaggccctcaggcatctatgtaagatacatgatcatctactgggccgcaaatatatggattggcccggggcacctttaggagaaattctcttccctccatatattcaaagacaacaacaacagaactttccactttgatgatgggtggtgttttcactataaaacacttcagaggtccgtgcacatagttgcttattctttcttggtgcctttatttataacctaactctgcataagctaatgttactgtgtaatttttatgccactgatacctttttcaactggaattataaaaatcagttataaaaataattctttttcataaactggtaccaggacatttcctttggggaatattaaaacttaataatagactgttttcttaatgcctgtctgtggttgatttgggtgatttgggtgggagcgctcaccagcctggcgggagtccctctgtgcgagccaggtgggcccccggtataattggaaccttcattcaatttgtacctgctcatctgtggagggggctagctttgcaggctagcttttcaatatgtgtgcagattggaactgaccatcaagcgtaaaatgagtattatccagtccttggatgcctttcgattgtgaatgttcaaaggaatctcgttgaaatctaaatcatggtctgatttcccggtgactcctgggcacagggagctccttgtccctcctaattgtccccctcttgcagccacagacagctccctcctcacatccacacctgtcccagcaaagtgcccccgtggccagctctccaggcctcgggtgcctcgtctgtaaaatggggaactggatgatgtctgaagcccttgaagcagttagatgtggaggttccacagagaatttttaaatgttagcaaaactggatttttaaatcggggcacccttgtcaaagcctctctgtgcatcggacggattgatgtgggtttgcagacggttgtatcgatctatctcacatccctgtgtgtacccttgtttctaaaggaacatagatcacttcaggtagcctgaattcctgaccttcctggtgtgatgacttcagtgtggaaatgaaatgagaggattgcaggggatggagcctgatggccatattctagaaactcaaccaaattatttgttgaataaatgaacaattaaatgagtgcttattatgtaagtgctgttcatacaagatcccacttaatcctcgacattgccacagttatggtagctgtgttctccttattttaaacacagagatagggagggccctataccaggcagctaggaagtaggtccaaggattcggaccaggcctctctgcccctatgtctgcgctctctccactgcccattgatgaaaagccttcagaaagcttaggaagcaaagttacatgttttaaattaagtaagtgaaccacgacctgagacaaaaatatcttacgactgtataaagaaacttctgagactgcctgcagcaacatatttctccagggataacacagccctgctcagccattctccgggtgggaggcgtcattccattcccatccttaccgtgtttgccgcaaacatgttctctgctcttgtcacttgctgcagagaactgtgtcttaatgctcagcccatgtgaaagactcgggtctgcatgatcgaagcctcacacaccagctaatggacctttgcctaatggcagaggagtcgttttagaaccccagcaacctgcgtggagttgctaatgcagactcttctttcccccagcaggagtcttgtaatggatggtttaggatccaggcaaggcagccttcaacactctctgcaatctaaccccagagtttacagatagtacgtgtcgcagtggcttatgttaaccccctttcacttccatctgatacctcgttcgctgtaagcatccaggctccccccacctcagtgtgggagcttgccgaatcatgatggtcaatgacgttgtctctttcttctttctcccgattaaagattccccatcaagaatatgacttattttctggactataacttcatttcttgtggacctgggtctacttctcctttggtgtcctttctggggtcttggaggaggttggttcagagaattcggtttctttttttttttttttttttttactaataaggtctattcgagtaaaaattaagaagcaaagcaagaaaaagccagaggcccggctcagcggcaagtgggtttgtcacgtattaatttttcattgctgtggagagttgtacatacataatcacttgattgcagtgggagttagggagctcctatggtgccatttgcataaatcttgttaagtcaatggcagttaatgaagtacaaatgagcccggagaaggtgacatgcaaatcgtgggtggcagatgggaggtctgtttgggggacagcagctgtgtgctctcctttctttctttctctttagcattttttaatctctatatttgagtacagatacacagycatacgccttggcctcctccgtgcccttcgcagagccccggccagagaacctgtccatcccctcctgcctctgatgtccaggctgcataaaccgttcaagacttgccttgtacttggtagcgtacgctagaaggatttgaattttttgaaaatcrtgctcagtttatctcatygtgcttacgcaattgaaagcgtatcatttttacttggtggggacacacagaacctcctcactacatcttttgagacgttgtgttgtctcctgaggtttcagagaataaaaaagaatagaagataccatctttgccttatcatgcttccatttgggagtcttttcttcctttttcagacaggccaactgtatttactgattattccccgtccctggttcgtggttggaccatcaggggattggcattcctagggttagtcaggaatgaraaatacagaaagtgtgcggggcatgctctgtacctcaggccatggggacgaccgctccctgtcatgcagacccctcagaggggccgcccccggcccggcccagctctggccagggtgtctcacgctcttggttttgtgtttaaggatttaagtgctagcaggactcacagagagctcttagagattcatgggaaaaacattgcctacgactttcagaagttttgtgtttatttgatcacctggctgatgttttgagagaaccaggtctctgcttgccttgaagaaaggtaggcaaagacgtgtgcatcaggaggcaacagccctgttgacagctgcggtggtcacatgctggggatccttttcttgcaggccacccactctggtccgtcctctgcgatgcccgccaaggtgctgtttctcagttctttgggctgcagggcgctgcgggggaccctccatcaggcacgctcccttttgtgatgctcggtggatgcaccaaaggagcaacatccctcaaaaaaactttttttttttaagtcttcattttgaccttgaaccctgatgtcatggccacctccagggagtcagctgtgagagcagtcatttcccagcagccatctgaagccgtgggaaaagccttcccaagctgtcagaggaagagccggcctgcccggggcaagcccgccgcacccgccatcgggcctgtgaactgttttgaagctgtgcgtgttttgattctcagttgagtagaaagaggcaattgtcaattaagtgaaaggaacctctggagttaatcccctcgtccagcctgccgcaggccaccgacctgtgttgtctggtacctgggatcaacacgaggggtgtattgtgtggcatgggcagaatgaaagcagcctaatgacgccagcgttaacagctcctgaaactttgacactgctcacagcgagttggttgactgcttcaccggcgtgtgctgctttcatggaggaaacaaatgtgaagaccacgctgaaacttgatagagatcggaggagatggagaggaatggcagtgcccttccttcaggggcatggagagaggagctccacaggcctgcggcctctctgcgtaggcagaggtttacaggaggacggctcacgtttattaagccccaccattgaggaaccaaggtgagcgagaggcccgccgagcgtacgatgtccacccacgtggcaaatcagctctgcctgggcgtaggggcccgttttgctccccagaagcagataatttacagagtgaactgccgtgccctgcaagctaattgacctcacttgggtgaacaactccctgagagtcttatattcagcccggttcacaacagacccagcccagttacgatgattaatgtaatagccaggcaggtgtatcagtgcttttactttgactcctcaaatctcatactgtcattgccagaacagtccagaatatctggaggcctacacgtgaaatgacagtcatccgtctttgagtatatcgggcacaccctcccctacatccccgcccttttggcaatgttggtgggtgacaatatgttcctcacaagatgtgcagaatgtttatttggaattactttacccaaagcacaaaatccatcatttatatgcaaatctgcaaagcaatcgaaaagaatacttcccttggccgtgagggttgcatgagggtgacaggaagtagtgtagccctaggtgcatcatacacgaccaactgccatgctaacagaatggcgtttccaagaacggaagttcgttttaagactcagtgtgtcctctgtgtatccattgtccagagctggtgaaacaggaaaagttcctttatctccctcgcagggcatgtgatgggctgtggctcacttcttcggtgtcccgcagctcagacccctaggggggcgggcaggcagtcaggcgggttgtggggagcatgggctccgatcccacagcatggtctagggctgggcgttgacagctcctgaagccccagtgggcgtgtgttacagtgtgcttttcggtttggctgtccacaggcagcctgtgaccatcagctcagttagtccctctgccttattgcaaggacagagggtttctgtatcccagggttcttgccttagtgtactggaagaattggatcacacgtcagcttggagaatgagtgcaacgtttaatgagtggtgccagtagttctcagcagatggatggtagccagaagggcgatggagtgggaaggtggtcttaccctggagtcgggccactcagtggccggactctcctcctaccgcccccgggtgaattccacgtcacccacatcgttctgccattggtggcctgccagagtctgttggtgtgttcttctgccggtgtgcttctctcgacgcccagccgcctgtgtgtgtgcccactagggtctcggggtttttataggcacaggatggggggagtggcaggccagggtggtcttggaaaatgcagtgtttgggcgcaagaactggaatgcctgtcctcgcctatgtctgtgggcacaggcccaagggcggagctcttgccagggagcctgcccttctctacccagcacttccctgcctgcctcccatttcaccgggataatatctaagtgatttgtttcagcaaaatagtgcttattttctttaaaagttgaacagtggtggtgaaatccarttccccttgagctcagaaatacaagctctcctacaagtagaggaaagattctcaaagttaatgttgccagaacttgtttttgtcttgatgaatcaaaaagatacttatttctggaattatttcttatcagatttgatcaactagtaacaattgttcactggtccttgtgtgacatgccctgggtcctctgctacggctggaggaggcagaaagtgtctgcagcccccaggctcagctcaggtgtgtactgacgatcccatcccatgacccccaatgcaagtggacgggtgtcacgccaaggagtggtgaattctactgagttagacaggagagggtgagggaaggacagggaaatggaggtggggacaatcccactggactgggacatacaagtaggtggtggcagaacaggagggaggcagacagcagagctgcggatggaggggttcaggaggaagtggggaggagggtcctaaaggcccagggtatctgcttgccaaggactctggctgctctgcagagaagggttgatttccccatattatttgtaggagcagtggtgttgggggtttagagactcatggccgcacggagtggatctccctccccttcttactctgtccccatagggtttgagatgatgggggttctgatgtaccagagtcttggcggtaaccagcgtttattgaccacttttccgagtgccctgtcctagagctttccactgctgtcccccttacctaggaagtgccacgctcccctttcccatatgagaacattaaggcttggggagacagtggggcgtgcccagcagccccacacagcgcatgagtccccagggctgccctaatgaaatcctgcagcctgggcggcttaaacagcacaagttgatctctcggttctagaggctggaggtccaagacaaggcccagcagagcctgtttctggagagccctctccttggcttgagcctgttgccttcttgctgtgtcctcccgtggcctggactccatgtgcacacgcctggtgtctctttttcttataatgatgccagtcccattgaatcagggtcccatctgtacgtcatttaaccttgtctccaaatacagtcccactgcgggtgagggcttcaacatgcaaattttggggggacgtatttcatcctgtaacacacagctgggtagtagcagagctgggacgggagctgagctctgtgtgaccgagagccatctgccatgttctttccatctggaatgtcctagcttaggccttcctggtcatataaggtaaggccacttgatttctaaccaacatatttgagaataaaaaagaaaaacttacttgaagaggccgcatgcgttagataggaagcatacgagactcaaagtactccgacttgggggtttccattgaaactttcctaagttgtggtaaactgttgtcatttgaaataagactgttgctggaacgaatccttataccaggtgcgtagctctcactctgtgcagtgcgttttacagctgttgaggcctttcagtcccgtccatgggagacctccttcaggctggttttgaaaaccaaagctcccttcccttgcggaggcagctcctcagggccgcgggtaaatgttgggcctgtagctggggatgttcaggaagagcctgtggattgggcaggtgctcactgtccrtcagttgtgtcactggttgctttgacagtggctgtggtgttttgtgttttggttaatttctcccaggtataaaagatagctatatactcacttcattactgaaagaaagatacagctgggcatagtggctcacgccggtaatcccagcactttgggaggccgaggtgggtggatcgcgaggtcaggagatcgagaccatcctgactaacatggtaaaacccccgtctctactaaaaatacaaaaaattagccaggcgtggtggcgggtgcctgtagtcccagctacttgggagcctgaggcaggagaatcgcatgaacccgggaggcggaggttgcagcgagccaagatcgcaccactgcactccagcctgggtggcagagcgagactcygtctcaaaaaaaaaaaaaaaaaaaaggaaagaaagagcaggagtgcagagactccaggtcagacttaggaggcctttcaccttaaaggttaaaatccccacacgtgacaagtagctctgactacttcccacagtctttggccatttgcaaacactacatagaaacagatgtctaccagctgggtgtggtggctcacgcctgtcatgtcagcactttgggagaccgaggtgagtggatcacctgaggccaggagttcaagaccagcctggccaacatagcaaaaacccatctctactaaaaatacaaaaattagctacacatggtggtgtgcacctgtaatcccacctacctgggaagccgaggcatgagaatcgcttgaacccaggagacggaggttgcagtgagccgagatcatgctactggactccttttttgatctctgtctcaaaaagaagaaaaaaaaaaagatatctaccaagaccaagactcctaaggaaattgtatcattaaagtcttatttcagttctgcagtatttatttaacagttcctgacagcagactcagtttctcctcgtgtaggaacttggactgtggaataggacttctcccaagctgagttttgtcctttgtgaatagaggctttgacaaccaaacaagcacctctcctggcagagagaaatcactggctgccagaatttcatgttttgtttagaaacagcaaccgtggaacttatggcacttggcatggctcttagaccagacacattttcccagaaatggtcaggaaggcccagactgtgcactctgtcccaagactgtcgctgtggttctccctcacacacccctatgacatggttctgcttgttgcctactccagagcctttggctccacaagttctaaagaaggtggcggcttaataagtcttcacagtccccttttgaggcttttcaggaaagtcatcagacaatgacatttttatcagatagttttgagtagcaaaaacactttttcctctcctacatctaaaagtaaaagaatttacttttaactgactcactgaaggccatgttttgaaaccaaaacactctttccttggtaccaaagctgacagctataagtaaatatataggaatgtaaatattataaagtaggcatagaagagtttgttagttttaggttgggtgcggtgcgtcatgcctgtaatcccagcactttgggaggccgaggcaggcagatcagttgtggccaggagttcaaaaccagcctggccaacatggcgaaaccccatctctaccaaaaagacaaaaagtagccgggcacggtggcgcatgcctgtaattccaactactcgggagcctgaggcaggagaatcgcttgaacccgggacggggaggttgcagtgggctgcgatcgcaccactgcactccagcctgggcaacagagtgagactctgtctcaaaaaaaagaagagtttgttagtttgggaaatatgttcctagttagacattgtccataaattacctaatactatagttaatgtttgcagactggtgaaaacagaaacatttcaaaatactattaacatcttagggccgtcccaagtctagtcctcctggttcaatccgatctgctccctgcaatatttactccctaacctttccttctgcttaaaaactcatcagaatcaaccacattattatcgtgtgagacttgtaataagaatgctggcagttacatgccgagtacatattgtacattacgttggttgcttcatcacaggacctcatttaattctccaccaacctaagatacaacttgctactctgttctagacgaagagtttgaggttcagggatgttaaggtatgagaccgatgttatatagctccacgtgagtggaagagctgggattcaaatccaggagtcctctctgaaacattctagaaaagcctatgctgttgcatccccttcccgccccatgccatctgtgctcaccatgaccgtcttttttttgtttgtttgtttgttttgagacagtcttgctctgtcacccaggctagagtgcaatggcatgatctcagctcactgcaacctctgtcacccagattcaagctattcttctgcctcagcctcccgagtagctgggattacaggcatgggccaccatgcccagctacgttttgtatttttagtagtggcagggtttcaccatgttagtcaggctggtctcgaactcctgacctcaagcaattctcctgcctcatcctcctaagtagctgggattacaggcacatgccaccatgcccgactaaggtttgtatttttagtagagatggggtttcaccatgttaggctgttctcgaactcctgaccttaggtgatccacctgcctcggcctcccaaagtgctgggattacaggcgtgagccaccatgcccggcccatggccatcttttctgtgcaagatcaagcatcaagtacacagtgtactttcctggtggggcaccagcaaggcaggctgttttacgcagggctgtcctggaaagtctgtgctgtctggcacctggatcaagatcagatgaggtccttgagctccagtgttcatcggagtccctgtgggcccagaggttgcctgagtaggtcagaatcgagtatcgggaaattgtatttcttttcttttcttttcttttttttttttttggagacagagtctactctgacacccaggctgaaataaaatggtgcaatatcttggctcactgtaacctctgcctcccgtgttgaattgatcctcataacagcctcccaagtagttgggactacaagcacacaccacgatacctggctaattttttgtatttttaatagagatagggttttgccatgttgcccaggctggtctcaaactcctgagctcaggcaatccacccacctccacctcccagagtgctgggattacaggcgtgagccactgcgcctggcaggagattgtatttctgtgttctcaagtgatgctgatgctgctaatccaggagccayactttgagatcccctttctaggcacatggagtcacttagggcttctttcctttcccgcctcacaaatagatgactctttgattcgtaccagcccctttaatctgtgctcgtgaaaattttcctagccgtgaggcccgtgtcagatgccttctgttccaggtaaaccaatgagatgtgtgctctttccttttctttcctccgatgcccgtccgatcttgggatcttgctctctatcttccctgtttatagctatgtgcatcattcacgcctcctttcccacgtgtttccggatggtgcacactccgagacatgttctttctcctgcgttgtgtacacagcagggagggtatttggtaggcaggttgctggtggtagtagcactaggtagcataggttaattgtgtaaaatggcttttttttttcttytttctttcttttttttttttttttgagacggagttttgctcttgttgcccaggctggagtgcaatggtgcgatctcagctcaccgcaacctccgcctcccaggttcaagtgattcttttgcctcagcctcccggctagctgagattacaggcattcaccaccatgcccagctaattttctatttttcatagagatggggtttctccatgttcaggccggtcttcaagtcccaacctcaggtgatctgcctgcctcggcctcccaaagtactgggagtacagccaccatgcgtggctaaaatgtcttttcttcaccaaaacagattttgtttgtttaaaagaatatgttatattggagaagttacagtattcattaaattgtattttcaggaacattataatttttaagtcaacattctttaacttttatgtatctaagatagtatgtttaggttacacagaagtggtcacatttttttaatctgcaaagaagaaagcttttgccagtgacccaaaataatttcagaaaactggtttcttgtacaacttttctacttttgagtatttatccagaagaagatttgtttaaataaatgtcttcacatacaaaattttgtttataaggaattcttcaagattaaacccacaaattttagtaacaccggactgtttttgtaattgccaagtttttaccatattgttcagtctctatcagccacagcctctgtgatttcattcatgctaaaaacaagaatgtttatatttttagtgtacataaaaattaattttatacaaatatataaaacagctacacagaaatactagtggagagacgagtaatgtgccaagtaatgattaggcaatgaggaaccacgagaagcagatagctctggttgggtgtgttggccttcctttgctcatatctaaagtattggagatttaagacaatatgaaatcattgtatactaaaatgtatcattaacaaagaatgataaaatcctactctaagaaaaataaggaagagcagagttgtggaaatgcactgctatagtcctgaaacttgacccagtcttcttgaagggcaatctaacagtcatacatgatggacataagaaatttgattcactttgtcccagtgatctgtcttctagaagtttatcctcaagggaataattcactaggagaaagggaaaaagacctttagtgtaaaacagtgtgtatagcagttatttataatattaaaattctgggagctacaaattttcaacaagcaagaagttaaattagtaattgctaactgaatagtaccaggatgtacagccattaaaatggccaatttgaataccctttagagataagtgaaagcataaaacataaaactgtgtataataattggarcatgaaaatatgtatacatgtggctttaaattggatgaataggaacgcagtaacaagtgaactggggtaggtttaaagcagaacttcaatttttttttttttttttttgagacggggtctcgctctgtcacccaggctggagtgcagtggtgcgatcttggctcactgcaagctctgcctcccgggttcacaccattctcctgcctcagcctcccgagtagccgggactacagggaactttaaaaattttaacttcatgttttgaaataattttagatttgaaagaaatttgcaaaaaataatacaaagactccatatacccttcacccagcttccttcactgtggacatttttatataactagtacagctataaaaaccaggaaattagtattggtaaggtactagtaacttatctataggccttcttcacattttaccagtttttcctgaaatgttctttttaatctcaggatccaatccaggatccctcctttcacttaattgctttatttattttgccacttccaccctgagaaaattcctcaagtcttatgtccatgaccttgacactattttaggaatattgatcagttactttgtagaaagctctttaatttggattgcctgatgtcatctcctgaatagatagaagatctacatttctggcaggaaaaccacagaagccttgcacccttcctggtgctctgtaccagaggcacctgacagccacctgtcttattcctgggaacattgaccttggtcacttggacaaggcgagacctattggatttctcccttgagttcttatttttccatttgataaagttagggatgaatgtcttcggggagatactttgaggctgtgctgatcatttttagtgatagacgttgtactcaataataagtaggttttataaaatgaaaactattttcttctgataaatgtgtacagtcttaaataaaatttaaagtgcttttttaactcttcctgtattggagggaaggagtaaatgaggatgattttgaaacttgttggttacttaaagaagacctggggaaacctagaggtgaggaggaactggagaagcccaggagcgaggaggagctggagaagcccaggggtgagggggagatggagaaactcaagggtgaggaagagctggagaagctcaagggtgaggaagagctggagaagctcaagaatgaagagaagctggagcagctcaagaatgaagagaagctgaagaagctcaagggtgaggaggagctggagaagcccaagggtgaagagaagctggagaagcttgggaatggggagaagctgaagaagctcagtggtgaagaggagctggagaagcccaagggtgaggaggagctggagaagcttgggaatgggaagaagctgaagaagctcagtggtgaagaggagctggagaagccctgagtgagcccgagctgggagtggtgagtgtgagtggaccttcccagatagatctggtgagaatggggtggcagttctagaactgaacaagaggggcttcctggtcgtggaccccgacgggtgggcatgcggtagatacccagcacatccgagggaaggatggatggytattgatttcccttcaggccatgccaatatgtttgtcaagcaacagatgcaattcaagtgctactgtgatccaggygtggctcgctgtttaggtaaagaagcttcacaaaggcgctgccacaaaccaacatgtgttctttgggtttcatctcgtaatttcattcatgaaggttgggaattctgttactcagaatcttacctattttttccaagtagtttctctcagagaacaaaaactatgtatagtatgtgtgtacatatgtaaatttatgtaacatattaacatgttattatgatatgtaacatatcattatgtattatgttaacaattataatctataattctatagattaaccctaagatttatttttccctaccatcttcccattgttgcccaaataactgagtgctgtctttccccacctccccgtatcacccaggctggtctcgagctcctggcctcaagcaaacctcctgccttatcctctccgagtagctgggactatgggtgcgagccaccacgcccagctctagagtgcttttccctgtgctcgcaccagaattacagtgaactgcccaacaaacatgctgtttttaaagctagaagggaccctcatcttatacctagggaaactgagtcccaggaagggtaaagagcttgctcaaggtccttccagatgctcttccagtaccatttccaccactgacaccagcattttcttattccttgtgcacttctcaaaaaaatagaaataacaagtagtggttgtttactgttttgacccagatatttttattgtattgcgactggtcagctttttctaagttgaatctttaagcttcatgctgttttatctgtttttttaaatatgcaagggaatagataaaaagcattacctttgaaagcatgtggttactaagagacaacatgaccatcctttgtgtgtttatgtatctagcaggctcattgattcccagcagtcctgtgaggctaggtggcattcattcctctgcacattttatagatgagaaagctgaggctcgccttgcatgatttcctagagcctggaagaggcaaagataagattcaaacccaggtctgcctatcctaaaaccagtggtcttcacattgaagggccttatgtagcaccgagctcccagtatgtaacttaacttatatataacttaacattctgtttatgttaaaaattcaggcacaggactacacccagggactactgcagaaacgttttytaaatagcgccaacgctgaggggtcttcgattggtggcacccgtgttccacggtacagctaggccttctgtgagatccctttccccttaatacagaaatcctctaagtgtattcgaaagcagttgtttgtaattggagtatctgggattgacagtggctttaattagttgattactagttctttaaaatgtactgtactcactgtgggtcttgcaaattggtaactggtagctaccagtgtaattaaatatttcagagcacttggctacagtagcattgaactgtgaagaaataatgttgtacagccaatcaaaaagagatacttgtaaactcatttacagcgtcagtgtgtgttaggaccatcattgagatgcttattgcaggagaaattaaagatacaattttgtgctaagaggcaatgtagaaattagttcccgaattacttgttaattgatttggtgattccctcgggtctgcatgctccttttccccctttttgttgttgcattcagttaacagtgactattcccagagcaataaaaatatattccacatgtagatgagatgtgcccttatatgagacggcctgcattctttcgcggtaccaagaaatgctcaacctaaaacacaactgtgtttttctcaggcatattgttgttttatgtatacccatcaaggtaaccggtgcattcacgggtttggataatttcaggaaaaggaaagcatgtttttatgtctcacgtttacaggcgcttttctgatttttctttccccctaatggaaaccttcctttttttatcaacagtggaggagattcaggagacttgatttatggaagctttttcttatttgcaattcagcaagaataaccatatgaaagaccatttgtagaaaagtgcaaattgctactgaaaatgatattgaaagaaaatgagacctgtttctccttgttgaaattgagtgtggatagaaggagagacagccatcgtgggtcagagggagcctcccaggcttcctggatgcaggctcccgtctccagaccccttccttcttgaccgaggggagaggacactgaaatgatgcacatattggtgctgctaatgtgaaagatgcagaaaccgttatccttttgaatttccagtggaagatccaacgaccctttgaacagctgccaccatggtggctgtggcttcattttgaggaaaacatttttaatatcttgttggccgtgcttatggcctgaaaagcagcattaacgagtttttgaaaactattattattcattttaggccagtccgttatttttttctattgcccttcccgtgatcacttatgcatataaatatcattatgcttttgcttaactggggcaaaaatcatgtgcattatttcagtgtctgcttttaaaartagatggtagtattttattttcagttaggtgaagcagaaaaatgtatccagcaaagtcttcattaaaaagcttaagatggctagaactaaatatacattgaacacaattactaatttatcaaatatgtttgcatgttggtcagtatatacaataaaaaatagtgtttaatttgaaatgttaaaaccctctctaggtccaaaaaatagaatggatgagacctactatttgatagcacagcagggtgactttagtcagtaataactatacatttaaaaataacttaaaagagtgtcattggattgtttgtaacccaatggataaatgagaggatggagaccttattctccacagtgtgctgctttcacattgcatgcctgtatcaaaacatctcatgtgcctcataaatatatacacctactatgtactcaaaaaattaaaaacagaaaaaaaaaaatagaaaccctctcaattgttgctgcacccagcgtggaagaggaggtgtgcgaaaccatgctaacgtggcgccatgccctgtgatgaaagagccacctgcttagttgttggctccagtagaaggagaaggaacacaccgtttgcttactggatggcagagcgttggcatgctctttatccctcatagattcctttcaggttacccccaaatagggtgacctagttttcctcatgagcatggcttattaagggccccaaaagtctaacctctgccaactcagagatgctgcttgggcagatacagggcctgagcagggataaggaaaggtaaccatcagctgcataaccatgcatttgcaggttcattctttctactttcgtctccgttgctccgtttcacatatctttttttttcttcccccacccccactcctttttttgagacaagagtcttgctgctctgtcacccaggctggagtgcagtggcacgatctcggctcactgcaacctccacctcccaggttcaagtgattctcctgcctcagcctcccaagtagctgggattacaggcgcccgccaccacacccagctaatttttgtatttttagtagagacggggttttaccatgttggccagggtgggctcgaactcctaccacccgcctcagcctcccaaagtgctggaattacaggtgtgagccactgcacacggcttgcttccccatatctttttaaaaatgtttttttgcaacattagccaccctgagagtttcttcacgaagttcctgtggaggtggctggctgtcttcgtcacttttctccacagaatgtttctaaaacacacaaatttggccaaacagcctccaaagcaatgatttcatatctccttcctcctattgttcactaactttgattaagttagagaaaagtacctgcacttttcagatacggtggctccgcgtgttggagaattcagtaccagatccatggctcatcctaagcagggcaaggaggaggggagctcttcacccctgggcgggtttgtagtgcggcttgtgcgtctccccagattgcagaggagaggaaatacatccccttcaagatgagaggacacagctgcaacgtcttattttaaaaatatgtgtgacttttactttctgcttcatacatgcatcacgtgtttgaatatactttctattatttgtgagttaacattgctgtttttctccaagtgtttgagtgaaattgattctccacgcagactctccttgctcaccctgaggtttcagggctttgacctgagggctgagaccacagggcacagctcctgacccacgtggctgaagggcttggagcaggaggtaagggggctgccggcgtagctccaaggtgatgaatatttctacttgatatttctcctggtatttctgcactttaatgactatttctactaatacttgtactaataatttttaatggttcacattgagtaggtgacattttgatacattaatgagccttatcaatgacttttaaaagttccttagtgtgccaggatactttgctgcagcccttggaaggaaggggagagggtgtggctgtggcccccattctaccctctgagcatgagtcacaggtggcacgcctaagagtaacatccacggctgaatcgtcaccggcattgaattacacttccaaggttagtcagggaggctttcctttaacatagcttgcccgtactaaaagctgtcagaatactggagaaatgtaggccttgaagatagaggggtgttttcaggggtggccgccttcactctggaatgctttgcgcctgctgggatgttgctagcatgcctgtggggagaggcccggagggctgggctgcgagggaggctgcactggcttctgggaagcgctggtttctggagcaggccagcctgcgggactccaggactgaggcttgcccagccactgtgggtcctgacggtgcagtaggggctgcattttgacagacttacaacaagtatcccagagaaagatgagagcagatggggatcctgaattttggtttcctggggacaaatgttttctggcttgttctcatgtttctgggaaataatgggattaaattcgagtatctttcttggctacaggaattgatggaagaggaagtattttgaactcagtgaaatgagcattcctctgcactaggccgacccctttctgtggcagcccactggaacataagcaccccatgttgggaatttctttttttggtcaccagtgtatcccagacccctagagtagctctcagtaaatatttatgtaatgaaaaatctcaattctcacaaccaccttaggagggataatagcataatccccatttcacagacagaatgaatgctcagagaagttgagccacttactcaatgtcactcagcctgggagtggtaaactaacacttaygcattgtatggaactgcccacgagtcacgtttgttctatgagaaggcagaaaatacctggggaggtcttgcccaggggtgtgtatgtcttaattgataaacctctggaattggaaacgtagagggtagtccagggtagaatttaggctcaagcttactttgagagcatgttgccctaagagtggaatgtcatggagcaaattccagaagctttcgctcacccagccttttcaaagtccatcccaagactgttgggtccacatgttgctcggatgtcatgagatgtccctggttgacacgttgaggacacgctaaaccacacgaagataatgggtgtcattttgcatgactcacagcccttaccatttgaacgtgcaatggatgctccgagaaagaacagaccttgagtcctcgtttgtaagacacagctctcagacgcagcctgtccagagttctgagcctcagttttgggggtcaggtgtcattgtcttaagatgcagttttgtggactggtacagagttcagtctaaggcagatgtctctcttttattcctgttgtctttcaacatttgggctactgggtagatgggcaccagtgactgggcagattggcaccaggactttgtctacaacctgcgtttccctgtttgttctgccatggggcatgaggcagcgcctggctgaccttggacttgcaggcagcctctgtgcatcccctggcccctggcctygttgttagatggtgcatttcgttttctggagagagagagagagctggaccactgtggccgttgtcagaattccactttcgtcatcaaggattcattttctttatgtccgtaatgtgatggggcagcattagcagtcggtcacctgtgtttccaaagggagaagtattttcaggatgtagagactgtggccatgttaataaccaggttctaactttcctaagaaccctgagaccttgtgagcaagaaagggcacagcatttgacatctgagtcaatcctggccaaatgcatactgaattgccactagagaattcaccaccactcctgatgaagccagttgggtagttttccttcacttgtgaaaaattaatcatgatgttagcttgttatatattgcgaagagattttttataagttggtgatagatgatttttaattttttggactctctgtatttctacatcttctttgtgggaaattcttcaaactccatgggggcttggtgacccagcctgatggtatcgtccatccttgcagcagtgggtggcccctctgtgctgggctctgtggaaggcgcagatagacaggaggctgcttggccctggggagtttgccgtgcagggggtggtcaaggaccagagaaggtggtgtgaagaactggcaatagagagtgggtgtcagtgggccgggacaggcagagcttcaggaagtgacaagtagtctctggggaccggcacatctggacatggacagtcaaaggaagactgggggcacatggggaccaggacacctggacatacacagtcagaaggaagactgggggtcggggtgggacagcatgatgcagagctttggcggctggctgatggagtcgttctcatttgtgaagacactgtccagggctaaggcagtacttgccaaggcaaggccaccgtgatccgagactgggaggcccagaaaagatgcagacaaggtaggagtcggctctgtgtgacttccccatgacaccagtgggccaggctacagtcaccgtttgagtgcccgtggaggattggtttacttagtaaattcgttgtattttaaaagtcagatggaatttgtcttcatattttgctcatgtcagtgaggagatagatgtgtgctgtcacttagcagtgtccactgtctttcttcaaatcaaggccagtgaattttctgattgcaggcacttcaaagccgtcagttccattcattgtttttcaaagtattcatttcattaaacatcccatcagaaagcctctgatagagggtgccctctcatcaggtccgtgtgcaccaggaagtttacagttcagaagtgttgcatgctgagcactctttgtgagatactttgggggctcagggggcttggagtttatttgttgggggaagcaatgttggtagggggtgggggttgcaccttgaggtttctaggccagcccaggacggtgtgcggccccaagccactaacacagcactcctagtgttcctcacagcaggtggaaaatgcatttataagatatttcttcctcggaatttttaagtgattttacttctattggatgctgttgatagcctcattcttctcaggtccacctgtcggtaggcccagtagtcaactcctaactaatagagtagttattagctggttagttgtctgcagctaagcaggaatgggactggatggtggggactcctgtgagaatgctgatgggtgccgcctcctcacctgtgtgtcgcaggtgtaggcgatacctgggaagccgttgtacggggctggcatttgctasttttataagatgtcacaagcatgacccaggagcacaccccatgagagtcacagtggtaccagcacctgctggctgctctctgcactgatgacagctgttagggaatcacattcgagactttaactagattggtccagagtgcttcactcttcttctttaaaaaaaaaaaaaaaaacagtaaacgttcttttttagagcagttttaggtcacggcaaagttgagcagaaggacacccacagcctccgccattgtcccccacagtctgttgcagccgatgagcctgcactgacagcactgtcaccctcagtccatctgtactttagggttcactgttggagtgtgttctgtgaatctggacaaatgtataatgagctgtatccaccactgcggtgtataggatcataagaaacagtttcactrccctaaaaatcctgtggtccacctcttcatttcccccaccgcctgaaatcacagatctttttactgcctctatagtttttcctttgccaggatgccatagagttggaatgatagaggtgtaaccttttcagattggcttatatcactaatatgcatttaagctttctccatgtctttccatggctcagtagctcatttctttccagtgctgagtaatattccattgcctggatgtaccatggtgtgtttatccattcacctattgaaagacatcttgggtgcttccaactttttgcaattatgattaatgctgctaatacacatttgggtgcaggtttttgtgtggacctaagttttcagctcatttgtgtaaataccaaagaacatgattgctagattgtatggtaagaatgttttcagttttgcaggaaactgccaaacagtcttccagagtagctgtaccactttttatttccaccagcaatggatgagagtttctgtttctccacatcctgtcagcacttggtgttgtcagtgttagactttggccattctaatgtgtgtatagtggtatcccctggtcattttcatttgcagttacctaatgacatataatgtggagcatcttttcatgtgtttatttgccatctgtaggtcgtctttggtgaggtttctgttcagatcttctgctcattttttaattgagttgttcactttcttattgttgattttaagggttctttgtatgttttggataatattccttttcagatgtgttttttatagatattttctcccagtctgtagcttgtcttctcgttttcttgatctttcttcttttccctcctaataattgttctccttcaaggttctccagcttattgatatgttgtttaggtaggtcttgggcttcattttgcctgtaacatatcattagcattttccttacagtttgataaaattaatttcaacaatttctacactgtgaaaccttctgagtgagcacatcctcaaaatcatcaactcttccgatgagataattgcttaggagcatatacagttcttaaaagcacttttatacattgtatgaaatgtagaatgggtgacattttataagttatatattgtagacattctagacttcattgcagctaataagcatccaggaatctgtgaagttcttatgaatgataattctccccatcctgtgtcagtgctaataacatctgtaattaacagctagggaagtcgttgcctgttggcagctgtgcttattggctgaagtgaccacgtgcaaaccaagcctggctgagccttgggagtgaagggatgttcaaacccacagactagaaggcaggtgggcagctggcacccagatcccatggatcaataccatgtgtgtgagagagagggtgggagagcctagctgccagaaggaggctggtctctcccctgcttcatgagtgtacaacaggagactggcagccccaaagcagctagtatcctctgccactgccctgaccgaggaccagggcctttggctctgagactgtgtgacatctgatggccagggcatgtacatcatcacaaggaaacaagacctggagggggccggtgagccagggagcatggtagaagagacaagccggagagcagctggctctggaggggcactggcaggacccgagggtgcaggcagcaagcaggctgttgggtgctgcaggcgctctccattggagcagtgctgtggaagcaccgtcggcctgccgccgtgctgagtgatgccagggccacgrcagaggctggcgtaggcacgggagcgggaccacacgtggccaaatgagcaggaaggaagggacagggcaggattattttagaaacttagaaaaatcatacctgcttgctgtagcaaaattagaagatgtacatggacaaaaacgtagaagtcaccccttaatgccagtactccaggatgaaagtggttatccccatagtttgcacccctgttcaagttcactctctctgaaacacctaaaccacccacccccactctccaaggccctcatgctcaccttgactctcctcatcrccccgccccctcctcagagtgcttgctaatgtcactctggatcccacctatcctggcttccatgtgggtagaaatcttgacttttcgttacagtgaatgtcataaaaggtgctcaagaaatatatcccgaatgaatgaatggaacaataactggtaaacctttaaagatatttatcaaatgggatcccactacaaatatggttataaaatgggatcacacacttatatgtgtgcatgtttatgaatacatgtgtataactgaaacaaatgttctatgaaatgatcctaagtgcatctcactccaatcctccaatctggttttttttttttttttttttaaagctctggttgcagctcactaaagtaatttcatgacccactaattatctcacatattttgtaaaactcacattttttttgtaaaaaaaaaaaaagccagtagcagcactggctctttgtccagtattgacatgttaactgtcatcctagttgagccagccccctccatgtaggccagtctggcgaaatccagtgctgtgtctctatgcagtccacgggcacactgagttctcatttgcccggttggaacagctgatggttagttctcagcgtgatcaccgtggtcagatgggcgccccatrtggtgccttgtgggagaaaagttccaggttttctttagctacttccacaggtacacagaggtgtgctggccatggggtttgtgtctctgcatgttcttccgcatagtatgaggtgcaggcttttatttcatagggacacaccagtgtcagacagaacatggggacaagatcacactgcagattcagatatgccttctgtcctttcaaagggtgtatcctggttcatcctctgtccctgcctgctggaataactgcttcccccgctgcgtcctgtcctcgtgcacccacccaggccacagagcccggtctgtgagcagcaggagggcagagccctgtcctcctctgcagcataacccataattatggctcttaatttacatattccatgcctgccttgagaaaatattttacctggaatgtcagttttttgggtaccatccactggagttcacattcattttcaccagttgttcacttagcagaccattagaaaggaggtccctgcgaggtccccgtgagaggataggaaaatgccatttaaataaaaggtcagcaagagcgagagtctccgaagttagacaggcatccggagaaaggtggatgtggaaagtgaggttgacttctgggcgcatgtgtggaatatccagkcccttagaggctcgggtckagtggtggaggatgaggcccctctgccatagggagagcctgtcttaatcacgccacgcaggtggaacagactctatgcagaaaacttgcggaagcattttgctaacatcacgagaacatgtgattcgttagttggagtggacaggaatgacttcagaaaccagagcagggagtctcgcttaaagtcttggcatcctcgcccctcggcctcacacctcccccgttcccgattctctacttttgctctccccgattgcacagtagcctcactggatggacaggtgccctcagtgtgttccccgggcatgcgtttcccacgctgagctcagaggtagctttcagtaagtgccagctggattttgtcactccttcagttgcaatcttcagtggctccccatggcctgcaccaaaatgtttataacccttggaaggtgtcagagcctgtacaccccaaccctggtctggtctcagatagtctccccagagctcccagccatcaactttcttggttttcaaatacacagtgtatcttgtgctgccacacctggcagagaggctcctcagcttggagcgtttttcttccttcatctacgtctgtgttttgtaaacttgtcatcttttcagatgttgctcatgtagcccctctcttgtgtaaccattcttattcatctgaggtgtaagttgcccactgccccaccctgtgggcctcttagcactttgtccattactttgttaaagtagctggcacgttgtgtaagcttttccgaggaggacaaggggttcatatctggctctccatggacactgagttcctggagatggctgggactttggtgcttagccctgtgctgggcactttacaacaaaatcgtgtctccattgcaaaaagtttgtatcatgttaagctttgctcgtgtagtttactaataagtgtgtatcaaagattaaggtagaaagtaatgattttgatactgcttcttagacaaagaaggcggctaacaagagccaaccactgactggagaggctccggctgtcaccgtgattattaatacattgtaatgacattttggggattccgccatattttgtatggttgycagcaaaatgttgacagttgtattgtggttaataaattcawtwagatttataagcattgtttacagaacctgttcgcctgctgaaactctaacagcatctgttccttcttactaattaactgctaattacaaatgagctttgtgtgtttgtcagtataactggctcatgcattttgtaaggaacattaacaaattgatttacatagtggaaaagcaatcaaaagagtaaactgaacagcacaggtctaaagccctttagccggcttttgaatgaagcaaacttttgatggctataaatattgccataaattttccattaccttaattctttggtaaaggtacagcgatcaaaagcaatattgagtgagtaatactcaaattagagcactgcagcaggtggccgggagtgctggtgatggccctgcagaatcctttgggggccgatagaggagaaacaccaacaagtggtcctgtaggaaatgcatccactcccttgtgggaatgctgctgacttttgaaagctgcactcgtgactggggttgcttcagaacccagtcacttaagtacaggttcacactgtgatatcgaagtcagtgtctcagccagcctgctgcaaggcgcttagccgggaagtggaaatctggtgtctgtcacactttttctcctcttgggttctcagatttcaaaccgtgttgatctgtgtcatgcttcagggggcaggcatttaaagttaaccagtttaagtgggtgattccaaaagtccagggctccttcatccactcttctcaaggagcgggagaagatggagacagccctgaagaatcaagttcctggtatgttttctaaagctccctcctcgagatagagaactatgacccaggccagagccacaggggcacagacagaacaggaggaacgggttacactggtgccatttacattcacagttaactttctaggtgattcacaatgcaggtgtaaaactggagatcacaactcaggcagctggatggagagttcaagggttttttgttgggttgggggggttgtgggagagggttgagacggagttttgctcttgttgcccggtctggagtgcagtggcgcaatctcagcttaccgcaacctccgcctccggggttcaagagattctcctgcctcagcctcccaagtagctgggattacaggcatgcaacaccacgcctggctaattttgtatttttagtagagacaggctttctctatgttggtcaggctggtcttgaactcctgacctcaggtgatccgcccacctcggcctcccaaagtgctgggattataggcatgagccactgcacccagccttcaagggtttttttttgaaaggtttaggctaaatatgattaacagcggttacattaaagtaatactgagtactttcctgagagggaacgtttactctaaaggatccagatacacagttgttggcctgagccctgacactgatgttcagggtcagaacagctgggaaggtggggagggctgctaggtccagggccctaagccatggaaggagaccctacttgccagctgtgagcctcaggcaaacccctagacctcttgaacctcagttaactcaggtgcagaatgaggatgatagaacaaccctcttccccagggttgttggtggattaataagatgatggagtctaccagtaaaggaggtggcatataacaacagctcactaaataagttactattgtcatgatctctgtattcctgtgaaagtaaccacatgtaaacactagacattaaaccttattaggtcatagtaactccatatgggaggagagtctcttttctcatcaataaatttattactgttaattccagataaatgttagaaaaaaattaagcttaaaaatagaatagataagggagtacaggctcccttaataaaggctaagagggaatgtcagagccgggggtggtggctcacacctgtagtcccagcactttgggaggctgaggtgggtagatcacctgaggtcaggagtatgagaccagcctggccaccatggtgaaaccccatctttactaaaaacacaaaaaaacttagctgggcgtcgtggtgtgcacatgtagtcccagctacttgggacactgaagcaagagaatcacgtgaacccaagaggcggaggttgcagcgagcagagattgtgccactgcactccagcctgggtggcagagtgagactgtgtccccccacccccccaaaaaaagaaaagagggaatgccagggttactttacaaagctgtagtttgtttaacacatttaattgacaatcaagccatctcacaaatgtaagtaaatggcactattgataaataacaggcttgccattggtgaatattttgcctccaaagtgattttgctaaaagtatgtgtatatacagtttctgtaacatttcatatggtaggaggaagaagaggcactgtgctttctgaagcatttattcctccttagaatttttcccaggggtaagtgttcagaaaatctgawgaattcaaaataatttgctccaaaatattatgatgtgattaactacgtattgtaccagccagcatttactgaccatatgtatgtattagccaccatcagtagttataaaaaggaaattgatttagtgagatacagtctacacttttaaaaactcacaacctagcaagaaagtcaggcttgtctcagtaactgctgtgcagatctgactgtactaggtatgcactagaatgtgccaggggaaccccgaagggatcatttgcttcgctttccatgtgttacatccatccccaaccttctagtattttctacagatgacatttagtgaacagaaagcctctctctctgaccctaattgattaaagactttttttttttaagaagcataaattagaagtgaacacaactttttggacttacaagtgaaaaatccagtgcctaagactttctggtgaaatgttgccgctcgggaatttcagttggaaacataaagccattcattaagctaacgcggrtgtacgtgaggtttattcaagagataaattgctggtgtgttggtgtttagaacatcaactctgtcggatatttcatgtgaccgaggtctgagcatcagaatccatgcccatgccactgctctccccaggggcctgagtctgcatttactgtgaagcaatcttttatggaaaaaacttgcaaaaaatagaatgagtttgaaatagaaagtctgagaacacaaacctgtgcttttccatttaaatatggcacaaggagatcccaaagctgttggaccagtgattttcaaccctggatatgcccacgggtgtgggcgtgcaggcacacatacacacgcacacactccgtccacggagggtcagagtcacactcattgggcctgggtggggcccgggcatctattctctagtgtttcccatttaaaggtgttcatcagaatcacctggagagcttaaaaaagcaaaaagcaagccgggcacagtagctcatgcctctaatctcagcacttcgggaggccaggagctcaaggctgcagtgagctatgatcgcactgctgcactccagcctgggcgacagagcaagaccccatcttaaaaacaaaacgtgatgttggaggagccagactccaggctttgggaaggggctttcctggggagggcagatttgttgagaatccattttcccagcgagttcgtttccacccccttaagaacaaccactttagaagaacattaggcagaggaaaggggctcctacgtgtacctcctttccaggagatgtgggaacaggaggagtacttgccttttcatacatgaaatggttttttatttgcagattatcatttgaaagacattttggtagcctgatttccactcagaaatagatgtcaccaacacaggatgagagactcttataaagaattacgaacttctgttaaaatgagaaagtcaatgaagggaggcagcatacccagaaaaggggaaaattaaaatctgaaataatttatgaggaaaataattttccatctaagagtgtattagctgtttattcaaaacccttgatgggaatgtttgtaatcaggtcatattgtgatcttcccacagcctgtggtttctgtttttcccctcctggccttacagttaggggagttagggcaggttccctccagaggtgacacctgttgacaaccagtctttcatgacagcaagctgctgtccattctgatggcttcagcctctgtgcattctgatggcttcagccgctgtccattctgatggcttcagccgctgtccattctgatggcttcagtggacattgcagtgaccattaaagtaaagtggcttagagacataacacggcgacatttatgtaggggcagagaagacaaggctgttcctctccttgttctcacctttgcccagaaagtgttagaaacagcctcttccttagcctccttttctatacttctccctttagaagccatgcactgtggtgggtcagatctcaatactcgtgggtccgtgttgtcctagcggtaccatgttgtacttcagaagggccatgctggctgcagaatggaggctgttggagggcaggagcccaggcaggaggtggtcggtagagcagcattcccagrgagagcctggtgggctctcagagttgggggctgcaggaatggaaaggagaagacatatctggaggctttcggaaagtagaatagataggaccgatggacaggttgattcgatgtggaggatgaaggagaaagaagagtttttttttttttttataaatgagggacacttgtgctgaaggtatgtatttgggaatcatacagaaatagccattgaagacatgagagagtgtgagatccaggaatttggtgcaatgagagctaaggaccactggtggtcttaggagggacaaaggcagaatccccagaaagcaaacaggaccagagaagcgggaaagaaacttgagagactgttctcctaggagaacaaaaaagaacttgccttttgaaagagggagataaagtaggaaaaggactacagcatgtccattggcttgtgggatggaggggtctttgatgacatcagggaaatgatggagcagaagcggcggcagggctatgaacgatgagcaggagggagccacagcacagcaagtgtagacaccgcctaggagaggcccaactgtgatgctaaagggaggaacaggtctagaagttatcgattcgcttggaataataaatgatacagtggcgaactgttccagaaagaagttaccaacagtcgccgctcactaggaaaccctagagtagacgtacatttgatttaagttagtagcttacgggcctgatgcggtggctcacgactaatccccgcactgtaggaggccaaggcgagtggatcccttgaccccaggagttctataccagcctgggcaacatagtgaggccccatctgtacaacaaataaacagattagccaggcatggtggtgtgcayctgtggtcccagctactctggaggctgaggtagaaggatcacctgagcctagggaggttgaggctgcagtgaactgtgatctcgccactgcactccagtgtgagctgtgagagagcaagaccatgtctgaaaaaagaaaaattgtagcttatcatttagcaattcataaataattacctgtatttgtcaaacacttcgtacatgttaggcattgtaatttggctttatgttatgaatgcatttaattttcaccaagggacgattccttccagacagctctgagtttctgttttccttggttgttgctgagagcataagttatattcctgcctataggctcatccaggccgcatttcctcctgatttcctgtttcctcacccgtatccygctgctctctctcttcccctgaagctctgggaagtcttccctacacgctcattagtgagttaaggaactttgatgtgtctccgtgtttagaagaaatcttgccgtcaccactccatgcagacgctgggatactaaggttttcacctgctgcttcctgcgggatgtcgctcatgtggaggagggcctctcgttggaagcccaggctcactccatggctgcccctctccccagcctgctggcgttgggcttcctccgctcctggtttcttagttctggagcacagactccgtgctctggagcaagagttcttcactgtggttctgtagatagaattcaggggtccgcgaatgtggctggggggaaattcattcgtatttccactgacttcgactgaaagttaacgtttccttcagatatgaatgtaggcaacgatccacagtggtgttttgttagcagaacctgtgactttgccaccctcaaaatcacagacatgttcacagcgcattgccgttgtcccagataattgaataggttgttttctctggtcaccgtttggcaatggaaggtactaggtctgccactgggtctcagtgcattaataaagcagtgtgcttattacccagccacaggcgttgcttatattttggtgactgtattttgatatgattggttcttttgtaatcctatgaatttaaacctaatactttgagaagggatcctttgggacgtgccaaaaaagacccacctgtagcaagcctccatgtggatttgagtttcttaccctatgaattctataaactgaagttttcatcccatgtgtcaggtttgttttttttgttttgttttgtttttttgagatggagtctcactctgtcacccaggcccgagtgcagtggcacggtcttggttcactgcaacctctgcctcccaggttcaagtgattcttctgcctcagcctcccgactagctgggattataggcatgtgccaccatgcccagctaattttgtatttttggtagagatggggtttcaccatgttaggcaggatggtcttgaactcctgacctcaggtgatcggcccgcctcggcctcccaaagtgctggagttacaggcgttagctgccgtgcccggcccgtgtgagatttgatgtgaagttgaggacacgggtcttcataatgaaacagaagtgctcattgtcctgttgccacccttgtcggtttttcaccctgcagccctttgagaccaaatctgcctgtgaagtcgctgttcatccctgcaggctccctgtacccccagctcccagaacccatcaccagccctccttcttagaagagtggtcttcgggaggacctgagcttcggctgcggccttccagccccctgggtctcactgcttgctgcctcccctttctcacccacacaattctttccttccctccctctgtcccacgctgtgtccctttctcttcctttctttgagttcatttcagaattcctcctcggtgtctgcttattgcatggcacggtctggttgggccccactttcttcctggaaaggtattttctggggccagggagcaatgttaccatttccagaaaagcagtccagctcctcctgcacagcactctttctgctgtgggatgcctccgcctcccttcgttccccatttgcagcctctaggtgccctgtcttggccagcagcacttgccttctcttccccatcatctgtggtctttctgcacctgggctcccctccgccctgcatctgagatctctgttttaaggccagctctccctagatgtgtagccactgggatctttttcatctcatcagcctagctcccggcaggacctccccactggacttttccaagatgtcagtggacagcatagagctggggtgccagtggccaccatcgggagtcactgccacattttcttttccttttgtgtccacacttggcacagaatcttcttccaggcagcctcctgggccgccagtggtgtggagctggccgagaaaggagcctgcttcccagcatggcctcacattgtsatcagtgtcactcaggaccttgcccgctgccccagctcagagcttgaacctctccctcttggaatctggcaggagtccccaaaggaccacccaggctcagtcttggccccattgagtctgtcctccccactgctaatgaagtctttcctgctgaaagccttctgggccatccattgtctgcctgtgagagtcctcggcttgcccccacaggcctcccctgccggtctggagctcagctagtggctctcatctccactccctgtccatcttgaatgttctaaacaacgaattaaaatgtttaacttgaatgcaggagccaggcaggtacttgtcatgagtgggtttggagggggcaagggtctgggtgaacagggagggcagctcccacccacaggggcagccgtccctcacttgcgccctcctcagcctcagtggcctcgtgttcccggatggtcctggtgttgaaggaaagccaggaatttggatttgcatataaaattttatcatttttaaatgttggcaactgattccaaaaatctattatgcacttttgggggctgatgaaaatgcttctgcagactagaaatagtccccaagtcaccaagatggcatctctgcattaaacccaccccctgaccttcccacgaagctcctgcagcttggcacggcatttaaggctccccctgaccgatgtctgcctccctgtcccagcttctgtctcatccactcccaacacccaagtccctaggcatctgagtggcctcctctccgaacctgggcacacagtgttcttccatccatcactcatccacctggctggtcctgctggtccaagacatagcgttggtgctgtcgccccctcagaagtcttcctggctttcctctccctggcccgagggggtgcctcttttctgtgcctcatcccttcattcccaagatggccttctgtaagacaaacattgtagcacccatcacactgggtaatgataatttattacctttgccgcctcccccactagactctgatttttgtatgagcagcaattatagtttgctgttccttgtccccaggacctattggggtcccggcccagcagtggggctccacatggctgaattgaacagtcaacaaggcagcctcctaacaagtcctgtgtcatcctgtttagccgttcgctcaaacagagaactgtagatggggctgaagcttagtcccaagagccacacatgtcaaggaaatctgggagcagcagcccagccatcccaggatctcacaaaggcccagcagcaagtacaggggagacagccagacccctgcacaggagtctagaggctgagtctgtaactaatccagctcagaccacatgtatggtgtgctcaggggacccccagagcaaaatccaacaccatgctggcttctgggagtgcagattttgcagacatggaagcagaaaatcatatgataccctgagttcctgagtcagcaaacggaatgggggaatgagcattgttcagccagctgggcgaaccctgggcttcctgaggacaccccattcttagctgtggggtcaccactatccaccgacagcccagccggtcgacagcagacctttccttccagttattcctttccttccagttattcctttcctgaccccccccgatctgctttttaatttctcagtgtatgttttctggtataatctgcttgtctttgcctctcggtgacatccacggagtcacccaagtcaccagccgggactattcctgatgtcatctattaaccttctccagctgctccgagatggtcaccaagtccttcttccctttcttcctgagcatctgtcccgtcgtgccctccgaaggagtcatgcatgtggtttggggcctggatgtgtgtttgggcctcctcactggtttccaaccttcagtctgtagccctcagatatgccctccttcctgcacccccagagtggcccctccactcacccttcagctgcagccacagggttgaaatctttcccaggccctccagacctcctggatgaggcttaaattttaaaaatactaaattaaaaaaaaattttaatttcactatattctcaaacttctcaccattgcagttaccatattttactgagattgtatatttagatgtctttttctccataagtcattgagtttgaaagagacatccttgtaaatcatttactggactgttggaaatttcgatctaggactcagaagttacagaagattttaaagaaagtcatttgtaaattcttaccctgaggtttatagacccttgtgaaatgcaaaatggaatgtaagagtttgcatgtacatcttctcagaagaggttctatgggttatttatttattatttatttattgacagaatctcactctgtcacccaggctggagtgcagtggtgcgatgatctcagctgactgcgacctccacctccccagttcaagcgattattctgcctcagcctcctgagtagctgggattacaagcaggcaccgtgatgcctggctaatttttggttttttttttttagtagagacggggttttaccattttggccaggctggtctcaaactcctgacctcaagtgatcatcccacctcagcctgtaaaagtactagtattacaggcgtgacccactgtgcccarcctatttatttattaaataattttttgttgttgtttttagagacaaagcccaggctggagtgcagtggcataatcacagctcactgcagcctctaactcctgggctcaagtgatcctctaaccccagcctccccagtagctaggactacaagcatactccaccatgcctggctttttttgtagagaacagggtctcactatgtgtcccaggctggtctggaactcctggtctcaagcagtcctcctgccttggcctcccaaagtgctgggatgacaggcatgagccactgcgcctggtctggttccacagttttgaagagggcctgtggcctccccctcttccccatcctaagaggttaagagctgtggattgcttgacatgtcccaggttcgacatgttgagcaaaatgctaggagggtggtgcagaggccaccgtggcagtcacacaggtagaccagcaagcactccaagactcagcgactttttgaatatagaggcttaaaggtagaacatctcatgagactttaggtttygagaatgggtgcctgtaagaatggtggtttcattaacagaatagcaaacyaaggaagaaaagatggtttggttcagaaaaaatactgctttagaaaggaaactgggactgaaaaacggccatctttttcatgtatggccattctggcttttgactctatcccaaaatacagaatgctctttctactcactgactcttgctttcaattttgtctaaaagaaaaatgattcacaatgaaaatgatgttgttacacagtgtacatactcaatattaaattcataagtaatgtgaaccacttcataaattatttaggttgaagttcattttgtatagaaaattacatctttgaaaagatatgacagggttaaaatgaatcaagtttatcgtaaaactgttctagccatagtaaattaatctgagtcattttatcaaataagaaacatttttaatattttgactattcatcactcaagcagtacagctggtgttactgaagagatcatttctatttcagtaccgtctgtagatcctgaaacgggcgcctttctgtgcttgtttgccacgacagtggctctcgtacacgacgcctracgtgtatctcatgtgaaggtgcagcccaagccaagctccctggggctccgttttccgtttcttgaccaaggatggcagaatccccaggaagtgctcctgttcctggcttgtgttttacatgatggatcttaccaggcggccttggaagccacttctcacaccagggttataaagtcctatgttttcacagtctggttaatacaatgrggaagaattaaaacctttggcataacaaagcttttggtcagttctataagcaaatgccattcacagcctcctgagtgatacctktttctaggcactgcttggtttctgggtgccctagacagggagtatcccaccggttacactctctgtcactcgccatcatcctgaggatgctgtttccataagccatggctcatacagccgtccccactccaggttaaggtcccttgcctggctcctcacagtgccctgggcatggtcctatcttggcctagctttcactaaactgcatctgtccgtccacctattagagccacctgccagtgttgagcctctttagggattggcctgtgccctcatcactccacccacacccagcacagtacctgggatagagtccatgcaaggtaaatgaataaggaacaaggtcctactcagaggcaaatctcttctttctaacactgggagctattcagctgcctgtaccatatcagaacatgcttaagaaaaagagggaaataattattgtctcaacaaagatttgggtttagcaaaaactggaaataattcacagtgaaactaataatccattgattgtgatgtccatggtgagatcattactctcgagaataatactggtaatttagtttgctcggaaggtactattttcagagtacttttacattttccaaaccctgctgtgtgtgttgaaatgtaaatcacacagcacccagataaccagatgattttcctcgtccttttaacagaaagatcaggtgagaacacacagttgcaccttgatcatttagtgctttaacttttccccccagctagtaagtatttgaggagtttctctcatttgggctctgaatgcttttctgatagtggggaaggttttaggaattgtattcggggctgctttgttgttgctccttcctgcccatctcagtgttaagggttgtcagtatcccaagactgatttccctgtccgtccgtgtgctttggaggtatcctggccatgttgttccttaaagctctaagtagaaatgactttgttccttggcactatgttaaattggctggttaattctggtgttatttaccctgtaattcattagtttcaccccaccattggcagctgacaggctgtaatttcacgccttgcaataaaagatgtctcataatctgcttcatttagcagcaagagaatttaatgaaattaactgcagtcctaattatgccagtgaatactaaagaccgccatcaagttttctcagaaaaggacgaggtccaactcgtgaaggatttagaatataatttcctgggaaaagttgcaagtgtcttccttctattggccaacgagggccaattatgagtacacatattactataattaactggtttttttgtgaatgtctctccaagtattcattgttcgaaatcaaatgtaaaagtgatttctctatcggagtggtgtagatgatagaaacaagctaatgttaagttttcaggcagtgacctctcctcctgcagtggaggacaggtttgcaaaacatcacagtttgagagcaggttttcatgtgtgactctggagggtttctggagtgagcagaagcccgggcccccttatgcctgtacgctcagagctcagcctctgcagccacgacttctccatgctgcggggatgctaggcctraagggttgccacctgctgggcatggagtgtccagcctcacccagcccctcgcctggcccttctcccttcctcatggccgctagggcaagccctcacttctccaggacagatggcctttcccygctccaccgtccactctgcttcccgcccctggaggggaggaagacgagcatggtctgggcgcccagtgctcctgtccccatctcacacatgtgtggaacaagccactcacaccctgacrtgctcccctctccctctcaccacgactctttcttggtcctgcctttctcacttttccctctcagccttcttcatagcctcttcctcttccatggaggacagggcagaggaaaggtagggaggagcattgatgcctcctgagcaggtctggcctggcacctgcctttcccacccaccccacggtgtcctggccccagggctctgcagcccacagcacctcttaacagtgctgtggacaaattccggcaaaccgtgggttagtaaccggacgacgttagcaaacacagaggctgcagttgagccaaaggaatggagattctggaaggaagatgtgcgtgttccaactctgcagaaaagcagctgaagcagtgggaggtggtctgttatatctaaatgcaatggaaatctccatagccacaagtgactggcctctacctctcttccaatcttgctctactaatgcgtggcctttctgtagttctgaaaggagccatctcccctggggcagtgcctgatgtggtctccttggtccccttggtcctagcacctctgcattatgcaccctggcaggacatcagccggctggctctgccaccccgcattagtgtccatgcaccttggtggagaagtcrctctgagcagctctgatttcagaggcctcacttgggaaatgagggtgcggtgttgcttcttggtttcctaaggctgctggcaggtagggctttacaaagaagtactttaggacattttggaatgagctgttgtgtattctcacaaaaatagctgcttttgcaaaaagttttcctgtttctagtcacccttcgtctttatgccatcccatcattgggggtggtgacttcacacacatttgagatttgaaagcatgatgactgtacttcaaagttggggaattccatggcccaccccacaacccactcatgtcaagtgcattccagggagcaatgggtttccaggtccaagtccatctgggggattgtggtctgtggtgggcaggggctgactaacctgcccaaggggtttagcaagggaatggctgttccgggacctggcccagcatcctcccactgtacacagcctccctgcacaacctacagagggggctcccaggcaggctgttcatggggttggtgttcacaggactctcccacaggaagggcgctgagctgcaaaggatccaggagacctggtttctaggcacagcccagtgttagccttggacacagcagccagtgttaccaggacctctgagctcacagcctggcctagagtgcaaggagccagtggacctgagagggccctgtccaggctgtcagtgctgaatatagaccatcggtgcccacctggcgctcctgctgctcggtcggagctgggagggaaacgtggctccactacagacatggggtttgggctgggaggccatggaatggtgaagatgctaagcaaggccatctcctgggaagggcagaagcagcttggccccaggtgtccgcatgtcaccccctttccctaaacttcacccgtccgccaacgcaccatgtgccgcaggcgagtgatgggaaaatggccctcgtttcagagaattttttttttaaagcaaagtgtattgtgtgttcttgcagttacttgctaccaatgtcccttgggtatctccccccttggagtgtttgcagccggcgagcgccaggatgcccgcggcagcatactctaggcttatctccgtgtgtgtggccctgaacccagaacacccggaaatacaagtgcaagtgcaaggagcccatgaacagaaagaagaagaaggggacggggaagcgcctcttgactgctcgccataaaaataattgagctgaaattaaatctgggggctttggtagcctcctgttaggaaaagaaataaaacccagtgttttgatgcacacctcgcacgtctcatctgcagtacgccagaggtaattttggcgacaagcagtaaggaaacctgaagtatttctctcccagaccctcccagcttattaaaagaacttatagacatgaaaatacattaaagtgggcaaagcggagagagggtgaaagagattaacaacctccgctgaatagagcccattgatgaaacaggcctgtgagctgctgccgactctgaaacaaggtgccaggaactgaaaagaaggtcaggcctgtccagaatttaggggggaaatggaaatgtatatttaaaactaatatatgcctgagtgctcatttttcccccgtttctgattgggaagatttactcgggaagaggaaaaacggttctgtagccgattacccaatttgagcacccaaattaaaagattcacttaaaatgcagcagagacaagcgaggcagcggagaagggcccgggcgtgcataatgcctattgtctgcgtctgcgtttgctttttaatgccagcgcccagcgagggagcagggccctcctagcgtgcgcggagggggcttggggtggaaaggggggggaaccccgaaacaggccgccttttgacaggcgcctgacaggtatgggtgcctttggagatctttttaggaaattgggtgtttgcgagtacaaattgaagcaagcatgctgtgtgtgtatgtgtgcgagagaaagttagccgtcagtcaagttttatctcttaatgaatagagactgctgaagtaagggttaggtaattgagtttataattaattagccataaccctcatcagataaagcagttgtgaagaattttttttatctcctttctctccccagggcctgcccttctttgtccttgcactgacagccagcacttatctcaggcctgctggagcccgtgccygtcagtcctccccctggccvgggccgaggggtggtcagaccagcccgcattgtgctgaaggcccacaatcagcccagctgtccggggccatgatgaattagcggtgggagttaacatagaggtgaactccagatcggccgatagcttgcaggccgctgctgtttgtcctgacttcagcgcatctctgatagacctttgacaccttccaacaaagaggttacaggagggagagctggagaaatggagcgctcctccagaaagttcggcaactcacaaaagaccccttaatttctatagcgggcaattcagtccacaaaggaaggaaatcaatgagcgtttacgctctttctttgaggaacctttttttaaagaaaaaaacatttactggcgctttgcatgttttgggtacaagcagtggtagaaacataaaacattaaaatccaagattgagcggatctgtcttgactgcgttttatagactggatgagagaaaaacggggtaaaatggctccccctactctgcttcaagatttgaaatatctgactcaggcaggttgagtgaggaattgttttaggaacagggaatgttgtgactttcttagtactgagttggaaataatgtcaacttccttgtgattttagttgttcctttctaattaacccccaggcaggtacagataaatctctcaataccctagggatgcggcagataggaagatgtgagcctttcttttcctcttctacagtcagtgttttataatagatagattaaatggaagttttgtttcttctttgttagcaagactagataccacttttccagaccaccctatggtaattatttggggacttaaggccagaatgttttatcagacaatatgactgaacagtgattttggatgttaatraaaatttaatcagatgaatatattattcagcctcatttagggagtaaagtatgataagtgcatctacaagtgctgaaatttgtagaacaaatgaggtcatttttgtgaagtaggctgagaacagactggtgtgtgtggatgggggaaaggatggtcgctagcttgttttggttttaagtgtaggctataccttgaattaacttgggaagtactgttactagcgacagtccctagtcattcattgcagacttgttgtcagcctcccatgtggagatactagatgccataattgagccatacctaacaattccaagtttttaatgaagcaaatatggtaaatatgtccgttccaggctttctttgagtgtagaaaaaggaagttgatgcgtaggctcatgggatgaccccgccttatatgactggataaaatccaaatactcagctagagagagtggagccgctgtgttgagacaggcactccccctcagcctccccttgtcttcccgggctygtggggtcacctccagcaaacccaatttgaaaaccrgtgatcaagtgttgacaactcctgtcacagctgagaaacttaggccttgttcaaggtcacatggagaaagaatattgcatggagtagaccccgctcctcccccgcatccaactgaacgtgggctgtggtcctgttggctccctatgggcctgctctccttccctctttttctccccgatagatgggacctgtgaggcctgtctctagctcagcttggcatgagatgggccactcctgccagctcacctccctgctggctatttgcccttcatcacagaggtgggggaggatggctgcctcattccagcctcagctgctattgtggctacaaaggcaaagccagctctacagcaggcccatttcagcgcattataggaaaccagaggctttaaacccagaccagcttggagcctggggctgccgcgtccgcttaccagtggtggacttggggatgtttcttactctccgagcttgacttgctttatctgttaagtggcagttgctgatggcagtgaattgtggagtgataggtactgtcatggcacgagctcaaaagtggctgtttcccctggtttcgcttgtttattattagtattattttcatagaggagttaatggagcaaatgagaaacaattctttattcattcttagttttggagtctgcatcctgtacagtgtcctcagaagtgtagatcgtttctgctgcaggagcccaggacgtttggtcagctctgacttcgtcacgtagactttgtgagagggagggtgcttcagaggagggcccgccatgaggtctgcctccttgtatttgttacttctgaaatcttaatgccagttattttaaactagggtgactaatggacccttatttcgtgaaggaacagaaaagtagaaaaggtttaaaggcaaaaaaagctgaaggtatttgtctgtgatgttcaacaaaccagcctcatcaggccccaggtggaaaatcggcgtggtgacgcatgtgctgccatcccttggggtggcgcacggaaatggaagcgtgaggtcatccctgtgatcagtaacaaaagtctacctggaaaatggttactttgattttccagggagtgagtagtgtgacaggcatgtcaaaattaatcatcagtagatttattcaaagctaaaagtcaactgaaattctaagctctctttgctatactacatttaaagataattgctaaagtttctttagatgtccttattcattcagttacagatttatcatttttcaaaccaaattctaaactgtgttacgttcagtatgtttttgaagtcataaaagttgagttatagtaaatttaaaatcgagcaatttctgctttaaatatagggtatcattctttcctttagattcgttgccctgaacttttgattttgatattataaatacacagctactcatctcattctcttatctccactgtgctgggaagaccgagaggctgagcagcagctccactgaattcaagtcagaggatatttgtttgaattggagactgggtgttggtaaatgggtgacagtgacaagtgggtgattggggacacgtccttgaggctcatgccttagaggaaatgccttgtttaccctatgaggtctctagatgcacggaggctactgcattcccagggggtcagccttgtctcagaagtactgagaatattattattatcattattattattattttcttttgagatggagtctcgctctgtcacccaggctggagtgcaatggcatgatctcggctcactgcaacttctgcctcctgggttcaagtgattctcctacctcggcctctcgagtagctggaactgcaagcatctaccaccacacctggctaatttttgtatttttagtagaggcggggtttcatcatattggccaggctggtcctgaactcctgaccttgtgagccactcgcctcggcctcccaaattgctgggattacaggcgtgagccaccgcacccggccgagaatatttttaaatgttcatctcaagttagcatcactgaagctatagcttcctctctttagtttgttcttgtacccagtgattcacccagaattgtttgggttttccatataagaaaatgtgattcgcttggtgtcagtaaggaagggattctctgactcatagaagcaggggtgtcaccccaaacagcaccatgaggaggatagcctgagtccgatccctctgggttggggctgccatcaggatctgtacattctcatgacctgtgtgcttaaacttgggcccttgaggttcctgtcctttccacatctaagccagcagtagactcaaaccgaaggtccgttaatgtcctcatcagtcgtgagcagctctgtgtggaccatctgcctgtccagtactgaaccagttcctgtgactggggctcattgccttggcctaggccacatgttgacccagagtacacaggccaggatgggaaagggtcacctgcccatgcagagtcacaggtcctggccatgagcacaggagttggatgtaggacaaccaccataaatgtcccttgcccaagttgtcatgaaatttcaaaacttcagccagtgttccctgcttgacactcagacctgaaggcctcctgcaagtgccagccactgtcgtgagctcaggtgtctgagagcacgcttggttcccacgctgcggtccggttggacgtggtagatgtgagaccagtgcctgaaagaatgccgctgtagggaaacatgaagacacacacactcagccacactgtatttaatgggccgggatttgtgtaagtgatctccatggagacgcaggtggtgagcctgagatgctacactttagagcaggagtcatccactcccrgatggcagcctggtaccagtctgtggcctgttaggaaccgggccacacagcaagaggtgagcggcgagtgagtgagcattactgcctgagcgctgcctcccgtcagatcagcggaggcattagattctcacagaagtgcgaaccctattgagaacggcacatgcaagggatctaggacgcacactccttatgagaatctagtgcccgatgatctaaggtggaacagtttcaccctgaaaaccatccctcctccctatccgtggaaaaattgtcttccaggaaactggtccctggtgccaaaaaggttgggggccgctgtcgtagatcctttgacgagcgtccccaaggagacctcagacacaggttcctgccttgcagggtcctgaccccgaccctcccgttgctcacagtgtgwgtgcatgtccgttgagcagcttcccaccctgattgcagctgttcctttttaaacagaacctgcagaagtggatacaccaagaacatggatgcattgcrtgtcacatgtatacattgtctgtttctccacatatacaccataacagaaatgacacagaagagcacctcctcggtttgccaactagcttttgtatagcagcaaattcaaagtcaactagtgatgaggaaagactggaagcagctaataataagcattcttatgtaactgatttgcaagaatgtagtacagtcgtcatttgggaattgactgggtataaagagttttccagtaaaagcgctggaagaaccagagcctgcagaagcaggcctatcgccctgtgccatgttttttgccacactgtctgcccatgttgggagtgtgaggcttatacccagggctgcttcctgggtgatcttgggggattttcatttttctggtacaggactggagagtttaygagatacaccatgacggtacagcatttaatttagtatcaccacttcgggagaatgtgtatcttaattgctaaaatctctaactttgtataaattcaaattgaacataatccagactatatagcaatctttaatgaattccatcatcaacattaccacataaaggaagttaagttgggcrtataaaatcgtaattcagtaaatttttctttagttagtaagcagattagtattcattgctaagatgcattttatcaacggttttggtagcgttagttaaaaaatgtaagaataatgctatagaacatgaacataacatttttagagaagtatatttatcaaactttttagttgcacagtttctaagggctgcttactgattaaaaacatttttacttataaaaagtcagcctgttttatttaagataagacattgagctttcaagttggcaaattgatgggcagaacgtatatatcctgtttgtacatgtttgagtttaagatgcagtaggttagggggaaaatgttttaaaaccatacagaatttaggaaacagaccttttaactaataactgttactgagagatgataaaaaaaaatatgaactagttcacaatgaattatattttgtatgcatgattgtctgtgattattaattgatgtgtacttcctctttgtcaaaagttataatgtatccrtctaccatgaaaggtccctagaacatgaaaggtggtttctctacatgcctgtgaaattgatgagcagggagaggcttactcatattttaatgccagcagtaacagtgctcacacccagagatcaggggcatcaaagttggtggtagcaaggagtatttgccactgtaattgacaaataatacccctcataaatactgccagtcttttcaattagttttcatctaaaattctggctacaaaatgatggcctgtcaactgacaatgaatggcaaaaattaataaattgtcttctaaatagaatggacacttaagaaaaattgggcagccaatttagcacagcatgaagcaaggggaaccctttgtactggtgccgggcactaatgttgtctcgatctttattaatggtgctcggcggctgctgacagttttgttgctactggcaactttcttcattaaaattaaagccagcatcaaattccattagccgtactctgggcaccttgcattttttttttaatacatattgtttcttttgttaactccctctccacccataagaagttgtcagagaagttaaatggaaggaattgtttgctaaggccagagaaccattcactgttgttgtggggaaatggccattactggcccggtgagaacccccatcctgaaatctgcaactctccccccacaacctccccccccccccccgccttttgttccatcccctttcaaaatgggagcatattacctctaaaaacgacacactattttggatctgcagctttcagataggaacgactaattggtatgaggccttctagtttcttattttttctgagcagttttttttttttttaaagttcctgcttcccttttctaactgtatttccatagctgactataccttaacacaatagtaactcaatgctcagagagactcgcatttgtccggaaggccttagagttattttcccgaaggcattacttttatctgtagaacaaatttcaacctttgaaggaaaaaatcgagctttgctgaataagttctgaactattgtctgaaaagccgttgcctgcccttcacagcactgtgtacagttcaaaaggctctgaaatgcctccgccctggagctgctcctctttcgccagcaagaggcaacaaacagctctgattctaggacaactcagttcttggctgtgcgcagcgccttccaccagcaagcagaggttgtatggccactgcgaatgtctcttgtaaaggaactaggctgggatcaccatccccatgggttaccttcccctcccagcccagtctcataattgctttcttctgtcctcagtaatgctaagtttaggggctaaaccttcatctcagtttgttttcttcttctcctcctcctcctccttttaacttgtatcttacactgaaagaaacacaaatactcattaaaacagtgaaaagatagttgtcaagcaacaaaggaaagggcataccagaaaacatacactgagaaataaaaaatataactttatctctgagcatcctagcactcaaggcaaaaaggaagataataatgctgagctctgctggaagtcattacgtaagtgcgttcggtatttcctttaactgttctaacttgaaaccataattataattaccttttttttttgcctcaaggagatggcttatggattgaatatgaggattacctttttctaactgcgcagctttctagtcaccactgtctccccataccttccagtctcacatcacagatacgtattttattaatggtatctaggatagtgttaacaggagtctaacaaatccagtattgtccttgtgaatcttattctcatttgtggaatttctcaaaaatacagcaactgactgagattccaaacrgctcacaattaaagacagtacaatgttttgctttacagagaagtrgcagtagtacagattctgtttttttgtaataaatgtttctgacattttaatagtgaagtaaattaatcaaataattgcaggaagattctgctattcagccgttcttttttgagtaatcttaaataattaaaggaagaacaacatgccaaatgatggttcaattarcatgtataaaaataaatatttaccaagactgcattatttgccaaaacggagatgtgcaattatttaatattgttgatggggcccataaaacaaatagtaccaaatctctccctgtgtacggccgtcagcctccaagggctgttctcccactgcagacacccctcctcttaccaccacaatatctgaaccaggcaaggagacaattgttacttgatgactgagcccactaatatgttacaggaaatggggcatgaaatgcaatactttatatatagtatgtactgtgtgagtcttccattgaaacaaggccatttttagcttgctgatacaatatttgcagtggttcatcattcgattgtcctgattaacaatcaacttctataggggaccatttgagtagtttttttaaatgtgatgaatcagaggatttgttcaacatcacttcatcctcttctttaaatggtaattggcacttgggaacttgggagtgaaataaggtgtggtctgttctatgtggtcatttccagaagtgccgttttgaccactgctgtgcctttcatccagatttttgcaactggtaaaggtgtcacaggcaccattgaaatctactccctcrtcagggaacacactcttgttgatagcaacagcatgcaatctctgttacagcctctaagttggaacagagaaggctttcstagaggacatttggtgkaaatgaaacacatccaagctgtcccacgttaactgtcacctctgtcacccacatgcactacctatgtttagcagggcagcctctgcctgtgatttgcagggagcgcatgctgacagctctcttccctctccttagttccaggaaggtccaggcagttgaactgactgcttgtctgtagaaagacccactgtgtccctgggggactggtaggtaccctgattcctgcttatcaggggattgattctgggcatgacccttcaccttctctgtgcatatctgtatcttacctccatctggtcactagttccagtaacttggcatttccttaaatgaaacattaacatctgtagaaaagatctctctgacatgttagatgtaacatgagttaaaaagtcccatttgggaggaagagaaccattggggaccctgccccgtggggttcctgagtgtcctgggcacctttgcttgagctcattcttttcgtcagagatcaaaaccaggagtgcctccttcagcttgtactaccggatggcttagcacctggcgagtgagtgtctcagaaagraaactgcaggagtgcattagaccactcaggggccctgctgtcctgggtgttcatccatggctccattcatccatggctccgtgcacgtgcagcccgggaccatgactctgattcgatgcactttgttttccagaagcacagtttgtcttctaacttctaatcagttcgggatggtattcaaatttccaagaaattaaattatttgtagtaaggagttattgccagtagcagtggtagcggtccttgtcatcgtcatcaaagtggcggtggtagtaatagcagtataaggaaatatttgtgctgctcgtaatgaaacgtgcacatggaatgtttctggagatcagggccagatgtagggtgcattttccatgcccgttctcatccgtagcagagactgcgtggagtgctgtgttgagaaggcttcggaggctcaggtgttgcagatgccatctgccatcaccatggggtagggcagtgcaaactgcaaactgtcccaggtaccttttagccattcttggtttaagtctttaagactaaaattgacacatggctgtttgtctgcataaacctttttctttctttaatcaggaggaaagtgagtaatccttttcatttctccagtagaacctctagtccatgtctgaattgccttcacagaccatatgcacctctgaacttccgtaatagatgtcaggatcctgagggcagccctgggttgttctttatgcctcttcacatccagggtggtgctgtccactcaccgtgcgtgcattgagactgtttgggttgctttgctctctggtgagatctctgtgtgcatgctttttctaatctcctctgctctgtgtagggcagggcatatgtatgtagttatcataatgggatttggagcccacagacaatgtggcttcccctttactgctcactggttatattaccttgcccaattacttaacctccatgaaactttttaccattcatgagatttgttagaatcattcagtaattcattcatcaaatactttttgaacatttgatatttgccaggttatgggcaagacgggagtggtccctactgtccataagctcatgatgtagcaactaaggagccagatggcaggggcatcccacgtggtctgggaagccctgtcaaatggaaacacagtgccaaccacaatgtgatttccattttgcaggggcaggtacatgagaaaaagtaagaagaaataagtgaatctgaagtttattttaatatgctttatttaacctagtatatccagtgtttgatcattttagcatataatcaatacaagaagttaccttgcgccctacagaaccttcaaaatctggtgtgtagttcacctatatagcacctctcggctgggactggcctcccgtcgagtcctcagttggcacatgtggctgagggtggccctgtgggatggtacaggtacagcctcctctttgagctagggatgatttcagctgaccaggggacagacgctggctggggttagggaggcagtgtgaggtgggcctcctgggcccgaggtcatcgaaggccccggtggggagagcacatggctaactacgggtcgctggccaatgcaaggcagcagcatgggagaaagccctggtgtgaggcgggacacctggtttgcaggctgaggatgtgccacctgtgggacaccaggtagtgatgtctgcagctgtggatgagaccttctaggggaagagttaactcggaaagaaaggaactctgagcattgaagagtcaggtggatgaaaagttgccaggaatggaaaagagaaactagagggaacaagggaagtgtgtcattcaggaactttctgtatttaaaagtgtgtgttggagagaaaggacaaatcttttatgcggaggacttgtaaatattttccatagatataaaagtcgacttcatagcttgcctggtgtgctcggttttgactctatagatctgacttgaatgcgcaagcgggccgttcccacgtgatttaataaacagttgctgtagcatgtgtaatctttgcagtgacaacaatttagggatcattcgctagaataaagcaggagcagcaggttctgattgttcctttttcaggaattcctccctgccatatccatgtgccactgtgtagtcccgtgaactctgcattttcgcagaatgcccccatcatgtgaaggggttcggctcactctgtggccggcctggaggcctgggtgtgcttcctaggcaggcagttggattctgtttaattttctttagctatgggagaaatggagtccatttccagaccatggtaagtgcccgttggttttgtttgcggttctggcctccagggcggtctgggtgggaggaggaggtgggcggccggaaggtggttgagcgtttccgctccactgcgcggccccggagcccccaaacgcaggtcagcatggaggggcagcctgcagaggtgtcaccagcagccattaagtgcagatactgtcgtccctggtgtcgtccctgaaaatcttgtgacagggagagacagagtgaaaggaaagaaaaacgaggcgatcaagagataatattaactagaaaaatcaagaggggatctgtcagtcctggtgggaaaaaaaaacattttgtttttcttagtttccttttccttttcttttctttcctttggatggaggaggtttggtttggtcttagtaccccagcatacagtagcttcattggctttttttctgcccatattcaaaattcctttgattagcatttggttctggttgggacttaataatgctagccagacctaatgtgaaccatacatctcgtcggcattactcatcgtcaacatgggtttttaaaagggaaggagagaaacacaacaaactttttatttctttccctgtcattgttcttggtcttgttattcagtggacgctgtattaaattggattctgtgtccatcattattaaaatgtgaagtgtgtcggtcacaaagcatacatttcggggcagttagctgaataattcttttctttattatcccaaattactgctgagctctggagaggggagcagtttagccaattattgccatttgagctggatttgtgggtgattagctcctggccgaatccagtcccggccggcgctttgaagcctgtgctgtgcgattttctcagcagtgaggtaggaatagacgcggctaatgacaggaaggtcgcgcgggtgagctgacctgtgtgtggcgcagccttgggttccgcaaatagggcacccacagtaacacgtgtggcgccgaccccgccgtgcgcaatcggggctttatacgattgctggagatgctgacagctcaattaaagtgtaaccctttgtgccctgcaacctggcacaacgacagaaatattactcgccggaaaggggagggggtctttggggagctggttaaagatccagaatcggcccctcgcccctttgcccctcccccaactccctccactgtacagaaggagctgcagaaaagcctccatttgtaaaataataggtgctctggaggaggggcagggcgggaaatattactattttaaaaagctcagttaaggggggattcctgctgttcctatggaaacactttaaactagagagaaagttaaaaagatttagtagcggcagagcttgtgtctgctggtcacattttctagtcatctccttttaccaaaatttacctcccagcatcgtggatgtgaatttgccagaagttttccgtttgtggaggactggggaaagccagttaattgggatgtgtttttgcacacaacgaatgatttctatgttatcgatttacttctttcacttaacggcattttctgcagcttgaatgaaagctgtctcgatccatgtatgtctgtgtatctgcggtctggtcatttttgccacacttgatttttttctgctaaaccctacgtcttgcagtatatgggtcactcatccagatttacttgatgctgttttagttaggcagcagcatgcgatgccctgtgcgcatctttatttttggttttagatttttggtggactgctttgatgttttattttctgagactaggagtatctataacttggtgtggttattcttgcaggttgagccgggtgctagctactgatgtgggaatctgggagcccgagccgactcagacagtcctgactccccagaattcccaccgagggagacaatccgtgtgtgtgatcggggtgttctggacttgaggtacctggtagatactcgggggagtgtgtccagtacggaatgggaattgagactccagcaagtggggaagagacagcggaagtccccagtgtgacaccagggcctgtggggcgtatttggtgagactggtgaggtcagcattggaccacctcccatgctgggtgccatcagtgtgctggagggggaagggggagacagcatttctctgtcctagagcagtgcacagcctgttcatgcacctgtgtgtgtgagtcagctcaaactgccataacagaagaccacagactttgtcttaaacagcaaacatttattgtctcccaattctggaggctggaagtcttggatcaaggcctcagtgggattggcttctcctgaagcctctctccttggcttgcagacagccatcttctccctgtgtcttcacgtggtctttctccgtgagtgtctgtgtcctgatcttttctaataaggacaacagtcatattggattagggcccatcctaacagccttattttaacataatttgctctgtaaaggccctgactccaaatagagtcacatcgtgagtgctgggcgttaggatctcaatatctgaattagggagtggagcacaatgcagcccataatagtcatcgtctaagggatgggcgtcggggggtgcttgcttatgcggagcctgtgaccctgcagctcagcatgggaggctaaaggggcgctcaccaggatggccagaggaaggggcaggatgcaagaaggacatttcaggggaaaagaattgaatttgccaatttacattaaagtttctggcctctgattgggtctgcatggtttcctgtcctgtagcagtcttctataaaaggctggagaggaggtatgttaggcttcatgggtcgtgtggtttctcctgaactacctacctctcccagttcagggcaaatgcagccattccaaccaatgaacttgactgtgttccgataaaactttatttacagaaagaggcagaggatcagatttggccgacatgtgggagcttgccggccccagtcccgtaggatccccaacgctaatagtctggatgagggtgcacaggctgtgagagttcctgttaggcgggaaggctctggcccctcgggatcatacaccttatgctggtgctgcagtgtgtgtgtgtgtgtgtgtgtgtgtgtgtgtgtgtgtgcaagtgagggagggtgacccccacaccaagcacacagggccatggattttcactgtcttgggtccaggcctatttctagctaagtgttatctgcagggtatagcttagcataatgagagggcaaaagcaagatgactaagtgttcgttacggaaaagtgggatgtcaggggagcctcagcaggggcatcacctggatgtaccattttccgcatggagctggtgccgtgggggaagaataggtcacagcttgtatgacccgtgtgcttctccagtttccaatgatgacattccatccacccaccacccacccagatgcgcttctctagttttattgaggtcagtttggttcctgtcagccacagttttaatacatgtttatagggggaaaaatcttaattagaataattagaataaaattattaaatgcaaatgtgtgattggtactcacactctttggatctcagttaaaggtgccagcttttctttgacctattttagaacttcatagaaacctttaacaagaacctgttccaaagtgtaatgaatgcaaatcataagacactaaatgagctattaacaatattcactgtaaaaccaccgaagtactcaaacatcactttttttttttttagaagtagaaacatttttgaacttgcatggatgtttttaagccagaaaaaactttttttaaaaaacttggtaattaggaaactattagtgctcctgcagcagcaagaggattcatttgatctcattgcgaaatcacacgtgcaccgtcctttacattcagtcagatgcatgcacggcccccggtgtctgttaaagccgatgaggaatgctgcccgcagagcaaaggcgagtggttgtggacgtgcctgttgataatctgatcttgacatggcgccgcctgcgttgagactgttgctccatcaccccgtaggagcttagccatgaaatgttccctctgtgtaacgatgatccctgtgcgagcagaggccggcaccatttggtccctgagactcaaaacaaagactgatttgcctggttaagacccccagtctctaatgcagtcrataaatctttgttggtaaataattgctatcgagcagagttttaatataaatttatgagtggtgttttatcacagcttggggctgcagcaaacactgagtgatgggtttcagatagcacttacattcatgacattaactttgtaagttatttaaagcttgtacacttaacattgcttttggctttcaatgacctcttgggactagacaaagaatacacatgacgaataaagggattgcagccaaaagacaattctactctttgctccactgtagaaaaggttccttgggcttaaagcaagatgtgcctgcctggaatcctgatattttggttrtaggtcattaaaatcagtctttctgatatgtcagtaaattaggtggtaggaattagatcaacatttgccatttccaagtaacataagaagaataatttgaggtgtcacaaaacatttgaaatttcttgctttacaaacaagttaaaatttgtctggtgggtgaaatggtttgcagggaggcagcatagcagcggggtaacaagtataaacccttggtttgtacctcgaatcttgcgcctgtttcttccccttactgcygtttgggttatctattgctgggtaatgagcccaaattatagtggcttaaaacagtaccattttggccaggtatggtggctcacgcctgtaatcccagcactttggaaggccgaggcaggtggatcacaaggtcaggagattgagaccatcctgaccaacatggtgaaactccatctctactaaaaaaaaaaaaaaaaaaaaaaaaaaaaaaattagccgggcgtgacggcaggtgcctgtaatcccagctactcaggaggctgaggcaggagaatcacttgaacccaggaggtggaggttgcagtgagccaagatcgcgccactgcactccagcctgagcgacagagcgagactccgtctcaaaaataaaaaataaaagtgccaccttattgtttatcatgattctgtgggtcaggagtttgggcagggcatattggggacagtttgtccatgctccacaagatactttcttagggctacagcgtccaagatcatttctttactgatgtatctgatgcctcagcaaaagtggcacagctggctggaggctgacgtgaaaaggtcactggcagtcatctatctgagacctcagttcttcctcaaatagtctcagggtgtctcctctttacttggtctccccagtaggatagtctgacctcttaacaaggctgcgcaggcttcccaggggcgtaaagcaggagtttccaggcctccttcaggctttggccaggagtggcacagcataatttccaccacattctgttggttcaattgagtcagaggacagagtgatcacacaggatatgagcaccacgggggatgagggggctggtttttgtgtgccatcttcggacactagctacttcactctaccctccttcctgcaaagtacccacagcctgtccccagctacccaaagtctcaagccattatggcatccagcccaggcttgaagttcatggccttgtcgtctacaccaggtacacgtggatgaggttccttgcatgtggtcctccccatcggaagaccacgatacgcaggggacaagttatctcacacaccatgcagtggtgactcaggaacaggagaactgcaacagatacccttattctaaaaaggtggagaggctgtaatcccagcactttgggaggctgaggcaggtggatcacctcaggtcaggagttcaagaccagcctagccaacatggcgaaaccctgtctctactaaaaatacaaaattagccaggcatggtggcacatgtgtgtaatcccatctacttcggaggctgaggcaggagaatcacttgaacctgagaggtggaggttgtggtgagctgaggttgcaccattgcactccagcctgggcaacaagagtgaaactccatctggaaaaaaaaaaaaatgatggagagggacaagagacatggaatagtcactgggccataacaattctgaaatccagccagcacatgatgctgattcaccctgctctgggcataagaactgtatattctccccaggaggcatcctccttggcccttggctctgccctctgcctttcccataagaactgacccatgtttgctactatgcagctttctcagcctgcttcctgctgtacttaaagttgagggcccagagaccacttttctttctgaactttctctgtgcattttaatccaagatggtataattcctttaaaaatcttgtgggtatcctttgtgtcaaatcataatctgttccattaaacaaaagctaatgcacagatttctctctctaatccatggatctctaatcagaagggtctgtgaggcattgccttaaaatatttgagttctcaaggaaagggtctgactgccacaccattgaaggggtcctcattctgagatcacagctactggcatccccaggatttgatcttagttctgatgccagttcttactcaagggttttctgctgtcaggagaagctgggaatgagaaactgttttgtgatcagtccagcaaggtttacagttgaaatattttttctaattgtgctggaaaattccctggacctcctctctctcctcccgtatttaacagagccaggagcacttccagcatctggcatggcaatctggtagctaggtgtgcaggctcacgaggcactcttgctatgctacccatccccctgcgtggggtggccgggagggggcaggttgctaattgccctgctggtacctgttctgccggccccatttccatcctaaggtagcattttcctcactgtcctcacaacttccactcatgcttcttacatctctgccagcctcagccaactgcctagttccaaagccactgccatgtgtttttgatttttgttacagcagtacaggatgctaattctgtttttcttacctgttgctgcataaggatccaccctgaaacttcagggtttaagaaaatgatcatttgactgtttcttataacactgtggctgagacctgtggacagagcccagcagggctgayttatctgtcagagcttcccaaggcaccaggtgctgctaggctttctcgagaattaaacccartggagatagtgttattcccactgatgctgttagctaaagtgagtctcgggcagcccagggtcagtgtgggaggatttatttatacagggacaccagtgccacgaagtgtggttcaatgggagccgtctttggagaacagataccacgctggctgtgcatgttgggcaagttacataagcagtctgtttcagtgtccttatccatgaaatgagaatcgtcgtggatatcagttgtgattgcagttgatgaaatatgcagttgtgaatactgagagattggtattcatactctttggaacccagttaaaggtgtcatatcaattcctgtccatgaaatgaggataatcaatgaccatctggttgtcatgcactttcagtgggttaacagttgcaaggcacttagagcagcagcatctggttcagagtgagcccaatattgcatagaaataaaaaaaaaaagttctaaataaatgccgaagccacataggagtcaaagaaagcgttaactgtaattgatgtcttcactgtgacagctggacagcaagaaagaatcttaagcagagatggttttcacatgtacaaaagtggcatctgaaagatggacaaagtatgcatggtgacatgccaccatgccgctggccctgggttatgcagaatcaaaaagacttaggatcacaggggccattggcactcactgacaggaactctcttcctgagcatctcaggcagagccttccggcctctgtcatcttctggccagtaggatcacggcttcatgtcctctaaaagtttcaaatgaactatttttagggttttccattttcttggtccttagagtaggaagtgtgaaagttcggactgattgaacatagaggaggctgtctgcgcgctcagcccagaccagtgggggccaccttagtaccacttcctccctaaggaaagcgacgggccccctgtcttccccgattggtttccatttagctgctgcacatgggggatgctgagtgtgttcagaggggcgtcccatggtcgaactggaacttgctttgggaagagtgtggactaagaaggggcttggcttgtgttgccacatgtgagaagacctctcaatggggcttttgtggtggctccacggtccctgaaagtccccactggctcagtgcagctctggaattaggaaccagccgtgccccaggagggcagaggaccctggctctttccaagggagatcatccaggcagctctcactgctgagacctatggacccctgtccccagggtgcttatgcagagactgcgggaccccaggtggggatcatgcaaaacatttttgtagcagattcagggctgaatggtttaacttctggggtcgctctagactgaaattctctgattcccacttggtacaaacactcttcaaaaatcagtgttcagaattaatttaagccaagaaagaaaaagcatgtttttaatccacaaaagctatttcccgagtctgctcatttgtagtccaattgaacctctgattatgactgctcctctggcctcctgcttctgaagccccagccaacgtcttcactcatcagagagcttctgtctcatcgtacttttgaggaacagccttttaaaattatttaaggagagacaatagagagttttgtagtttttcctattgttttggcaaacttttttttttttaaaggtttacatgtataaatgcagacatggactctctgacgtcaaagatctgtgggcattaaatccacagctggggagtccgggctttcccaggattggggcccttcaaggaagagcaagcctgtgtaataatttggaggcctaagttacccgactgtgggaaggccagtgccgctgtccagtccatgtggaaggaccttgatgtcagtccagaaccacattttcgttttgtttttgagacgaggtcttactttgtcacccagactggagtgcagtggcacaatcacgactcactgcagcctcgacctcctgagctcaggcagttctctcacctcagcttcccgggtagctgggactacaggtgcacacccccacacccggctaatttgtgtatttttttgtagagacggggtttcaacttgttgcccaggctggtctcaaactcctggactcacacagtcccctcgcctccatctcccaaagtgctggggtcacaggcgtgagccatcacgcccagcccagaaccgcattctgttttttgttttgttttgtttttgtttttgttttgagacagggtcttgctctgtcgccaggctggagtgcagtggcgtgatctcagctcactgcaacctctccctccaaccaattgccctacctcagcctcccaagtagctaggtctacaggcgcacaccaccatgcccagctaattttttgcattttactagagacggggtttcaccatgtttaccgggatggtctcgatctcctgaccttgtgatctgccggcctcggcctcccaaagtgctggggttacagatgtragccactgtgcccggcccagaaccacattcttgagctgagctcccgagggtacctggtgatgtagaaggaagttggcttaactgggggcgctgcagcagcttctcagacatggctgccctcatgcctccttggggccagggctgtggttatagttgctgtccatcactctaggtgctttcacctaggcagagcaaccgaagtgcactttgcagggagctaagaggctcggctgctaacrgcagacgggtttgggtgggactggagtgagctcaagattctgtgcaggcctcacttggatcagctgctcctgtccttaggggtcaggacaggacttcgtcatgtttctggctttgccttcatctattctggaaatttcaagagaacctggacatgtgaatgtgaaagagaaggcactcatgtatagaactcattacaaagatagcattactcctagaaccaagataccatgagtgtgtgtgtgcatgtgtgtgtgcgtgtgctcttgcacacgctcatggatcaaggcagaggatgagtttaaaaactggtactaaaataccctcttatcagagaaattgtcaatatcatggccccacatttccattagataggcagtaacctcttgtgaagcggaagcaaactagaaacagctctcccaaacgtgggcaaaaaaagaaactagaactggttgaagactgagttttgggagaagaaccctggaggccaaaggcagtattcctggggtcctgggatggagagagccctgtcaccccctctcccccatctgcccttgctgcaaggaggaggtcagccttgttttataaatgaggtcacttttcaaccttactggtccatggccctgtcctgtttctgtatctgccaaccagagagcaactcccgttgtttgttttcaccttttagaattcctgggactaacaacaattgtaataaaatcgatggtattttaaattgttgggatgaacaagcactttgggttcctgagatcttaggataaaagcccaccgaggtgcgagtctcaccatcgtgctgtctgctgagagatctgattcccagcggaccggccttcctcactcgatgattgtcagggctgagaacccagcacaggtctgtgatgcccacgaggctgtgcggctcagggccaggtcggttttgagtcacgtgcttactgtgtgtcggaacacttgtgctttgaaggctgcgattggacacgtgattcccagcacgtttcctgaggttccgcctgcagcccgggcctgtggtggagtagagcttctctccccagctttcccgggagtgtgtggtctcctgtttcccatctgcatttgcttatgggscgccatgacaccaacacatggagccacttggagacttgtgtgttagttgtgcacagatacctacacttcccactgcccgacagtacgtgcagtgattttgatggctgtttatccggactaatcagacaaaaacatcttccaaaatacattataattgcactagggacttctaaatttttattcaatgggtaaatgtctttttatttcattttaaaaactcaatgcattgtttgtttatatttaacatggattcatttaatgagagttaagtttgaccatataatggaacaaatgttaatttcctcaaaaagtagttgttctatgtcagacccatgaccaagatctccttgctataattagatgacttgtttccagggtaaggggctcacctgcagataattttctcatctccaatagaggtgtgcattgccttctgtatctttacttcattgttctctagcttcctcatttgaaattgcaaatacttgtatctgttgttttcctaaggtgaacatgatgctttttactatcaatttatgtacttttagaaatatttaaaataatttatttttaaaggagaatgaactagtcaacctattaaatgattacgtcatgattttaatgattctcaggaaaaattgtgctgacccttagatgataattcttcaaaatgggattctgattctgtgttggccaagcagattataacccggcccttgcgtgctaaaccttaagtgtcaccatattcacccctaggcttcttcctctctcatggctcctccccagccaccctccgtctcccggacttcctccttgaacgtggaacctcaacggctggcctggccgccttgcctgcctggggcaccagccccccaktgctgtgtggctgataccaaagtcttcttttccctcctggtcaccagctcctgtactctctggctcagtgaatgaccccactgggccacgacaactaaagcctgactttgtgctggccccgccccacctcacccagcaccttgtcccgattttacctccagcgtgtttcttgcatctgcgttctccttgcctgccttccttctcctctcttgcccccaggcgcatccctgatcgttgctgccattctagaccagtctttcccacatttgagtggtgtggaacctttttttttttttttttgagacagagtttcactcttgttgcccagtctggagtgcaatggcgcaatcttggctcactgcaacctctgcctcccgggttcaagcaattcttctgcctcagcytcccaagtagctgggattacaggcatgcaccaccatgctcggctaatttttgtatttttagtagagttggggcttcaccatttggtcaggctggtctcaaactcctgacctcatgatccacccgcctcggcctcccaaagtgctggaattacaggcatgagccaccacgccctgccagagccatttaaaagaacaaaaatctcatgaatccttcaacattgatttaactgttttgataataattatgcagttaggtacaagcagaaaactaagattcagctccttgtctttatagcttttaaatagatataaaagttatatttattaaacatttaaattaataccattaatttactgtgcatttaatgttaaggatgatgatgttttgctgaaacaaaatgayggccatccgtgccaggggttagggatgacggttgcagggcaggctcctttggtgtcagctgcctcgtgacygtatcacgtggtgaccccagtctcttcctttcctgctttcatactgagaaatcgtttcgtgtacagcatgcggtgccttccccgggggttaacttgttctcagagtgagtgatttacatgttgcgtctccctcagcgctgtcccccttagcaccactcatgacctaggaagtcggagatgccaactcgggcagtggaatccagtggtggttttggatcactttttagatagtgattaaaatacactcaaaaatttaaaaattctcttggagaaattatggttccagagaaaatgacaggtttcccttgcatctcaaatttgctcagaccgtctggggatcttgttacatttggattgatccctccccctcttgggtacacccaaccactggtctaaagtgggccacactttgagctggaaagtgcttccgtcttttgccaacttaaaatttgtcctcgccaggggaatctttcctaatgcaaatcagataaccccttcctccctccaccctgcacacctatggcagggcccagacattcaggcacctccagggccaggcaggaagtggggctgagggcagcccgctgatttgagagaagggcccacggtgcccgtggaaacccgagagtgtggcctctgcacactgctgcccctcagggccatattcccatgtcagatggagagtatgggtgctgcggctgctggatcctaagatccataggagggcagggggactccatccaaccccagtgactcttggccagaagtcacaaacaccgcgtgcacgtgcagctggcctgcagcaggttcagtgtaaccagcgttcaatgcaaaaatgtatacctgtggccagtattttaacataagaagccatcacacacaagtccagtgtttctccttctctttgataatcaggaaatctggccacgtgggaccctccagccctgcagggtcgctgtgttgcacaaccccaggggcttgttggtggcagcatgttggcccagtcacgttctgggctaaagtactcctccctgccaagcaggtctgatctctagtttccagcagccctgggcaccccgttcctggaatttgctagtcgggttgagatttcttgtcctgttctcctttccttgaagacactcagggttgaggccttctcaggctgctcctggatttagcaaacagaaaccgcttcctctggagccatgtgcactctcagttaagggaaatatttgctcatctgctctcactccaagctcacattatatttcagtgggaatttgggagtgaagcggagcccctgtccgctcatgttccttgactgaatcagaatgtcttgggaattggggataccctctgtaaactgtggggtgcagcgggaagataaaatgcgagttgtcatgaagtctcacttctctccctgcaagggactcaggtgacagaggtgcctgccagagggatcctgagcagccgccccttggtggttgtgctttggaagggggagctgaagttcaagaccaaaagtgttgggctgggcagtggctgggacacccagaggttctgcgtggggagcaggtcaccgcccatcagtaggaacaggagactttggcagcccagcagcccagtgtcctggcaggagtgaagacggcaggagagctggccctgccacattccgttagctaacaagacacttcccctgtgtaactcagtcctggctttcagggagccatggcttccataacttcgctgcccctgacttgttcctttggggagcaggggacatgactgcacagccgggctgagcatggggtagtgctccagccactgaaagaaaagtgcacctgccccagcccagctagaccacagccatgacatggcaagcggggcagccaagtggctcttggtcgccacagcaattcttgggggggtcagataataaacccaactggggccaaggctggaaggcagaaatatgactcctaagaggccagggtattctgtagtcctgccacttacgcagcatttgaatagtgcctataatccaagattatcccccctggcaagacgtagagtttaagttaagtttacttatttaataagatcttaagtttattgagagttttcctaggatcaaaagaaaatcagcgtaggcctggcacagtggctcactccctgtcatccagcactttctaaagacctaagcgaggcatggtggctcactcccctgttaccccagcacttctgggaagccatggtgggaggattgcttgagcccaggagttcgagaccagcctgggcaagatgatgagaccctgtctctacaaaaaataaaataaaaaattagacagacatggtggcatgtgtgtgtagtcctagctactcggaggaggctggcgcaggagaactgcttgagctggaaagttcaaggttgcagtgagctgtaattgcatcagtacactgcactccaacctgggcaacagagcgagaccttatctctacaaaaaacagaaataaaaaaattagccgaacaggatggcacacgcctgtagtcccaagctactcaggaggaaggagggaggatcacttgagcccaagagttcaaggccacaaggagctatgatagcatcactgcactcyggcctttttttttttttttttttaaagttttaattcagcctaatttagttcctcagaaagctataaaatgatgtcttcacatgcctcccgattagactgtttccccctttttccttaacaaataagtcctcktagccttcactgggggcaggacaattttgaggatgtgatttcctcacgaaagtacctcccacacgccagccagaagagtggtgcaaatccatccgcatggagccccgagggtgtgcgccgtggccagcatttgtctgagtgggaagggatgaagctttctgaatgaagcctggagcatctgtaatctcctggtgacaccagagaccgtggccctggcattgttgaaattccatctgaaatgaatgacggaaaaatgggagcccactggagaacttgagtgagggcgaggtgggtggatcacctgaggtcagcagttcaagaccagcctggctaacatggtgaaaccccatttctactaaaaatacaaaaaaaaaaaaaaattagccaggcatggtggcatttgcctgtaatcccagctactctggaggctgaggcaggagaatcacttgaacctgggaggcggagcttgcagtgagctgagatcacgccactgcactgcagcctgggcgacagagcgagactccgtctcaaaaaaaaaaaaaacaaaaaaagaacttgagtgaggctttgttatgctaagttttaaaatccacgggaatcccactgaagaggggtctctcatgagttgaagcaattgcttgtttattaccgcatcgctgatggtgactgcccttctctaattcctgccatgcaaggaagcccttattgtcttggtttgcaacttagtagcattttcctgtgggcttcattgggttgattggtctcagttccatatttggtgtatagcgatttagattccaagaaatcaaggtatgccacattttgccacgtttccgttaataagaacttgcaaagaaatcgtcttctaaagtcgtttcaaactcaaatattttcccttaagcaacaatgtctaatggtgattgcagccccaagctggctcatactttattaagtttgtgaaacttggttacgatctagtaaataaaaaacagtattgtcacagtattggtaattaattggacttgaactcaattatatcccataataattattcattcttatgttgtaattcttgaaagatagcagaatttaggaggtcgatggaggctgggaaaagttctgaaggtgactcgtggggcatctcggctttctcaaagcgtcttcttgtatttcaaaactcataactttccttctgcctcagtccaggtgaattaactagcctgagtcttacgctctctcagtcatattaaggttacataagtttataaaagggtaggagaagaggaagtaaagagattgttccatttttcttggttaacatgggccagagttagatgagaagggaggaagacagagacagagactcccgatgtgaacgctgccattgaaagggactgagctggacaggcatggagcccaggctgagcaggagagaatcccagctcaaggtgtggggcctgcccaagctcagtgttggccgtcagcttccttaacaaagggaaacctgtcaaggtagagcaaggtttgctgggaattggtgttaaaacaagaagaaattctsaaccaccatttaagaagactggattaaacatgacttcaaaaatgtgttggtttcaaattctgagtggttttcaaggaggcttaatatgatttcattaaaaatgaattagagtaaattacatgggattcatctattaaatactgttactgaaatttgccagtggaattttggttttaataaaaaatctgaaatgaaggaaactgtaaaaaaattcttctttacaaatataaggtgagaatacagttaatgcagtttgggtttttctggggtttttttgtggtttttgttttgttttgttttggtgggtttttttgtgtttggttgtttttgtttttgttctttttggctacaaggtgtgttttattttcattattcatagaaataattttctataatgtcctggggcaaaccagagaatttggcaatctgattgggggtggtccttcagagacccacaggccagtggcatcggtgcagagtgcccaggttcacaatgcagcttgtggcttgtgtccatcttgcaggtcgctcttcctccacatcacaactggggtcttaaggatgacgagggcaggaaatcctccgggctcttaggaaatttcactccgcttctgcccagtggtctctttggtcggcagggtgttcttctcctgcgtctccgttttcttcagcttggccctattgaagctggcgattccccccacgtctggtttgtctgccattttcttaaaacaatcggtaccatccgtggcgggctcttagctcactgcaacactctgcctcctgggttcaagcaattcccctgctcagcctccccgagtagctgggattataggtgcccaccactgcgtccagctaatttttgtatttttagtagagacagggtttcaccaatattggccatggttggccaggctggcctcaaactcctgacctcaggtgatctgcccacctcggcctcccaaagtkctgggattacaggmgtgagccaccgtgcccggcctggttaatgcagtttttttagtttgttctttctttttctctttgtctctcctctctctttctttcactcgctttgtcacccaggctggagtacggtggtacaatcatagctcactgccacctcaacctcctgggctcaagagatcctcccacctcaaccccccacgtaactgggattacagaagcacaccaccgtgcccagctaattttatttatttatttatttttttagagatgggggtgtcagcatcttacccaggctggtctcgaactcttgggctcaaacgatccttacaccgtgcccagcctggggtttctttctttaaaacattatacctttaggtgtttcctgtgtgtttagcagttaattatccaaaagatctagtgtagcacgtctcaatgtgtttgtgtcgtatttgttgaactaatggcatatcttttagcattcgccagtatcacagagtgaagttctgcacacacacagaacttgaatgtatatgttgcctgtgtacctgccttttcttttttttatttacattagaatttctrtttggctctttttcccttgtagggcatgctgttgaagcgaagtggcaaatcgttgaataaagagtggaaaaagaaatatgtcaccctgtgtgacaatggcgtgctgacctatcatcccagtttacatgtgagtatagccccctcggagcaattaacagctgcagacctcaactaaacactgtggggaaggggaacctaccagcagcccagcctcttgtctctgtttgaagtgaaagtcgtatttggtctcctgctcaactgtgagataaataaccctgttcctcacactccactagaccatatgtctttctctctcttcccctccctaccagtcaatctgtggctttccaattctacaaagaattacaataaaaggcacagatgaagtaaaattttagatgagagtaaaaagacaggggcaaggagaaaagagaaaggagagaagagtggtctatctgaaaatcgagaatgaaggaaacaattacatttgaacccaggatttagctttgaaaagctgtgaacaataatcagaagtcaaatgcaattcatgactcagcttttattgtcagataacacattccagtgcattaggcaaaagaaactctcctctttgtgttatatgtaagtttrtgttacatataagtttgttatatccgtggtgtataagatagatgtataaacaaaattaactttattcttggggaagaaatgcagacgttctacccattgataaaatataaaaaaatgcagacattctacccttgataaaatttaaagttggggtgttctagtttcatagcaacacattccataactcttacttgatgcagagaartgtgtagattagaatatatggtggaagtcagtcattygattccattgtccctcagtatctatgggggatggattctgggatctgccttgtataccaaaatccatggtggtcgagtcccttatattaaatggcatagtatctgcatataacctgagagtatcatcctctatacttttaagtcatctctagattacttataatatgtaatagaatgtaaattctctgtaaatagttgctatactattgttttttatttgtataatttttcactgttgtattaggttatttttcactgtttttttttttttttttgagaggagtctcactctgtctcccaggctggagtgcagtggcgcgatcctggctcactgcaacctctgcctcctgggttcaggcaattctcctgccttggcctcccaaatagctggaattacaggtgcctgccaccatgcccagctaaatttttttgtgtttttagtagagacgtggtttcaccatgttggccaggctggtcttgaactcctgacctcaagaaatccgcctgcctcggcctcccaaaatgctgggattacaggtttgagccaccgcrcctggccttcttttgaatatttttaatccatagttgattgaatctgcacattcagaatccacagataacaaaaggcaactttatatcactgtgtcaggctagtagtaatagtcacagcagcagcagcagcagcagcavtattttttggtagagactgggtctccctctgttgcccaggctagttttgaattcctggcctcaagcaatctgcctaacctcgccttcccaatgtgctaggattacagtcatgagccatgacacccagccaagctattaatttttaaaattttgaaatgctttgtaaaatggcacagttattgatgagaagttagaaatagcatattgaagaaaattaatatcattcctaaaataccacctagggaacctgacttcacattttagggtgcatactcccggctatttctatgtatatttctcttttccttccacaagcacatggtcactgtgtatacrctgcccacagcctgccttcctcactcatagtagatattttcatgtcaagaaatatacttgtacaccaccatttttaatgattatataatattccactgtgtggatgtgccttcattgatcccacggtatctgaaaaatgaaccttggcagataaatttactttcagttttttcactgtcataaagaactctaatcaacgttcctctgtttatctctctgtccccttgtccaatttgcctaggatacattcctagcrattggcttcctgcgttgaagagtcgcatgtgctttcatggtttttgctgtattttgtcaaattcccagaaaggttgtatcagtttatctcatctggcagtgtataagagagccttttctctgccctctcaagaacatttaccttcagaaagaagagcttttcctaatatgataggtagcacatgggaaccttgatgctgagttcgcttgctggcgtcttgagttgcccttgtctccttgtcttttagcgtagctatacctttcagaaccacgcagcaaagcaggtcttccgtcggcatctctcactggtttctgttgttactgaaagcacctcccatgcgttactattcagtgggattcgagatgcagatatggatagattcttacatagatattctttattgyagtaaggaaattcctttgtgctcagtgtcctgctagtttagttttggaatatagtcagactggttctccagggggccttcagatcgaagagatgtaatacccattccatgacgcccacctgggaccaggttggcatctctccaggactgccccatgtaggtctccagttctgcagccctctccacacccagcttccatccatcagaacaacagcgaggcaccaggtcttccctggattctctctgcaaagttgctccatcagcagtggccgggctgccctgttactggcttagctcctcctatggaccctgtcagagagcagaggtctaactattgaaccagtcgctttatgtaagttagagaagtgcaatcaaaatatcattcttggtaagactcactgaccagtaaaaagtgagagctgatggatgatacatttccagtcaacatatgctcactgctgagctcaggctcagtcgaagggatgtttgctgcttcttgccaaggggcagatatggtaacaacgatatgtatcagaagattcccttaggaggcctaaagcctgtttgcttttcatccaatcccttgagtatataatcacaaccagttcttcaaaaattctcctatccacaggcttttttttgtgatgtccctcagtgtttgccaattccatcctttctccttcattcataagtatgcatgaatcttactggagtacggaagaggggcgcaatggggctttgttgtataattgtatagcaagcaagagccaatgtcattttcaaatgcaatccttttaatgccagtctccttggaactgamatttttgatgcaggtacgtagttccctatggaaggggcttaatccaggaatggatttgaatcactagagcctgaagagatggcatgaccttccacgtaatccttcatgggtttcattttcacagccaagcattggataaaagtgtggagaggcagtgacttccaggtgtattctctgacaggtgcatacgagtccgttctgttgtgacttgttaggggaagtgctgacccacaccagctgagttagtctggtggtcttggttcamaatgggaagaggcattcaatgggacacccacgagccgaatccagattttccttcataagaaacttgagaatgtgcaaatgtgttgctagttcaggtcccaaaattttacaccgtgagagtgacccagttatctcagtctggaaaatttcaaaagatcgtagaaccagatgatctcagttaaacacggaccatrctgtgacacccacatccttggctatctccaggatgtattacggcagaaggaccactgagagtcattggccacatgcagtggtggcataagtggtcaagtgttgggaaagctgccaggattgctggtgtttgggtttcagagtcattattgttgctcctaactctattactgaccacagcgtgaagtggggcctctccctggtaacaccctattgtctgaacatgggaacctgcctccttttctctcctctgggattcaggcccatgtccagcctctgtagacctatatcaagtcattaaaagtagatgttaacctgtcagtggaccagaataactccctgttttacactagaggaaaatgttatctggtttctgagaacactattctcatccaccttttctctcaaaggcagatggggcccaggttccaacacaagagcccccggagcaggggcctgcattgatctcatatagcatagcctacagcccgttcttttccacagagcccaggaaaaaaaatcccggccaaaccatcagatatttttagttttctacaaagatgtaaacgggtatcaatagtgaggttgctgcaccgattcctggtgtataccactaatttaagaagcccaggtaattagtggactaaaaaggaaactagcatgcttttggggagacgggattctaatcagctaatacttctattatggggtgctgacttgagagcgccaggcttgcagttgtattaaaygtggaagattcagacagagatgagatagggccgtgcggcagcccatcaccgscagcgcttgctcgtggtggtgaggcctctcccttccggcacagacatttatcttctgtccacgtgtgtgccgctcacagtccacgtaaggctgcgccctggtgccaccaccagcctccttccatttgcttatcatgttaaattcagggagctggggagagggtcttgcacacaaggaacattggagcaagagtaaacaactgagtcaagtttaaacggaataggccaatgtggttatgggcagggggcgggggagcgggtagttcaggaggatctcaggattatttgttctttaggatcaaaccgagaaggtggaatcgagggtctttaccacccttgtctttctccctctgtgacacagggatgttcaggcatagtagctgatgtcagaggattgcctgtgtgggataggagggtctagaaggctcgactcccctcctagggctgctccacacagctcctgcattagtcaaccaaattaaattcccaggcgagctccccaaccagtcctccctagacaagacaggcaagcaagggccgagttgatagacctgcctgggcaacatggagagaccccatctctacaacaaataaaaaagtgagccaggtgtggtggagcacacctgtagtcccagctactcaggaggctgaggcaggaggatcacttgagccaggaggtcagggcttcacagtgagctatgatcgtgccactgcactccagcttgggcgaccatgcaagaccctgtctttaaaaaaaaaaaaaaagttgatagaggcaggtacagcatttgttgctgtcgggtagagcggccacccactgccccagccttccctgtggccacttcagctcctgcgtgctcccagcagtgccagcatcctcatacctttgtttgggaaagacaccccagcagtggggagctctggctttcagttcctttgcacactgtggaagcaggagactgaccatttcctaaccttgccaaaaactctgggtgagggtttttcaatgtcttcattagatgcccttaggaaaagatctccctgaagaggtcatttctgttcctgaggtatctgaacacagtttgcttattgcacaagtgtccacggaagtgtttgtgtgaaagatcgatcacctttggacacgaacttcaagtatcagtcccagacagatgttttccacacatcggtgtgttcgaaaataaacccagctcttggccaaacaaacagtcggtatgtggccgtgctgtgcaccgagctcgtggaatcccagcaggatgacctgctctktgaaactgtggcttcagaacaaagcagccagtcatgaaactggggrmacctgacattgcaggacaccgtggggctgrtgtgaggctgaaaatgtacctagaatgggtcggctgcctgggaacctcacgaatactgatccccagggactgcgtgtctccctcagaactggggcagctttctacttgcagaagatcatgacaagggacttcagctgggtggtggccctgggatgtcactttccttcccacttaattgctttggatttctctttcctttctygtcatcccccaaaagtgtcttwgccttttttttttttttttagccctgagccccaagctcagtccttacatagattgtttaggagaccagtaatccctagttcctttgacttgcagctcagcctcactctgtcctttacttaggacataagctaaatctacatacccttcctacaccacagatrgaagatatggagggaaacctttttctccaggtctgtttcatgttgttgaaaacctcaaacctttttcttaggagagaacctctgtttctaagcagtggaatagaattgcttatggaatagccaggtcataggatgtgataatttccctggaaatcagaggggaaaagaagcaaaacatggagccaactcagactaagaaagctccatgaaagtttatgccagtgataacctccaggccccagatctgctcagcttgggttctgtgaagtcttgaccccagccatcacccacagccacatctcccagcctccttcagctcttccccaaaggcttaggaggtgttagcactggctgcctcaggatgatggggtccctgcacttccatgctgtgtaggttgagagaaggaggtatgggcacaggaggaagtgatggtagatttccactgtagttattccctttttttttttttttttttttaagacagtcttactctgtcccccaggctrgagtgcagtggcacgatctcagctcactgcaacctctgggttcaagtgattctcctgcctcagcctcctaagtagctgggattacaggcatgcaccaccacgcctggctaattttttgttttagtagagatgggatttcaccatgttgcccaagctggtctcaaactcctgacctcaagtgatccacccgcctcagcctcccaaagtgctgggattataggcatgagccactctgcccagctgtggttattcctaaaggccagtggtggggcaggataacaaggacagcaccagagtggggaggggtgaatgaacctacagcgtccacatcattgcttccctcacagagtatgttcagccaccagttgacagtgggcgggggctgcccagcctgtccaggagctggagcacacctgcatagctttcagatcacacagaggtgccctgctgcagacgctcaggctacatccgttctagtgggtgtgtttgaaggtagacattgggaaactggctggaaggtgtccgttttagaaacatggagaacgaattctttcactgggtaggaagtttgatgacattgtcttctaggtcacttcagactctgaagaatgtgagctctaaaactttcaccaaaaactctcagcaaactcaagctaatggagttagttggatttctaaggaaaacgctgtcctgaagttgaagctactgggtgtaagactaaaactgaggctcaaaaaaaaaaaaaaaaaaaaaaaacacctcagttaattcatctttctttctcaagatgctattattaaatgaaaccaaaacccagttgagataacagatagaaaactcaaccaaataatgaatgaaactgccttaatggagtggccaactgccctggttttctgcaggactgaggggttcccagggtgcaggactttcatagctaacatcagggaagtcccaggcaatctgggacctggccgcacttgctgcagtactgaccgccctaacagctcctttatctccacttcgcattttgcaatgataaccctaaacatttaaataagactgacacggtcaaagcaagcacgctggctgatgctgctgctctgcggtctacatttttgtgtctttgaaaaattgtatgtctccaagacctttaaaaagccctaactgcttaactttcttgggggaaatatatatgagtgtctcatggttttcagacactttgctggatcacagttcaggtggatcgagggcagcctgttctaagaccctgagagtccctttctgtggacttaaatgtgagccttagggagcaccttgatagwaaaatggaggcataatgagaaagaacttggacctcagggcttcacagttcagcgtggccacctattcatcttccatgtcgcaagcacggccgtcgagtgcaaggctgcaattccctgctgacaaagatgtgtgcagtgagattcctaagtggacctggaaggatgagctgagtggcctcacggtcaagccaaggacttcaaggtgcccctgtctaggaaagctcaccwgtgttscggtcctggctctctgggcttcctcaggaggtcgtttggcagctgtgaaactcctcccctccgggccatacctggcagacgtgcatgaactgctcagacttttaaaaaacctccttctggccaggtgtggtggctcacacctgtaatcccagcactttgggaggctgaggtggatggatcacctgaggtcaggagttcaagacyagcctggccaatatggtgaaaccccatctctastaaaaatataaaaactaaccaggtgtgctggtgggtgcctgtaatcccagctacttgggaggctgaggcaggagaattgcttgaacccaggagacggaggttgcagtgagccgacgtggtgccactgcactccagcctcggcaacagtgagactcccatctcaaaaaaaaaaaaaagtccttcttagattcctttccattstgcatgtgcccacattaaaacagctgtggctctgtcatttctccctgacctgcaatactggaattttccttcttaaattttcctcctttaaaattgttaaagagcttttcttcttttcattactaggcaggttaatttctatctgagtggcttggactctcctgcaacacataaaccctttgattctgtgtgtcgtcaaagtttggttttgttctttcaaagccagggcagccaaacttggactctctaaaattatcatcagaatgcagatttcagaaagtttctagtttcaaaatcagacagaagacccacttctttactgatgtaaagacaacaaaaagatctgtgatgattcctaagtaggtattttcctcaaaagaaatcattcaagaaaaaaaaaaaaagattgctatgagaatagcagctcgtggctgtgctcagtgcctgtaactgcctttgtaaatacacgaattcctcacataggactgcaacattttacttgaggattgaagattcacgaagaatctgtgatccatctcttcacccaccttcactgtctgctaggatggacctcagacttcttgaggtcgtgaacattcatttacactcagagaaacttttcactggtttccccagaacattgaaacagtcagaataactcctgtgcaggctactggactgacaaatgtgaaggccagattttcagatgtgaagctgggaagaccaaaaagacagacctccctttcttactgagaagagcgtagtcagacatgtcaagtctggcacgctgctgcagaaggcgtgattcatcttaagatcaaaaattatttcatcttgctttcttggtcataagctaaggtgcttggagctgtcctttggcctttcatgtgctgtgtctgtggtgcgggtgtgctgtgtcctcataagggtgygccatgtctgtggcgtagtgtgcaccgtgtccatcataagggagcgctgtgtctttggcgcgggtgtggcgtgggtgtgccatgtccatcataatgaagcaccgtgtctgtagcgcgggtgtgccatgtccatcataaggaagcgccgtgtctgtagcgtgggtgtagcgtgtctgtggcgcaggtgtgccgtgtctgtggcatgggtgtggcttgtctgtggtgtgggtgtgccgtgtccatcataggggtgtgctgtgtctgtggcgtgggtgtagcgtgtctttggtgtgggtgtgccgtgtccatcataaggaagagctgtgtctgtggtgcgggtgcaccatgtccatcataagggtgagccatgtttgtggcgtgggtgtggcatgtccacgagggtgcaccatgtctgtggtgcgggtgtgccgtgtccatcatgagggtgcgccgtgtccgtcatgcagatgtgccttcatggccctccctgattcccaggccccatctagtgtacatcattgcctcgggtgagaatgtccctttctgccccatctagtgtatgtcattgaggaggagggctgtgttccccacagtctgcccaggggctgtcatgtgagtggcacataggtattgcttagtacacaccggtcacagtgacttgagtgccaccacaatgaagtttccaatcgtgtgactccttcagcatctttgctcctgaacttcctggactccagccctcaacattgacaatcctggctgtgctctacagattgtggtatgattgagactaacagtactcaccatgtcttacaacatgacctccctaaactgacatagggttgggtgaacacacacacacacacgtaatcactgcctcacgtggcattattacaaatgctgcaaaatctaaacacatcactggaatccaaaaagcaatccatttagaggcatatgaggagattgtacagatattaaagaacaaagatctggaactatggcaacaaaccaacgttgctgttctagcctgagctgcctgttttaggcaaatgggaatgcttttggaaacaatatgaaccgcaacgggtatttctgcaagtttctaagactggcaggagtcagctcgggggaagcaggaagaatccccagttggttggctattctygggaccgaagagataatccccattgaacagagcctacactcacatccttgagtccgtgatgttcttcgcttccctgggaacagccagagtccagctttccgtgtggattgctttcacagggatatctggcccttcaagccagtggtgtgaatgtcaccccaagaaccttgacgtgtagatactgcctacttcaagtcatactgcagctctgcctcttcccaagataggatttgaagcagcttccaacagaaaatggatgtgaaaatgtattgtgaacacatgcataggaccatacatacatcatacacacacacatacacacacacttaaacatacacatacacatgcacatrtacacacacatacmcayacacagctatgggcacaacttcatttcaacttgtagattgtgaagtaaaggcattggaactttgtggcttgcaaatctaaattacctccttccatcttaagatctcttccctcctttattctaaagtgtgattcggctcctctcttagctgatccttctggtgtgcaggtcaaagaacactgagctgggaatcagttgtggtttccgattctgccgttgccccacccgcttccatgttggttccaacgtggctttgtggagtcctgggactcaggcacagtgtgagaatcactgagcctctcaaggtcaattatgcagtgattgcttggtagctcttcttcctccacccacagcctcggcctcggcctccgttttctcttcctcctgggaattcatccagaatgacgccagaagtcacacagaggtgatcttgcagaccatactcccctgagtgtgcaggcctgcatttttgctcagttcagctagcgcagtggcctgctcataaagtttyccaaaacctgtaggctgtatgaagaatagcggttactcctaagctgcttttaactttcaccttgtgattctcatcatatttttgttgatttccctcctttgagttcttttatgtatttccatgatggagaagatcccctctcccgcttggttgatgtccgtgcccctgctcttgccccagcttgcctcctcagactggcctctcacctgcttcctgctctatcgctgtctttgttttcttttagtttctcatacttgccatgttatctggcctccgggtcttcacaaatgcagttgcctctgttgagaatgttcttttctgccccatctctttgcctcactaactcctctttccaatcctggcttaaatgctacttcctcttgggagtttccccrcactcggcctatttgggcacccatgctgtgtgtgctctcacgttactctattgggccatctctctgattctcccacaagactggaagctccttgaggcaaggatgtatatgtcaccaatgtatctctaacatctggaacactggcttgttggatggatggatggatggatggatggatggatggatggatggaggcacaattagcccatatgcttaacctttccttaaatgtgtcggactagagttcctaaaacctcgtggaaggaatccaccatgcaacacttttaggaagcagaaatatgtctcagccatattctggctccatttgctgcaacttaaagaaggatcttgatgggagaaaagcttcaggattttgtttgttgcttttttcattttaattgtaaaatacatacaacatttgccaccttaatcattttaagtatactgttcagtagtatcatatacgttcacgttgttgggcagtcaacctccagaactttttcatcttacaaaacaaactctacgcataaacacaaattcctatcccccctccactcagcccctggcaaccagcattccagtttctgtctctatgaatttgtctgctctaggaacctcatataaatgaagtcatatgctgtttgtctttttatgactggcttgttgcatttaacattatgtcctcaagattcttccagttgtagtgtgtgtcagaatttccttcctgtttgaggctgagtaatattccgtcayatgtacacaccacattttgtttgtccatggatggacacttgctttcacctcttggccactgtggacaatgctgctaggaatgtgagcatacagataactcttcagagcttgggttttaaatgtaaaaactgtaacatgggaaagctacagagtatggctgaatattaaacctgcctaaccttaccagcactctggtcatggtacatttgctgggcccagtcctgaccacagtgaactgtgcaggcttcataacatgcatggtggtctggaagccatgtgataagaagaagaaaaccacccagcaatgacatggtcacatgggctctcctggagtttgctaagcacctgggtgacctgggaaagaactttgtcattcatgtgacctgtttgaaagaatgtgatcagttgtttctcccatgtgtcaacagttccaaagccaaggaattaggccgccataaaagtagaaatgttttcagggcatagtgacaacttttgttggaaatggagcctactaaaaactcactggtgttacaccaacacagaaaaggactctgtatcaaagtctatttctgtctatgtaattctttctttgttttatatacccycagggtttggaaatgtttgggatttaaaaataaaagggccgaaagctatcctcacgacatttcattattgatgttgttgacacacagtgaatggaagcagggtgagactggacaaaataaagtcctcttatttctttttttgtttgttttttgttttatttggttttatttgtttttttggagacaaagtcttgctctgttgcccaggctggagtgctgtggcgtgatctcagctcgctgcaacctctgtctccagggttcaagcaattccaccatgcccggctaatttttatattgttggtagggacagggttytgctatgttggccaggctggtctcaaattcctgacctcaactgatccgcccacctcggcctcccaacctgctgggattacaggcgtgaaccaccacgcctgaccaagtcctcatgtttctaaaaattataccactaaatagtgtagatcctacctaacctattttcaacattgaaaaattctgccttcttgcatttctagttaaaatgaaaaaatagaatatatgtgtgtttctataaatagcagatttaacagtgtggctggagggtttgagtctctaagcttccagtggaatccaagggacatcgtcctaccagtatgccgcgtgatatgtcagatcgtctctggccgtcctttgtacccaattgataacattttgttttccatttttggccttttcgtgttactcattgaggccaaaaattcttacacaaggtaaataaatcaaatccctctggtttcctcagcaacagtaagtcacagccgaggactcagtaggagaggatgactgkggggggtcatgaggaatgttcttttacttctactaagaaattgaatttcattattatattttataaatattttcttctttggcttataacctgattgcgggcttgttgctgaggtcttggaaggtaggtagggaggggcagggctggagaggcctgtttcttctcaggtgtgcctgtggccccagatggaaaccaatcaaggtgcgatttatgttcattaagtgcttgtcaaaactgaaaaattttctaatcaacagcaatctagctgcagccccctcgatggctgggagggccrcctctgccrcatcggctatttgcctgttacaactctaggctaaaaatccgctgatgattacattaggctaagctgcgaagtaaatgaaccatgtcttatttaggtgccactagcttcagagtagtcctgccccgcagggcacttgatagcattttatggctttaaaattagtgtagcttcccatttgctgcagggtgctacatgttctgcctttgaactcaataagcaaagggaacggggccttttgtttttcccccttctttttttccccttgcattttagcaattttgttttgcatcttttccagacggcattttgcaataaaaatgtctgactaccatatacatgcctcccccatttaaaaaaaaaaaaggtgggggaagagaaggaggaaaaagcagaaaatgtcatgcgtttgcagaggacaggttccccccccacccccacccccgcctgtgctacaaagtgaaaaatggctttgcaggtcaaccctaatgacttatcatgtcagaattgctacctcaagtgggaacaacacctttagcccaagaaattgccacataaagtcaaagggaaaatagttcagtatttttattggacaagagtggtgagagctaacatttatggagggctttggcgctctgttaagcacttgagtattatctcagtgaaccctcgcaacagtatcatgaagctagaactgtttttaaagatgtggacrtggggaccctgagtgactgaatgacaggcccccagtgtgcaactcggaggagagtggaggcactctgatttcgaggcttattccctgaccaagagaaagtcaacttttgtcttccaaagacttctttaggaaatcagaaaagtgtggttatcagtgaattatctgattcatttgaatggaatctaatacaaggtgctgtgaactcccttggcaggcattatgtttaggaaaacaagagtagttcctgtaaaagcaatgcatgggaaaaatacgtatagaagacttctaaataggcctaggtggaaagtttaaaaattagaagtactgaccctttgtcaaggggaaaaactgaagtgggagtttgtccgtgttaccttaggtctcatggcagaagacatgatgtagcaatcgatattcacctcagaggacagatgtatatgctctgctgtcttaaaactctactgtttggccgggcgcggtggctcrcacctgtaattccagcactttgggaggctgaggcaggcggatcacttgagatcaggcgttcaaggccagcctggccaacatggtgaaatgccatttctactaaaaatacaaaaattagccaggcatggttgcaggcgcctgtaatcccagctacttgggaggctgaggcaggagaattgcttgaacccaggaggcggaggttgcagtgaaccaagatcatgccactgcactccagcctgggcaacaagagcgaaactgtgtcttaaaaatatatatatactgtttgttttagcgctgcacattttagcaaattcgtccaaagaaatctgaagttttaaagagacccagacaggcagtatcaccatggtgaacatttccttataagtcaaaatttctaggatctaactattgatccagttgtttcaagccatattcaaatattaaaatactaggacagcaaaggaattgtgttggctccttgaagttcattgtaatgagaggcctacagtgactgtgtagagacaagcagctgttttcatatccgaggcatgcatcgtacaggctaggtttgagcaggcatgggttacaactgcgtaatactcaatttaacctagaatgagaaaaatctttcaggcagtgtaaacctcaatacagtaggtcagtcaagacagatacagtcaagaagcaaaaggtgtattcataattcgatttagaattttctgctttttgatttgtagtagaataacttaaccctttggactggtggacttgagcccacgcatgttggacactggcctccgcagcacatgaagcagagaagtctgcttttgccatcatgtagggactctccactgtacatgaagctgccaccactggtccccaacaaggcctcaccagccttctcgtttaccacgtgtagcataatgacccagacccaataaagcatttactaagtcaagaatattccacacatactcttccttacctccatgatggagtagtagactgatttcatcttgatagtctgggtcagtcactccagccaacactgtaacttccttcttagcctgttgactttgaggtaggaggagcccaaagtggccaggtgacaatcttacagtttaatggaattgttgttgtgtctcggtggcagcatttctccctctggaactaagacccctaggccagcagaacgtaatgttgtgggaacaggaagcaaaaattttgctagtgggtcactaggggtgatggtgagtggtgccacttccatttctgccccttgattcctggacctgtgaatcctggcaatgggaaaaacaataccatatattggacactgattcagagcatacacagccttctggagaactttgcctcagccctgcaaagtattgtcacctagttggcattgtaattgtgacttcaaaaggccattccaccattctattaatccagctgcttcaggatgatggggaacatggtaagaccagtgaattccataagcatgagctgtttgcctctgtgcatgctacacatctgattggccaggtgccttcctcctgccatggctgctggtcactgtcatgcacttacaagcatgggtcaggtagtcttcaggaacgcagttctgaaagtgaaacactggaatgcttttggctgtcttgggaaacaaagttatttctcatgggatttttccctttgaagctgcctcctaccttgctattgtgactatgatcctttggggagaagagtaattgtcttcttgagttctgtgatctgaagggatgtggccagaagatttttcatagttttacaatattttcacagtatttttaggagcatgactttggtctgcacctgtgactacgtacaaggccattgtttattattcataaatgtgggatgtgaacgtttgcttgatctttttgaatgggtggtcctatatatgtctttatgattagtttcctttgaatataatattaaatggagtttgggaatagtagtgaactttacaatggcttctcttacatacttttttttttttgagcccagaagtgaggctttttaaaaatagaacttcacaaattactgcttccttttgatactggatattcatgaagtgcagtgaaaatagggaataatgagtcattcttttcctccaggagaaggaggaacaaacaaatgtgaaaacatttacaatatctttccacagtccaaccctttgctcctccccggttgtgtacataaaagcatacacatggagccaatggctgctttgcagacatgaagctagactagtggttctcaagactttgggctcaggacccctttatctttttaaaaattatgggccaggtgtggtggctcacacctgtaatcccagcactttgggaggccaaggcgggtgggtcacctgaagtcagaagttggagactagtctggccaacatggtgaaaccccatctctactaaaactacagaaattaggtgagcataggaacgtgcctgtaatcccagctactcaggaggctgaggcagtagaatcacttgaacccaggagacagaaattgcagtgagccgagatcacaccactgtactccagcctgggcgacagagtgagactccgtctcggaaaaaaaaaaaaaattatggagggaccccaaagagcttttgttcatatggattttgtctattgatattcatcatgttagaaattcaaacaaagaaaatatgtaatccatttaaaataacaataaaccacccattacatgttagtataaataatatttttgtgaaaagtataattttcaaaataaaaaatcatgagaagggttgcattgttttatatttttttaggtctctttgatacccagtttggtgtaagacagctggattctcgtatctgcttcagtctgttgtgataggttgttttggttagtctttgagtatctcacgttacacagatgtgtggttggaagagggaggaatatttcaaccctcatttcagataattgtggatattcctcttgcacacttcaccaaaactcaacatgtgatagtttcttaaagcttagtaatgcaatgtgaaatcactattttttttcctcctctactaccttaaaatccatccaactgacttgccctttgaatgatcttttacgtgtgttttatccatgcaggcatatccacatgcatccatgcatgtgatgtcataccccggtcatttcaagaaaaactatttttgaaatgaagtatgcagatttctaaatagtgatagttttcatcatataacatcaaaaattttcatttgtatcaccgccaatcttgtcagaaaagttgctaagtctttggaaggtgtcaagctcatagttagagatacaagtttgccacatacatagaactgaaaaccagagtcagtcaatgtctggcacagtcattctttcaggtaaaaatcttgtcccaccaaaaaagtggctggttcagcttgcaactccaacagctgcagaagtgcgtttctgcaagacaaccatcaccctccggtagccagcaaaaatgctttatgcatgctttttccatgtcatacctgagaaaatgaagacatggactcaaaggtcgaaatgtttaaaaatcggtagcacttctttttttaagtgtattcagagcatctgtgagacttttttgtttgtacttaaagagcatgccagtgaataatgtgatgatgactagtacagtttggggctactactttgattcatgttaatcaccagcatgtttgcaccatcaaaacaaatttcaacacagcaataaaaaggcaagtactgtatctgaattgttttgaaaatcttattgatttgtctgaaaagtgatctatcttttcagtattatatattaatataaaatattatatttctcaacatacatgtacagttataaactagaacttaatggagaaaacgaattggaacagattgccactattttccattatttttttccatcatttaactatgtaaatttaaagtcttaatacttttttgaagtatacgtaaaaatggagtatgctgattacattttctatccttgaagaaagttgagcttaagcactgtcagattttcaaagccatatggttatttctgatctaatgttgagatgccaatcatatagtgtatgcatttcagtttagctttaagatcttgttaactgcttttagtacccctgtgaacacatcagcaaaccatcttttcaccagacagccaaaggtaacctccggatgtgaggcagtgagaatcaatatagtaagggtatttttagggactgttgatggattgctgtattttgagcttaacttcaagtgccaaaggccccagagctgactaagatgaactcaccatttactgaggacgggagaggccatcaggcacatagtgggatctgggattgccaagacaagatgtacacacctttccctttgtagttttggggagaattcttgtatattttttagtagcctaatacggtattttgatgaggactttgtaccaccctccttgctggagccaagtgttactcatttggtaacctcccggtcctgggaacacataactgtgaaattctaggacaacgtgatacagcagcgaatcaattaattctctgtatcaggagggatctggtacaccgagatactaatgactccgcgtccttctccaaaggcagccccacagaaggcsggcgccacgttaagctgtgctgctgtcagcaasctgaaagctatgggtctctgacacggctctcaattgctagcaggtttctctcattgcacctcatttgcatctgggacatcaattagcatgtttgttgaggctaattgaatgaaactcaatcatagctcttaattgcttgactatgtgaaaagaaatcacattaatgcagctaattaagtgtacggcaatagatgcaacataattaggagcgaaatgtaaaaaacaagggatggcaaaggtgccggagcagggttgcagggggacagcgaggcacagttaccgagcaattggcgggttcggaaacaggtccctttgctctggcgcctgcttggaaaaaataagccgcatgatgatcatggacaacttgagaaggaaaatgcaaataggtttgcaattactactttttcaarctgttgaggggcaggagatggcacctctggggggcctggctcttgagtgggccccagggacttgttaagtgctgtttaaaagtacttggctttgaattaccctcacgccttgttaaagggtttttcctcttttatcttcgatcagcattttcaacaaggaacatggagaagggtagtatctgtaacatttgcatatcaaaatcaagcttcctgtcttaattttaccgaggtccctaactcagacccgtgaagggtctgcacagccccttgacttctacggaggacattgtttagtggttgtagctttaattcctcaagtaccaagctggggagagatgaaaaggatcagttctttcaaaaccagaaagctcagtgtcgtttctcttgggaggaacttgaagccacagatacatgtgtctttatctcccacctgtgtgtgaagcgctgagtcggagggcttttattgagtaggaaatgcattttgtaaartttytaaaaatgtkcagtgccttgaaatataagaattggctattttaaataccgattttatttattttttttttttagagctagttcttctgaggttgtaaygcctaactcaggcaagaaaacagatcccttagcccatgctgagctaaagataaatgggttcccttgccgctttcgaatctggagagcagacacttggtacatttctataataattttaaataaaatatcgtggttattgtatgttaaaacatgcctattaaaagagcccatgctgaggcttagtcactatctgattagcctcattttagagcccataagcaataaatgctcaattacactcctgttattgtattttaatttgttaagaattggcattaaggaagaaagttatagcaagttgatatttttaaaggagtaactgtgcaagaaggaattcattatttacaagcattaactttggtttggaaagttgggtttgcatattttcagtggatattaatggaagtaaactaaagatgcttgagaaaaaccttttttaggaagtgaccaacactcaccactctacggtgtgcttttcctttcttttctcttttcttttctttttgagacagagtttccctcttgtcgcttaggctggagtgcaatggcatgatctctgctccctgcaatctctgtctcccaggttcaagcgattctcctgccttagcctcccaagtagctgggattacaagcacacgccaccacacctggctaattttgtatttttagtagagcaggcatttcaccgtgttggctaggctggtcttgaactcctgacctcaagtgatccactctcctcggcctcccagagtgctgggattacaggcgtgagccaccgcgccccgcctgatgtgcttttcatttgtcaccctcaacacagcgcagtcctgagaattcctgtgccgcttccagctctagctttccttccatctagtttaacagagttaattcaatagtaactttctttctgtctttggtctacatcctctcaaagttgattatgttttgtggagtccagcatctcaacttccaagtggaatccctttcgggggctggtgaagtcagatttgttgttcccagcccagataccaccctcccgttacccgaacccaccatgacagctttcctccaagggggctgtggctgactccagccagcctgccctgagagtcaggccatcctccctgagccaccctgtaaaatgaaatggccagtcaccagcctcgggtggccgggcacctctgctcccggcctctgggctgatgtgagatgcacgcgtgccagggttttctgcctggatagcctgtctgtcctttgccggggaakgcccggccttgcccctgcctctgaatttgccccactgtagcacagtttctgatcctttctccagtggtcttcagcccattgttcttcctcctggttctgaccctggtgttttgagctttctgtctgcaccaagacttccgtcctcaggggtcaccagggaccctgaaacatcttgtccctctggggctgatgtaggggagcctgctggggttctgtatttatctgccagagtgtcccccgccagtgtggctgtgccctcatgtaaagaggttctcctcccgcccgtcctgccgttgagaattcctgcacccttttcccttgagtctggtttgactccatgtggcagcctgtaagtcatgttggttgcgggaaggtctacattgtcacaccccaggctcacccacctgaccatggttgggcagggagaaaacagctcttctcatcctctgccctgaggacccacagtttcattcctttcccctgaactggaattgtgtactttgtggcttttgttgtgccttttcttctatcagcaaacatctacttgttgataaacccgtgactccttcacaagtgtgggtgttgccctgcaattaaaaggtggactgcttgcctgtcatcccagctactcgggagactgaggcaggagaatctcttgaatccggaaggcagaggttacagtgagctgagttcatgccactgcactccagcctgggcaacagagtgagactcttgtctcaaaaaacaaaacaaaacaaaaaggtagacagcccgtttcctggaagccactgggatctcgctttggcctctctgctaccctaccctgtgtcccagcagcttcctcaatacacttggccaagtttccttgtccctgagacagaggcttccgacccttgcatagtgattctagaacttgatccaactatctctctgcatcgggtaactgccattgggcagttaaaagacagcagcccacttctccaccctgcctcggtcccttgcatccagcatgtgagtttatttggcagttcttctaaaattacgttggctgagcacggtggcttgtgcctgtaaccccagtgctttgrgaggctgaggtgggagggtgacttgagactaggagttggataccagcctgggcaacctagcaagacctcatctctaaaaaaattaataaatgaaatggaattatggtcacctgaacttaattacttttaacaaagacaaatttattggttttcacatctaaagggaattcaccaagatgctgccaaagaaagagcatatttattcccacttcctgcatagtcttaaaacacttgaaatgttgtttttccaagagtaattttcaaatacagtcatttctctgtattcatgggggattggctccaggaccctccagaataccaagatcctcagatgctcaagttccttatataatacagcatagtatttatatataacctgcacacattctcccgtataccttaaatcatccctagattacttatacctcatgcaatgtaaatgcaatattttcttatttgtattttttttaattgttatattgttacagagggctgagtgtatattctttcttaacgtgtgatatcaagtaatatgtgtccagaatgcttaagatactgtgtttgcagacagggagtctcattaccagaaataataataataacaataataataatgagtgatgatgatgctgcactaaaggatcagtaactcactggccagcaggcccatcccccggctctcagttgcttgttcaccttccccgttccctgcccaycagccagtttccaggtagtgtttgactccacagtgagttaagtgagctgccagagagcagtcactgtccaccgaggcttccctgtagttctctgattgctgctggtcatttgcttccaaggcctagaaagccagataccccttggacatcttcctggttcttagcacaacagttgacctttttacttccagttttcacctgatttttcaccagagagcttcagtcttatctagattttaatgatattcccatctgagacagaaaggttattacaaaatggtttcctactccatggaattttacttggaatttataggaggagcctaatgtaccctctgataagcaagagttcaaaaaatcagattttgtgtgtagacttacttcctaatgacccttgaaggaggcacctgctgtgtctctccttacatctctaggtcctggattagttcaggacacagaagcaaaactctgatttaaatataataatgatgttaccagtactctatagataaaaatctcatgatttttaaagtactttccacagtggaagggtcatagggttttaactcatgacgtctgatagacccttttgttctaggttgtaaaaggtctttttttttttttatctctcttggatgtttaacattttcaacaggattacatgcagaatgttcatggtaaggagattgaccttctgagaaccactgtgaaagtcccagggaagaggccaccccgagccacgtcagcctgcgcacccatctccagccctaaaaccaatggcctatccaaggacatgagcagtttacacatctcacccaattcaggtaagcttacagcaaatgcactaacaaatcaagttcaacagcaacaggtggtccaggctcgaggataatgttggactcytaggttaagtggagacagtaactatcacattacagattaaggtttagaaacctgatcacttctgtggctgatcatttcctttaaactttcagttccgcaaatgccagcgagcaaatggtgctttgagtcacagctgcaaaaaccatgcatctaggcctttccagggctgcatagtggaaagtgaagttaacatgtgaactgggtttttaagatccttctgaaaaacgtgaattaacgttaaagtgtcaaagattaactcatttctgataactgtatgtatgaaagtggaaaaaccattcggagcaagattcagaggaaaccatttgacctatataaaatgtaaattctgtgttgttatattttaattatctgccattctttaatgcaactttagttctctgtattctcttttaaaggagattttttttcattcaggatcagagaaagctgtattttctcaaatgttgatgtgtttagaaattcctggcctctgtgcccagttgcaagccatccaaaatgacattgttcattttatttacgtttttgcaaataattgccctgtgtcatgaaccttcccatgtctgctcatcagagataaggagaagatcctcttgagccctcccataaacacacacacasagtcaggctccttcaacatggggacatcccttcaagaatttgcattttctcctgcagaaagtccagaactttcttctctcccacctacatccagtcttcttaaaacagatttctggctaggcgcagtggctcacacctataatcccagcactttgggaggctgaggcgggtggatcgcctgaggtcaggagttcgagaccagcctggccaacctggtgaaaccccgtctctactaaaaatacaaaaattagccgggcgtggtagcaggtgcctgtaatctcagctacttgggaggctgaggcaggagaatcgcttgaayccaggaggcagaggttgcagtgagccatgattgcgccactgcactccagcctgggtgacagcgagactctatctcaaaaaaaaaacagatttctctcctatgagagtttctggtctttgatgctgcactttcctcttctgaaacatcaagtgcttttaaagagggatggtgctgactgcctggttctgaggcatgaacgacactggtaggtgagagcaagatggtacagaggagttcaaatttgggtccaccatcctgggctccgctgcatagtgttaggcagtcactgagctggttccttcccaccacattggggtgctcttgcctggcctgcctgtgttaggcaggggggcggtgtcagaggagacaacatgaaagtgctgggaaagctggatacaaacacaagctgttgtttctaatcaaagttaaaactggctttatgctaaaggagtctttagtgcctcccaaaaaagtgagaacagtatttttccaggggcttctatgacctgctgacctttcttccaagacatccgtgagatttttcttattagagcggtgtgctaactatggggtgggaagagagaaaagaagggcacaagaaagaaaaarcaatccgtagtgagtaaaatgctgaaggctttattacattagtacrttacataaactcatgcatttattcaaaaaatatctataggccaggtgcagtggctcacgcctgtaaccccagcactttgggaggccaaaatgggtgaatcacctgaggtcagaagttcaagaccagcctgtccaacatggtgaaaccccatctctactaaaaatacaaaattagctgggtgtggagatgtgcgcctgtaattccagctactcaggaggctaaggcaggggaatcgcttaaacccaggaggtggagtgcagtgagccgagatcgcaccactgcactccagcctgcgcgacagagtgatgagactccgtctcaaaaaaaaaaaaatctatcaagcacctattttgtgccagaagttgtgcgcactgcagatatggagtccctaacctctagaattcttccatttccacctcccttctgaccatcacatctagtcatctagttacataagtaaaagcatttattgagtttcatttttataattttaaattgataaaaatgtattaaatagaattaatttaacttaaataaaaatttattgatctttgtaacatggtgttttgaattatgtatacattgtggaatggctaaatcatgccatttgtggagtttctaacgtgtgcctgagacacagttcccgccttcaggaatctcccctgttgttggggagaaagacaagtagatggaggccacacggagccacaggccccaggagggctgtgtaaagggcagggcttggagacccagtgatgctgcggtcggctccccaggaggtaggccaggcttcaaggratgggggctacctgctgagtttgaataaaggataggaatttgccaggcacacagatatgaaggaagggcaccaattctgtgaagaagcgttcactatgtaaaagtaggattttgaacttcctaatcttgagatttatgttccttggagccaaatgccactgttgtcctaagggaaacactaatgtgtgattttaagtagataatacaaaggccctataaaccgtaccatatctgatggagtcggctgtggcatgggcctttctctttgagggagtgagttgtgtgtccttggaaggcatttcccattgcccagtttcattctctttaagagcccctgttgggcaaatgggagggttgcgacaagattgaaatcccttttccatggtcacagccctcagtgtgtaacaggacatctccgcaaccctcaaacaggttaatcccacacaggggcctggctgactttccctcttctctggattccaactagggatagagaagtggaggtatgaccttagcacagaggcgttgccactttgggaagaagaaagtgcctcacggccacagcagtgctaagggaagtggcaccctgaccaagcatgcgggtgaagtcatcagctggtgtgcggcrggagggcgcagatctcagatagcagctccctgttkattgctcagcttcattcttgggttctgagaataagccatgggcggaggcacttctgtaagaggaagcagcttcattaaaatcttgggaaattttaatttgcattcaccttctctaaacatgaacatgaatctgtaaagtgatacrttctttcttgcttaagaaattaaagcrtttggggatttgagtttttatactctttgaaaattgagtttcttgtgctaaaatcatcattcacaaaatgtcctctcacctgaggaattccaacacagcaaattcartctgaaataaattgaggctacatttaagagacgggacttccagctaaaaataggtattagagagctgtttttgccaaaaaattgaatacttaaccttattcttcactcttgactcatttgttttgtctcagttctgggtgaactggagggttttctttctttgtattttcatttttgtattcattttcttaatgcgattgaattagatcaacattttatgccttctcttcccgtaacttgcattcacatagacctgatatatgtatgagcctaaatctttgtggttaacacttattattgctttggaataactgtccatatatggaatgattcattcggttggtataaccatttacagggttcttgatacacatttccaaattaacttctaaaaggttttacatgaaaactcttcccatccatagccatcaccagtttcacctcacacacttgctaatgctattaatattattgttagaatttatgctaatctgatgagcgataaaaatgcctcatgttttgtttatttggatttctttaatcggtaatgaagttgaacagctcacatgtattaggtgtatgtgtttcttacgttgtaattaattgtttaggtgtatcctttgcccatttttgcactaggttctttttcttattgatatctgagaactcyttgtatatttaggatatgaatatattttgcaggtatttccccagtttattatttgccttttaaattttatggtcttctttacataaaaaggttttccctcttttttatttataatcagattatcttttactgttgtgatttctactttaagctatttagaaarcctttcataatcttgaaaccagatcacagtttacatatatatacttctaagttttaattttattgtttttttcccttaaaaaatatatgtatgtgtttatgtgtgtgaatatatgtatatgcatatatatctgtgtgtatgtgtgtgtatacatgtatatgcatgtatttagcccctaatccacctttaatttgtttgtgtctattgtgtgtgatagaaatctaattgaattttttattcaaataaataatcaactgtcgtttttctctttgttgaattttttttctttccctattaattccatatgttgcctttgttgtagaactcaatcacttcatcaaatgggctgtgtttctggcctctcagatgtgttccgagacctggtgtccctgcattgtcttaccttatgtagatttaccacagtgtcttagatgtatgactccgtttgtatctggtagtataacacagttgaatatttctcttttatcttccagtttttcttggctactgctrcctgcttatttttcctcaaatgaactaaasagtaacttgaaaccttctcctccttgataaaaataatcccctcattggtgcacatgacatcaggacctcccgaggctgtgatacgggcacgtaaataaaataataaaaataattctatcatggcttttaactggcattgcttttaagctatgaattgtggaggaagtggcatctttactgtgtggagttccttatcgtggaacactgttctttcscagtttattcaaatttgtattatagcctccagcaaagttcagcattttttttttttatttagctgctggacatgtcttgttaatctattctgtttataatttttggtgcattgtgaagctaatcytttttagagaggcggggtctattatgtcatctaattggtcagaaataaaactcctaatttttgtgttttctattattcagccatcttgctgaactcttgttagttggaatagctactggatgtttctgttgattctctagcacacagtcataatgcattccatatttcaaatactataatgcctaactgtgtgccaccagtttactgatacagagactggattgtgttgcctcctgtgccattcgtctccattgttactgagtctgctgtatgcccacccttgattaatgctctggatattggggtggggggaggacaagacgtctctccaggagccttacactcaagtgggggtggaggagtccaaagataaacacacaagtaagatcattgtaaggaatgataagtgctgaagggccatatggggcaattgaatagaaaatacctggaggggctcgggrgtggggtattcctagcatttgggaagtgatttgcctgtattgaaatagtgactacatttcacactttaaaatgctggaaatgtggtcatcttcatgtcagtttttgccatgggcttgggagagaggaagaaacacgcactgtcagagcagctgccttgtgcactgctgatgactgggctcaggccaccctctggggctcatgcattgaggagagcagaggagctgcaatggtgatggggtggctctgggttccttgtggcggtcgtggagttcaggagtgggctggggcacagcagcaggctgtgcgacgaaagcaaggagagctggccagtgttgtccctgccaccaacacccccaggagagcatgcatcggaacaggcagcatgcctagggagagcagaaccttttgatgtggatgctggtgctcaaaaaagggaaacagagatgattgtgaaactcaaacatcctcagtctcagaagaagagaaagaaatggagaggcaaggcagccctgaccgtaggtggtatgaagtgcaccggccagctcacagccccccacacrgtaggtctaaatgaaacccgccagtcakyatgggccatacacctgctcagagcccacaaccagccttctggttggccaaggctgcagagaaaaccccttcatctgcctcatcaacccacatgctcttattcrtagataatggacaacgaaggtgtttgtgggaaccaacagtaaaatgtgaaggataactgatcttagtaagagtgacattttagtgaaagggaatttaaaaggaaattataactcctatcaacagaaggatttaataygttagttattaatgatactcataaaatgaggcaaacagagagcacgtgtttggcccrgcgcagtggctcatgcctgtaatcccagcactttgagaggctgaggcaggcagatcccctgagcccaagagttcaagaccyatctaggcaacatggtgaaaccctgtctttacaaaaaatgcaaaaatttagctgggcatagtggcgagtgcctgtggtcccaggggagactgaggtgggagaatagcttgagcccaagaggtcaaggctgcagtgagccatgatcatgccactgtactccagcctgggcaacagagtraggcctrtgtcaaaaaaataaagagtatgtgaaaatactataggagaaaaagttttatgaataaagattgtgaaaataaaaaattcattagataaatactgtaaagaacgtggctaaagacatgttggtagtcaaagatgtaacagaagaatatatgctagaagcaagtaaggatatctgaagagtcaagtatcaagttggatgggagaggaggctctgcaaaaatacaaataaaatcttaaaacacaccaaaaataggagaacaacaaggttacctacaaaagaagagaaatctgactstagacttctcaagagcaacatgcattcttaaatataatggaaatattccctcctaaggacaaataattctgaacctagaagcctatgcaaagaygactactaatcaaatgaagatagaaaaaaaagacatctttagacaacctacagggttatacaacatctctgtcttaaagggttttgaaaaaattactkaagggtctactccagaaaaaaaagaagaatccaaaagatattcaggcctggttaaaccttcccttcctcattcaaggtcactggcttctcaagatgtgcatggccattatccacttccattcttttggcctggaacttacatagtcttaagttgccattctaatgaggatccaccagaagccacattttggagaatcttcccaacttgaatttcaggtataggtccagagaaggaggtaaaacgtcaaggtattttctgacatgaatgtttggccagcctagtttggtgaagctgtatccacatgtaacaatgcagagttgtattarcttccacagttattttcacatttaagtagagagcaggaaaacataatgtccaagagcaagggtttcrgagtccaaatcactgaatagaatcccatttctcctgtctcagacccttctgaagttgtctcactaaaccccagcttccttgtttttaaaatggggaaatgatgtccacctctgttctatggagaagaacacacggcattcctttgaaaagcttggccgatgctgacttcacagaattacatcattaattcatcatcatggttatgccaaaagcaaggaagaggggaaagaaattatgttcttgaattaatttttcaaatacaataaagcattgacatagcctttgagtggacataatggacatagggcttagacttcacaaacccatgctccccaacagacagcatcccactatcatggcagcaagggggcagacagaagaaatgctcttctggactttcatggatgtccatggagctgtctgctccagttctgtgtcctgtggtcactttattctgtaactcctggttgtgacatttttgttctaggatgacagataccttcttgtctctaaagtgtgtctttgttgggtttttgcaactatggatatgtttttatcctaaccagattgatgcttagacctttgtcaaaggaaacctttccccttctcctctacatcccccccttccctacttgaggcccccagcggtttcgaaatattaaagccttcgggagggttgaagctgattttccaggggaggtgggggaggcggggacagcaaatgtgttttgagtattgaactgccgttgacatctaaagtctcaaccatgctgttttctccacacttcagcaatcaggacatccagcaaacccataaaaaaccaaactaatagcatgaatattcagtgacctagaatactaattattgtcatgaatattaatgtgatcggacttgctctttcctctcctctttctctctcgtcctctttctccctctctccctctctttttttccacttagccggctctaaagatgggtcataatgagagcatttaagagggagcgctctccgccgtgacagggaccggggtaataaggagagcttgattaacgtggtgcacttgggggagagatgagaggcttcacgtggtcctgttcgggggaggcaatgaggcaccggcggctctgttgctgctcccggagattaatgaggcctaagagtgcattaggaacagtgacaaaggtttgatctaatgggctcagtcatttttcctttgagtgacagacgcacagaagtaattggctgtgcagaatggcagctcattggcggtacttaaggatacattatccccgttgtgtggcccgcagaggctgtttatcaaaactgctcacactgcagacgcggagtcgcgaagctgctgtttcagtggtaatagctattaaaaaaaaataacgtgacatcaaaactagacccgttgttgtctcatggaaagaaagtttttctttgtttagtttcaaacggtctagaaaacattataataactctggagtccggagtctgttgtgggccctggatgagcagtgtcagtccacacctgtcccctgccggcatgcggtgtggccaaggcttggtggaacacagatccttgcttcccactcatgtcgaccaaggtcactcgggagttttccacacattggatcttggttacaacatataaattggaagcttctgctaagtacccttctagcaccttggtagaccatttgcaaatggaagccttactggtcgagaattatttttctgaaataaaacctcaatatcagtagcatgtgatatctgctttcataaaccaggttttgttggaattggttttaatgtctatttgacaatttttagggaaaatgttaatgttttgtgaggcttctcagacatcagaaagttagctaaatctgacatyagaggacactaaagttcatcttagttctttttaagaattgcagcatcttcagcttttatgagcaatgcgttctcactattagttgtttccgtgtttatacattgctcccactgaggtttaggcaaattcgtgtggtattgtttccatcattaaattgtaaactctttgagryatacactgttacttctctttctttgttatcctctcttagttttgtgacctagcaattattttctcattaggtatatattcctgcatgttacccatcatgttaaatrtaagtgatggatgttgaggagattagttgctttcctgcagataatgttcccctgtagtagctctctgtggtcctgagcattggtgtgtaattcagaagtaagtattgtacttcctaaattaaggatagcttcaattatttgaactctaagtggagtgttcttttctgaaagaaccaactaaagcaacttgattcctgatgatttcagctgagacatatcaggggatggccaggaccttgagttggatgtggtaacaggtgtgcctacaagtaaataaaaggtgcttcaaacactttttttctctcaaaaatgtgtgtgggcagggaggaatagtgtttcagctgctgaactgatgcttccgagaccagcgaagtggtctgcagggtcagctgtgggaaagaggaggtgcccggaagagcctctgtgaattacccgcgccccctccaccagggagccagctgccagccccgggggccagtgagaaccgaggccttgggaaagggcttctggttcttccaggctagagttgagtccgtggcttccctgcttcctgcagtcctttcccacactggcagaggagagtttttcgaagtaatcgtgacatttttccatctcgaaaccttgtggcccattgttttgagttaccactcatatagtgaacgtttgcgtttctggagtatttctagggagtggtcaaaccccgtaacatcccaaccagcaaacctgtaaaacccgcctcatgttatcagacttgtgagcccggggtactccttggtgctttgtcttccctgtgtcattgctggattcagttgtgagatcattttgtaagaactggaaagcagagaaagaagtagtagtgaatacttctcaggatagagctgtggggccacctgctcctggaaggggactgtaaaattcagagatgaccggggaacgctcccctcaaaacagtgttgtcaaatgaaaatgaatttcatgttaaaaacacacasacacacacctgttgcatttatcatataaaggagaaagaatattgtaaagatggaaccgttattcatggcaaaggaagacaccaaacaaagaaaaattcttttcttctccgtcttcacaatgcttacacccctcatcctcgctgttgcatcagcttgtccatataacccataccaggagatggattgtggccaagacaagccgtacgatggcgctctccataaacactgtcggaatctggagcagcacgtgttccttcagcagataaaaatggcaaaatgagaatggcacacattgttttgcaaaggtcggaataagactccacgttttaggaagtgacgacgaaccgtctaattctaggatgttgaattctgcttggccacgttgatgtatttagtagtcgttamatttgtcattgcaactgggtctggattctgtatattcttttttctgttatgtagaactgtgtggctggagaaagcaactttgtctttagaataaatacttacacttatttctaaatataattacttaaatgagaacttagcgtctgacatggtaaatattttgtcttaaattgtaccaaytgccacatgatatccactcccaacatggagcagtaacccagggatgggagggaagggatgactctggcgctccagctcactgtcacctgctgtcaggccatgtccttcatccgctgcatgcgcatggtgccccaagcgcagggttgttgttttttttctctccttcctttcttttgtaaactgtacctctgacaacattggcatcgctctgatcatcagacctttgggatgctggaagatggggggtgccgtggagttctccacagcaccaagcacttcactagttgatggtgggtgttcagtaagtactcacagagggaatgaatgagctcaagcaaagtgatgccaactacagcactaaagcaaacaggaggcagatggcatgcacagttcatacatgaagagacaccattacaagggaaacataaggaaaatattcagacattttagattttaaagacaaacaagattagcaacatcaccattttaagcttttgctaaaaaactgtagagataggaaaacccactgttgatgagattaataactgatatctgcagaggttttacagtttacagagtgctttacataatttgatcattatattaaccacatggggcatactgttatcattatcaccatttcttcattattattattatccacttagaaattatggactaaattgctttaaagatgcccaggttccatcttcttttagttactggtcattaagaaaattaattagcaacatatatcatgaatcagaaagatatattatgctgtttgttccagtaataacgctgctgagaatttcttctaaggaaaattcaaaagtagaagatgtcctttgcagtgttgtttatagccagaaattggaaacaaccaaaactatccagaagtagaaaaatggtgatataaattatctacattaaatcaataatgttacatatctaaaattatgaagattacataacaacatggggaaaatggttaggaaatcatattaaagaagtgtataaagttatatcttttctgtggccataaccaagaacaatgtatgcatatgttcaataaaaaattgatctgttagacgagattttggtggatttagtttacattatttgtatatctgtacttttgccaagtaaattttaacagtacaacaaaataggcccccattatttttttccttgacatcataatttagaacagggagaaagcagcatacaatgagctgtttctacgttgtaggaaagagctgtgtaattccaggatgtggaatcctaagcctggccacgttgctgtatttagtagtaattacatctgtcattgtgactaggtctgaactctgtactctgtcttgataaacataacatggaaaatctcttaactaaacaaaaggtatcaagaaacaccagatttgtgtcttcctagtagatatgttgaattgtactcttttacaaaacaagtatcacaggatgcagagtcccgaatgcctacatcttataagatactgaatgtgtccttggaaaaaaaatcctctcagcctgaaattccacttgccaaaagcaaggcagatctccaatgcaaatacaggagcgaatgggccccattcacaggccttaaatcgtgtgtctcactttttatggtagtgttgtgaattctgttctttttgggtttgtaattagaggacagaacagatggcgaaggcctagtttgaagtgatgtgactgttaacgtcgcctccttcatccagttgtgattccagggaacccggttttcccacacatgcgcacaacgggcgtggtgcagctgtagggtttgcaaggtagccgctcacgctgagtttttacagcatttgaagctgcctgtgaatgagattggaccgaagaaagccgtccctggatgtttctaagggtgaaggctccataggggaagggtgaattcttgtcaatcatattcctgtaattaggatttgttaaaatagaaggtatacaattctgcagtgggaataaacgtctgttttacactcaagtgctcatagaatcctttttggctttttccccgccctctttctatgtacatgaaagttcctatcgccatcaccaagagttgctcctcttttcaggcttacttaaccaataagtcaaatgccagctattattttcctagttaaatgctttggtgaagttaagtcctatttgtaaagacagaccaaaattggaaggcgcagggaatgaacttttgtattttgttattgttattgtaaagatttgttgatgaatctttatttgaatgctatgaaaagccatcatttcagagtatatttttaaaaatcagaacaggctatttttaatgtaataagctaatagcttaaaagagggattctgtctttgatgtcatttggtggatgaaaacattcttgttcaatagaaaaccagcatctttttcatgctcatttgagatcagttcaggcaacatactgatattcattcagatataaatgccatattcactttgaaatgcaaattgtgtaaagaaaaatagcatatggtggaggtaagtaccttttcaaatcaactcttccactttagggatataagtacagctaaaattattctttggaaagaatctggcgcttttgacacatggaagcttgcactaatcaaggcagctcagtaagcacacacacatatccatatcaaggaagtggcgcagcgaggacatggattagcatggtaatgcagtcaccccctgctaatcggggcgagtaccagctgatccgtagatggggtatttgaggaaacactctttctgagttcagaatgggccatgtcgtcagtcatgtatttcatggtaacgcaaataatatttgggggacgatgccgaaaaggtccttttatgactgccttcctgtggaagccagcatcctatactgtttggggctgggccactttttaaggacttattgctggtacagctgtttccttgtacaaccctgttctgtctcttacacttcctgacctgacctctgcattcacaagccattccaatgacattttctaggtttttggataagtgttaytggtacaacatacacataagacgcacagaatcataagtcatrgccacgtttacaggggccgccrctcacatccagaagcagcaggtagccagccctcatggaccccttcctgtcccgtgcacccccaccccaccccaccccactcacaagggtgaccaccrtctgatttctcactccgtagatgggtttcgcctgtccttggacgggatcctaacagttggcactctcgtgcttgtctccggctctgtgttctgtgtgtgatgtcaccgcagttgtggcccgtgtcagtagttccttgttgtcattgggtaatgttccgttgtgccgtgatgtacctacagtgatggacagtgccgtcattcccagcgtggggctgttatgagcagtgctgctctgaacattctagcacctactttttggtggccatgtttatgtgcatctgtatgatttaaatctgaaagatgtgaaaggagaagagaaatcttaaaggaggaaaaaaaaagaagtggacttgaaatgttttatgaaagctttgcatccrgtaagtcaattagaagagtggtgtaggtygtcctgggacagccccgagcttaggaaacccccgtgtttaataagagcacgtaagcaagcctgtccaaagtttgccgtggagagtgacatttactgtcccagacagcaaacagatgtgcccccctcgctgggagtagacactacccctgtctcaccagtctgttcattctgtcaacatcccttgcaagatactaccttaagtctaaggtagtatcttaaggtagtatcttaggtagacttaaggyagtatctcccctttycatctattctttatctagatgggcctaattccaaagtctaaaagctgcagtgtcccctggagcctctcctgtaccttccagcagcggtgggctccctgaccctcatactttctggctgctcttgtgttactctgccttgcgtttgrgccacatgtggatctgctgtataccttctactagactagattgtaggttccctaagacagggactccttccttcattgtgcccaatgcagtaggggctcagttccatgcggctgctcggcccgctagaaggtcaatgttagaataggcggcagcttctgcataccgggtcccatcttcccctactcgcgagttagcaggttagcctgccctaggttcctgggtgatgagactcctggatcaaaatgaatgacagtctcttgcagcaatagcaatagtgagagtatcagcattgtcatgcactggcttcccaagcctcagttcccacagggtgacaccagcacacacagtractcatgttgtaagaggaaccccaagcttaggaaaccccatgtgtttaataagagcacgtaagcaagcctgtccaaagtttgctgtggagagcgacatttactgtcccagacagcaaacagatgtgctccctcttaaagtagacattacccctgttgtaccagtctgtttactctgtccacatcccctgcaaaataacacagagcagagagcacctgcccgtgtccacacccagaggaagaagaaactgaggcccgtggagagctggctgccagcaacagtggggtgggatgtgctggtagcagcagggagagtggaagtcagggaaggatggaagggaagggaagaatggagagtactcaccccccaaagtaggccacatccttgtacttatccccgagtataagtgtaccctcggcttccggggtagaagcttcctttaagacccttgtatttgygcgtgacttgaggttggtgaattaggaccacttgttagactcacctcgtctactccaggaaggagggcattctaatctggcttttacaatctcctccttctagggaaatacagacatgcctgcaaagaacatttccaacgatggtgcgcagagttttcccacatctaaacgaccccagcttcatatcttactccttagacacgggaatgaaattctgtagcaaaacggctgtgtgttgaggtggtccctgatggagacaatccagaggctctctttcctgggcattactggggctgagggttggggcgtggcttcctgcagaccccacgcaccttgcaatcctcrtggcatttctgaatgtagctctatttctattagccttcctgaactggcaactttaatgcctgggtagcaagcacttgggcgtttccttaaactcaccgtcttagctatcaggtctaggtgtgaaaatgtgatttaactaatcaacacagtagcagcagagcttggtgtctttgttgactgtyggcggccacgtgggtttaggtcccctgcccttcagcctggttgctgggtatgaggcctccacctcggcaggactgcttcgagctgacctggactgtgtttagaacagtgtttggtgcacttgtatcctagctkgtcttgatgtcaggatccttacccctcaagcaatcaaaaaagttatccagcttgtttcacaaatgagaacttcagaccttcagccttaattaataactcattaacgtgaaatgaattccagtgagtgaaaacagttgccctcgagtactttgagtgagaatacagtgattttaaacagaggctttttttatgcttaaagatatttccaaaagtgttcaaaactcctgtgtggtaacacatagggcaggtattgcttgatgcttacataacaaaactggatgccaggacagcattagtaggtcaattarttaatgacattcattcaagaacagaaatgagattacatattagactctgtatgcatatctgtatcaaaaaatgcatgagaaagtatgacactataattggatatggaatgtgcatgattattaaaaagattcactccacatttgggggtggttcgtttctttgacgggtggatttactgaaagtaagtggaaatgcctcaaaactgtggccactggcctgggactgctgacacatggcacgagatgctccatgggcgtgttaacccagcatggcagcttccacagtgtcgtggctcaggtcgtggaccactggtttgcctcagagtttaagcagatgtcttcatgcatttacgttgaaaggcaggtactgtgtttggatcccagaaacaatrtttctgaccctgtrtaattttttttagtcaaatatgtttctgcattatcacacaaaatacttttgttttcttttgttggtttttctgaaagaaaatttaagtgatctcaaatatagtgaatgggtatattttgaaacagagatttactcccttaagagaaaatcggaaatgttttgcttatggaatgagcctcctcctccgcatatttttggaaggtcctgaccagaggtcaagagtgaggtgggttgagtgcagtggggtgkggggaggcaggtgtgagcctgggcaaccccggaacccactcagatccttcagacagatccagagagagaggctgtcagctctttgttcataaacacaggcccacagctcccagatgctttcattttctaagtgatgccagaaaccaccaatttttaaatgaaatctcccaatttaattctactttgaaaaaaatgatcaactaagtaaaaatgtctctrtgagctcagcctggacgtcaggcgatagtctgtggatctgattgaaagtttcacctttatcacggtttgtccatgtatacaccttgatgtggcccaaattcagtcatgctgtttcagtgtagtcccgcagtgggaagtgggtgtggctggggctgggggrccttcacgagctatagggctctaagagtctgccgtcagaaggattgtggatagctggtctggtgtcttccatctggacaccaggagcatgtggtcttgccaggaggttcgtcaccccagaggttccaggttggttccttggggactctctcaggaggcagaaggtgggctctgagccacaccctcagagctgctgcaccagcatctcagtggattggacttgtccttgtattttgatggacagacagaagtttgaaaaccagtacattcacagcagcattcacagcagagtcctgttgttkcctagtgtgtaggcttgaaggaatctctcccttcctttttggcagtgtgatgtttggccatgagatgaagaactcataaacctaagatgagttcttgatcagcaacctccattggaacatttcgtggtcccttgtctggggttgagattgacttggctctccttactgtgtgttgatacttacttctggagctttattgcaagtagtcagtgatggatgcactgaaatactgtcctctgccttttaaaggaaattgttctggaaggtttctaggcctggttgtcatcggagaaccactctccagggagaaggagcaagagaagcggtgctctattgagtgccatgttgtcatcgttgtyccawagatggagggacagacagacacagtgaaattcctttttgtttttcaggtatttggaccttgtgtgcctaaagctggtataaaatgaggtctgtggacagatggcatgcttaataatgacttgacaggggtctgattgggcattgcagtgtggaaggaattacctccttatcatcttacctacacagcaggtgtccctgcaggtagagcaggcccagaagtgcctggcacagcagtcagggtcccagcaagggaggtgcccccccaatcgcacccccagctgcttgcaggcatcttgtcattgtccttttccacctttgcggagtcctttcgcccaccataacagtgtcagcagtgtctggaagccttttgtctgctcagaattcacgtgatgaaagcggaaccaggccagggaagcccsggcagccactcttgggaggcgcctcctccccaaacgcaccttcgatgggtggatgtgtgggattgagagagagaaggggaagagaagcacacaggacagtgcaggcaccagggctggcagaaatgcaccaggacaacccatgggccccaagggccaaggagagagggggtcacccagcaagacaactgctcggggaacgagccctggagtcagcacccaccctcaccctcctctctcctttagattcctgccatgctcaccattggttgagcccagtgagaagctagaaggtgctggagccaacaggtgcagcccatatgggtgccttcccaggaggagagcagggcggagaagggatgtgaagggatgtagcaggaacatggtgggcacgggctccaggaggggrtcccgagatgggagtatctcctctgctcctcagggatgctgccttctgtggggtctgaatgccctattgtaatagggatctggctaagrcacacaatacccagaggacagccacagggtggcttcgatggtggcacgtggaaaatacagggaggagcatgagtgctccccttagtgccatgtcgccagctctgggctgctcctccacgtctcttaagatgccacatgcctggccyacctcccccggctgctgtgaggcctggtgcaagagcaagcatgggagcaccacatggcactgtcattcaagatgtgggctccaaatgacgctgtgtgtttctagggcgttagggcacgcccatgccctgagatggagctctcagaacatcagggcttgggggcatgagaaacggcctcaagaccctacatgtaagcaggggagcccagacccgaggcttccgagccactgccctcgctcctcccacctgagccccttggatgccagtggtctgccgtggtggagttttgattgtgattttttgttttatggtggtgactttctggctggagtggtttttttaattaatgtgcacacagatygcctgggatcttactaagaggcaggtggcaggtggggcctgggattctgcatttctcgaatgcctcttggcgatgctgcttctgtaggtccgaagaccacaacctctgtggctttccgatccttccttccctggggcatcactgtgggcttttttctggaatcaagcagacctgcctatgaataatttcccttatgacgttcagaatgtactcagttcagacaacagcataaaataggtatcttttctttttttttaaggcagaactctattcttcaaagccaaacgcctcgtcgtttgttaatcgctgattgggtgtagggctcgtacactacgcttcagctcgtggttccgtggcttcccagtgctgcacgggatcgcagtgaggccgcttgtttgaggggagacctggttcytgcctctggcttctcatccayatcaccggagtgcttttgaaaatgcatcttttcccaagccccattcccagagcttctgaatcaaaatctgtattttttgaagccactagttctaaaaagctccacaggaaattctggtaattggccagatttaagaactgctaatatgggctgcgtatttattataaaatcctgcactgtgaaaaacttatgttgagacagcttagaacttagctggttctgaactaaaacaattggaagaaaattttttttaaaaaagccccagtacctccgaagatctgcaaatagacctaacagactaattcgctggcagcagggtatgattggctgagctttagagaaaggcacttaattatgtttttgagtctaaaattggtatgaccagataataattcattttgatgttgagcaactgattcaaatcattaagtatacaatggaatcatttttcatcacagcccctgtgctctatgaagtcacgcaggttgtttttcctctgcttagtcttttcaaggttaagagtaaacttatctggttgaagagcctgcatttcctccgtgtcgtgtctagggactttgatttgtgttgatcataaagtatggcttccccatgaaaataatcctctggcaccagacagttgactctcaatgggtgatcattttctgttccattggtagggtgacatggccgggctcctggagcccccatcttgccggcctgccggatcgcggtgtctctgctaagactcgctgggtcttttgtcttcacttccactcgatgttgcggttgcggttgggttgcgtctttgtatagggttgttcggtgcgagccatctgtggcatcgggtcccttcacattgctttgtcaggcaccatcaagattggcgtcccccttttattcctcccgaatagtttctgtctggcgcttccgtttgccatgcaggcaggacaggggctgctctcggtggtaaggtgcactatgtgccagcgtgtgggtcccatagactaactcgcgctggtttctgtggtctgcagtccgcggtggtgttcacctgacttgtttattcctagggaatgtcactagtgcatctgggtctcagatggcaagcggcatcagcctggtctccttcaacagccgacccgacggcatgcaccagcgctcctactcagtctccagtgccgaccagtggagtgaggctacggtcattgcaaactcggccatcagcagtggtaagagggggctcagccccacggacccgcagccacctcaaggtccttcgttgtaagccaggggctggacaggacgccctaagctctcatgctcctctgggagcgcagcaccctgtggggcggctgcatcagagactcacatcttgcctttcatctgtggaacrttttgtccttgctaggctgtcttgcccctgtcatctcatctgttcctctttggcacagggaggagstagtcatcccatttggtcagtttggaaactgaggcggcagacagggcaactggcttacccagggtcacgtgacagaagtggcagcgctgagaaataagatctgattttatctccccaatcacactgccctacgtggcgtggcccacactcttccaccactagtgcacattttatatcattagggtgaattcagtctccttgtctgttttccagaattcctggtgtaccctctaaattctggagtcccctttgtaatccttcagttttcaaattcctttggcattattattattattattattttgacaagtgtatccagctttttggggaataagcatgcacgttggaaacgatctcgccgtctgtgtggagcgtgaatgacgcagcaccgagggcaccctggtggctgcagcagggtttgcctgtggcgttttgtctctggcctgttcaccggtatttaaaggaattcccactgttgtatgtaatctatcagacggggttttagagtaatcttagcataatttgttctaattaaaagattcagcatcaggtcttccctgtagacccaccagctgctgcagcaggacgtttgctttgggtaaacatcatccttatttctagtggctccgcagacgccaccaagcagaagccttaaaggaagacatctccaaaccaagccgggagacgcggagtcagcgaggtagctccacaccatagcggtgcgggtctggaagagccttgtgacttggagcagacacacacagcgtcacgcggctgccccggctggcccattcccatcccagcgccagggcttgctccttccctcaaaagaaggtgctttgttagatagcaaagatctgcctgcagcttcttcaagggctctctaaggctctctgcctcatctggaatcacgatgataaccctgaaaaccccaaacaaggaggtttgaagttatgataaattaaccgtctacagtttactctctttgtaaccactgcatgccccagcgggcctggtagtcagcctttcatcagccctgtgtgtgctgcagctgaagccccgccacctgccagccaggcagcctaggatgagcctccgtacctccatgagcctccgttttcttatctgttcaatggacacgttctcccctcccttacgtagaagttaggcatgtgccacaacacaggacagtaggctcttcgtgactgaagaaccactgttaatcatggttcctttaggaggagcagagagttcacatactcgtttcattatcaaatactttaaaatatgtattatcaattagtattactatttgataaggtttcattctgtggccgccatctcgtgaaggtgttcttgcatagggccacgtttgagggcgtggggagatgcacgctgggccttctggagccaggtgcacaggtgacacggacaaggccttgccttaccaagcagcctctgctgagtgagagtagtctaggtgccaataatacaggtgtttaagtattcatctaaaattcatcctatacagattttccttttgcacacttacctgtttgataaaaactcactaggtaactttccctctactgaatagctctttctgttgagctgtacgtatgtgcagtgggcgtttccacaccgccacatcgtgagacactgctttccagagcctccgtttggttggaagtctctttccatggaagtgggctgcattgtctgcacgcatgcatttgtacagtacccatgtgagactaaagtcgcctacgtttgaatgccagttttttattcacaaagcaatttctataatattaacacacgtgggtgtccattaaagaccagtatgctccctgacctcgtaaatcttgaaccctgaacatagaagataagaaacaagcaagcggatgccccaggtgtcagcctgctgagggacatggaaggagagctgtagggagagcccagggctgaaattgtgcaggtcgtttaaggattgatagagttgatcaaggaaagcttcccaaagaaaatcaaacttgagaaatgcttaaagaaccagatggatttttttgtrcaaaacagcaggaggaagttattataagcattggggcacttcggacaaagacccagagaggaggaaaagggaagatggaatagccacgagccgcagtgaagtgaaaggtgatagttggggtgcagaaaaatgaggagagaccagaagagatgagtgttgagarcccagcactgccaaattagcatctgattttcagacttgggagctgacattttacagagcaaagatccagaaagacagcagaatggtgcacagaagtctgattcctacagctttatgggggtcttggttgattcctgtattttctaaggattttttttttttttttgagatggagtcttgctctattggcaggctggagtgcagtggcgcgaccccggctcactgcaacctccgcctcccggactcaagcagttctcctgcctcaggctcccgagtagctgggactgcaggcacgcgccaccgtgcccggctaatttttgtatttttagtagagacggggtttcaccatgttggccgggatggtctcaatctcttgacctcatgatctgcccgccttggcctcccaaagtgctgggattacaggcatgagccaccgcgcccggcctttctaaggattaatagtatgtcataccggaaatattttgaaaagggagacaataatcgtaataataagagctacagtttattgagggctttatgtagataatctcatttgatcctcacagagtagatcctgttgttacctgccttctacaggggctgcctttggtacagaaggattaaatgtcacttgctcaaagtcacatcctgtgaggggccaggattcaaactcaggtggcccgattcagctctccatcactgcatgtcaaggtgtgcctccaggagcagcagcagcagcagcccctgggaactgcttagaaatgttgatctcaggccctgtctcagtcccactgaatccagtcctcaggggatgggaccaggcaacctgtgtatagcaagccctctgggatcacatggcatgctgaagcttgggaaccactgctgtaagtcctcacttcccaaagcctggtccacggaccaagtggcatttgacagctccggggatttggctggtgatgcagaattcaggctccacccaggcctgctggacgcatccttgtctgtctgcgccgagggtaccatcccggcgtccctctggttcgcgtcattcccccctttagtgtgctgcttcgtcaagtggccagaccccagcaatgtttagtgaacaccagggcacaggatctgatggacaacttccagaaaacgtgtttatgaatggatttcaagactcagccttggcataaacattccctgcagggcttagaaaataatcacagaagaaacaaacatgattaagagctttctgtcatgctctttcttcttaagttgccggtgatataagtcccccctgcccccacttccttttcgaatgtatctgcccccatccctagtctttggtttggatttcagagtcgcttactctgtgctggcagcaggaatgaatggggagagcctaagcagctttggaatacagacgcccgtgttggcaagtgtgccttcccattgttgtgcactcttactctaaaacataataatcacggcaacattgggattcactgtttctccgccccccgtccaccctaaattaagactttggctctggagaacttttcaaagtctcctctctagacacaccggtccccccggggtttcttcctttaaagcagctgtgagaaactcctaattagatagattcctttgtaggggcaacctacaaaacaggaggtgctgcttaaattaagggaagaagaaaagaatccatttcgtgaaatggaatgcccactgctttatgactattactgttgtaaggtttcacatttaagtacctgaggtttaaaattaaatgtctaatataatttggcgttgctaacatgagacctgcatctgcccttagagaaaatgcagacagctcggttgagggtttcaaattgccgtctgccggcttgcaagccgcacggaggattggatccctcctctgctgagtaccacatgctgctgagcgtaattttttaaatgcagaaacatattcatcttgagcctctgcattgaaaaaggccgttccaggagtacatgaaaaattaatttttttacattttttcccactcttctaagtgtttgacagaagtaatttttgcagcaagagagaataaaaactggtggctgtaaattcctgtcctgcaacctcttgtgtagattctttatggacccagaattgatctacatgtcagatcctgttgtggtttaaactgtttatcactgtaatggcagtagtgagcccktgaccaccaacttataatcctgggtgaaagaaattggtgtttgcagtcaatgaagaggcagctttgctttattgatagattcagaacaattatctctgcaacaactattggctgagggttctcttgaatcttattggaagcctgtaattttttttgattaatcatttcctccataggtaatttcctctagaagcgttagccacgagtcagcatcactgtgggtagcaggggccctggggggtcgtatgtggcatacttggccgtcctgtcttacttcaagacaagatgcacgttgagatgcgtcacacctgtcctcagggccagagtgctcacctgcctgcctgcctcctgagtacctgggtgagcctggcccggccctccccgctggctcctgcctgggccagcctcgtcgggtggtctcagctaatgctgttgccatggcagcctcgctcccccagccctggactgtcaggttcttctgatagctccaccccatccccgattgcttcagtccaacagtttatcttctgccacgctgactggccatcactgttaatactgcatttcttcacgtgactcttccatgtggctcttgagcctcacttccctcggcctcccccaggccaccacgcagcctcgtcaccatcgagcacaaacaccatgtccatcttccacatggaaggagtgtatcacrtgtgtgtgtgtacgggtgtatgctctggtccctgtttccttctggccacgtaatcattatatctttccagtagactctgtggttataaagcagccgatcctcaatggaaagcatttgagtttttgccagcttttaaatgtcttttctcattataaaaatgttttgcacgtcgattttgatgatgggggttcgaaacatgagtttcagcttcggaagctgtctgtcccacacttactttcggagccaatgcatttgaaccacactttccagcaagcatgtccacaccattcatcaattttaatcattatagttggagcattttttttctcttcttggatattatactgacaattttagtgtatgaccagcaggcggcggtaatgtgatactgccggtctctgacctggaagcttctttgatgggagggtatcagtgaagcgtggtggggaggaaatacatgtgttgacagcctccgctgttgtgaccttcatgcctaacactcgtttccctggggatcatcatctctgataactgagcttccaaaaggctgagaaaccaagaccatacttatcattattagccaaaattcaaacccagatctttctgatttcaaagcttgtaatcattcccctctgcttttttttttttaaggagaaacgcatgcttagtactaaaacattgtatcataaaaattgtttgtcttttgatagcgcttgcttttcaaggaaatatgttctaagatggatagacattttgtcttctctcactgatgctgaagtttcctttatcaattcttcccaaatcttggctggcattcaaaagcgttccctgggggttgtcatcaaccttcagcttagctcagtgttaaaggcccctgggctctcatctctcaaagctgggcactccctgcctcaccgccgggagggctgctcggctcgccaggctggccggcctaattaaaaggctgaccccgctcccttctgtgctcggagcctgctttcctgtctctgcatgtggccgaggagcaggcagaagcgtcctggggtaactggacacagggggtgaaaggtggattttttttcctcccaatcagaatgttktaactttgtactttgtctccttagttccttcctatcagctattttcagcagtagctgctgaccaggggaaacagaggacagtgaaatgctgccccatgatcaaaaccgaacaggggcagcacatttcattcccgaagaccagaaatcttcatgttgttgcaaggcaaaaaaaatctagaaatgcttgtaaacagggagtagagaaggatattgttgctagttgctgtagtgcccggaccagacctcttggccctctggccctcggcgtgtcttcacctattccaggggctcgcagccaggggtgattttgtctccttgggacagttcgtgatgtccggaggcatttttggttgtcacataggggagggtgatgctactggaagctagtgggtagaagccaccagggtgctgctgagtgtgccacggggcagagaccagccccccacagccaagagttattcagcccaaaacaccagcggtgccacggtcaggaagccccgatctggacaatgaaagtttcgcttccttggccccttccagctgcggttgctkcrttgcacagtaattcagtaagaatccttcccaaagaaaggaaagccrgtttctggtttgcaagagggtcactgcagccaacccagagcagtgcctgatcctcagggtgctttccacacagcttctcagagcatccgcctggcggcacggccggttcagcggcagtcctgctgccaccagcgtagatgtgatgtaacattcatggaactcactgcttgccaggcacaggcccccaggagatgagtgccagagccttccctgcttcagatgaggagatgagtgccagagccttacccgcttcagatgaggaagcaggggcagaaggcagttgggcctatcgcagcagcaggtcggtggtcaaggctagattcaaacagcctgtgtcataattgtcactaagctgttctcctgcccacccgaccgcctccaagaacgctgggtgcgcagcgtgtccccctgctgcgcgtatgaagacagggagggtgaggccatcagatgtgtggatgccacaagctgagacataatctacattgaaatctccagatttagagactacaaaatgggttgaaactaacaaattgaaacagagataaaatcttgaattcaggctcaacaaaccaacagtacagataatggaacaggagtaccggacctggtggggaaggcttgggtgtggtttgtctgcagaaacgctgtcaagacttacattctgcactaagaggaygagagaggttctgaatgtctcactgggctccgaggatcctttcgggggccacattttgagaaagacatcggcacactgggaagcacatgaagcggagggccgagatggggagaggggcctgaaacccacaacacctagcgtggctgaaaacctgggagggccggaggaccctctcaggaaggcgtcgtccaatggctgcccattatattcttgggggcgatttttaaaaatacttgttcctggggccagccgctagagatctagtccatttggcctgggatggaacccaagcagtggaatgtcccccaggggkttcagatgcgcagccagggttgagaagctctttcagagggacctgaatgatgtgtgtgaatggtggttataggacaaaatctgatcctgattctgtataaacccagagaattgaactgggagcaatgggtaggatttgcaggaaagacaactttgacaccaagtagtatgatgcagtgagacaggtcccagcgactgtttccagccttctcctctggcatctctgccttcctctcccttgcctgaaggccctctgcatcctttcccgatgaaactggggaacgtscccacttctctcccatgccaaaacccatgcctctccagcctctggagcttccatgtatgatctgttcctgcttggacatggggtagggcatcccttccacctctgaactcatcacctctcatcttccaagggactctgcttccgcggacaccctctctcctgtcccagcggtttctcccaggtattggatcactcccttcagcttacatacctgctcggccatcgctcagcccaacaccatggccctctgcagtttccacctctccttctattctccttctcaccrcacgttccaggacactcgtctgtcctcagctaccacccacattctcttcaaccctctcccatgtgtcatcagcccagcaccctccaacactgctctcatccacttcagtcccaggagcaccccttggttcccgtggtaatcttcatagtgggagacctgctgactccacatcttgcttgaaaccctctctcctctgggcttctctgaagacacacacaggtttttcctgctgctctctggctgccccctgtgtcatcctcctttaccagcagacctcagacgatasatgtggcccagaactcagctctctcctgtcctccctgcactcctcttgaaataggcctgaccattcctctagactcagaagatacccaaattcacatccccagccatgactcctctctcctcattgaacgcaggtaagcagctacctgctcggaggggagttgggcggctcatgctcagcatatttgaagaactccagctttcatccagagcgtctgtttctcacccaccttttcaccatctatcctcccagtagttcaaaacacacccaaagcatcacttgcacaccctccctcggcctcacctcacagtctgttcatttgcttggttccctccacttgacctccaagaataccagctgggtttgtcctgtacctccacctcctctgtgttcccctggtccttctgctgcgtcggtsctaactcatctctggcctgtcattcttacttcccaaaagtcctctctctctgcagccaaattcaccttttaaaaaaacaaaacatgagccagattgccactccccacacccactccagtggcttcccactgccagtggaatagattcccaattcttgatttctggctgacaaggccccagctggtctgacccctgttttttgaccgcctctccatggctccagccggcggctttgctgagatctgggatgagtcatccaccagatagttcaggcttccgcccagacgtcagctccagcgtgtgtacatcactgcagacagccactctccatcccattctttgcggttacccagacttcttgtttttctcagcatgtattgtggcctgacttactctggacacattcttgttcgactcctacccagtcacaagtggtcatcctgcccctggcatcttgaattgttttcctagcatctgtcactatctgaaatgatcctgtttgcttatgtgtcttctgcagtaattctaactccaccacagagaggggcttcagggtcttgtctgtctccactttcttgactacctggagctgtgtccatcccatcatcacaatgtcattgcacggtaatatgctgagttagtgaatgagcacacttggatagcatccccaaataggaatagtccaagtggtggcaggggtggggtggcttggtgtatttcgttmgatttgcaaaatgagctccaaggattctgccagttttatatgatataatcttctgaatttttaagtatcttaatgctttgcatattgctttagaaactggttcttaacagagaaccagtgctggtgccccttaagacagagcatgttggtcacagtgtatacagtttatggcagaaaacactggcagcagtctcagcaacaggttcttaaattagtataagtagttagagttgaaactggttttcctccctcggatcatcttagcctgttcctgaatcataagtaaagtcagtggtgtaaattaatagggattatgtagattagatacatttcacaacaatttaatttcttatgtaacttcatttagtccacaagtatttattgaccacttactgtggccacccactgccctggccctgggagtggagcaggaatccaaayggagttcccaggtctctctaggtacaaaagaagaatcgacggataatcactaaggaaacaaattgaaatgtgctttgtcaggtggtgaaaagtaaaatgagggtgagcaggtgcaaggcatacgttcgcattctgaagtcaagtcgtgcatgcatgagtgtgcgaattmctaagcatgttttcaactgagaccatcacagcaatgtatctgttcatcattcattccattcacttgacaaatatataactagcgctttatcgtatgcagtggtgtcccagggtacattgggaagtgaccccagagaagatggrcacatcagttgatccaatccaatcaaatgctgccaagaactcagtaggctaaagggagtgtgggatccatgcgaagggaagggtgtgtgcggctatggagctttgttgttgggggggtaagaagggcggacactgaaggcgaagcacagaggaaggaaggagcgttccagcccggtatggaagagtgaggaaaagcattctaaaaaggtttgcccgtgatcctgagccagcagaatgccctgatggatgtggcccagaactcagctctctcccatcctccctgcactcctcttgaaataggcctgagcattcctctagactcaagatacccaagctcatatccccagccatgactgctctcatcatttcctagggaagagaggaatgtgatttgaaaagatccctcttgagtcagcctgggttatcatctgctgtgtagacagctcatgccaggctgcgttaatcgagagcagagtgggctcactgcagacaacccgcgattcccctggttccaggagtccagtagccacgggtagagccgtcactgaaatttgcatctcgttctttggttcctttctcatttgcttggcccagtttttaatcaggtcacttctcatgggcctcaaggcaacaatgtgtcattaacttacattttaggctgggcgtggtggctcacacctgtaatcccagcactttgggaggccgagacgggcggatcacctgaggttgggagtttgagatcagcctgaccaacatggagataccccgtctctgctaaaaatacaaaagtagccaggcatggtggaacatgcctgtaatcccagctactcaggaggctgaggcaggagaatcgcttgaacccacagaggttgcagtgagccgagatcatgccattgcactccagcctgggtaacaagagcgaaactctgtctaaaaaaaaaaaaaacttacattttaaaaatttcctagcatacagaagtctaaaattttgtaaaattatttagcattttattaattttttagtccccatgtttgcagctgcaaattttcaatttcagggggacttttttaaagatagaaagcatcttgactatcctagcttcaaattaggaataggtagtacagtataaaaagatttgtcaatttgagaccaacctgggcaacatggagagaccctatctctactaaaaaaaaawttcatttaattagctgggcctagtggtgtgcgtctatagtcccagctacccaagaggcacatatatttgaagatttgtcaaatatatgtgctgcttctccaactggaaataaaactttgtgatgttttgtgttctcaacattagaacgtctgattttataatgtacattttgaagcaatacaggactttttttccacatgactttatacaactcttgggacaggaaaatattcactttgtatttctgtggtttgctcagttccacaacctaggaacccaacaggttaagaaccgtcaatcatactgcctccctggtgactttgtcaactgttagaataacattggtcaaatctttttcatttcctccctcacttccttttgtagattttataaacacatgcaaaaaggcaaagacctaaaggacttaattttttttttttttttttttttttgacacagagtttcactcgtcacccaggctggagtgcagtggcacgatcttggctcactctgaggttcaagtaattctcctgcctcagcctccctagtagctgggattacagccgcatgccactatgcctggctaatttttgtatttttagtagagacggggtttcgccatgttggccaggctggtcccgaactcctgacctmaggtgatccacctgcctcggcctcccaaagtgctgggattacaggcatgagtcaccatgcctggccacttaaaattttggggggtatcgagaagaaagaaaggcatggaagaaatgagtgttggagaagagtggtgtttaaaatgaacaagttgttacaagatggttataacatggctaggtcgagagacagccagagatgggtgacagagggtggggtgtggctgagcaagcccactgtccagcttctccgttaggatttgtatgttactttggttttgcattcttaaacttctttcaatgaatatatcatgttacatcttggctttattatgtgacagataaggttattaacagaaagtgatattaatattaattatacaatgatactaaaaattttatatcacacagaagcagatggttatttttaatgacttaaaattttactcttttatatgagaagaaacattttaaacatatttagttataaatgctattttaattgctacattatttctgcagcgggatttttaaaatcttactatagttgcagggaaatatttctatgtatatttcagatcctcttaaattatatacttatttacaggaaacaattataattacattgagaaaacagaatggggggcttcaaattatcgataaatacatcacactattctcacacatgatcattccatctggtcatagttcaagaattcagctctagtaggaggcttactctctgagcattcatcaagttaacaaccttaccagttatctttttaggtactctatttttgtaatgtttgtagataaatagtcctttgctggatttttaaatcataactgggtaagcatacgacttaagaattatttcctatgcaaaatagaatcagaaaattccatctacttacaaattctttatgtacttccacattttaagctttccaagttgggaaactcaacttcaaaccagctgttgacccatcctttgttctatatcaagctttgcattaatgcagaaactgaaataagtatctccactccccaaagtgatacatctgaagtcatctggctgactgtgtgtccagaggcaccacgtcagtgtctctttgccagagcctttatgggggtggtacgaggggaactggagtctgggggcacgtcaggccttcatcaatcagaaggcagtggcagcgacagcaagacaggcgggtcaggcccccagatgagatttgtgaggctgcggcatcgattctgaccacayattctggaaaaattatcatcctacaccaccttctgaagcagtcaaggtttgggttattacctggaccagcacccggcttttacataggaccttctcctgggggacggtggtatcgttgtaaaccaaaaggttattgatcaaatcttgctaatccaagttcctgacaattaattttttaaaaaagaaattatttgtccttttaaagaacttttctcttttcctaaaattatgtgaagcttttcatttttaaaattcttttttgtttttttgagacggagtctcgctcttttgcccaggctggagtgcagtggcgcgatctcggctcaatgcaagctccgtctcccaggttcccgccattctcctgcctcagcctcctgagtatctggggctacaggtgcccgccaccgcgcccggctaattttttgtatttttagtagagttgggggggggttcaccgtgttagccaggatggtctcgatctcctgacctcgtgatccacccaccttggcctcccaataaaattatttcattacagaagcatggttaacgcgtgcgctagcagaaaagtcccaccattaaatggaggccacagtgcatggctggagaacagcaggatgttggtatctgttgcacatgtttcagcctgtttctacaaatctgcctttttcttctaacatatgggttaactrccatttctctttgctaattttacaataatatctttgcattttcccctaataaaaaaattaaattttagaaacatttaaaatgcagttaagctttttggtttctaaaaaactcagtcctacacaaagctcttagattcgggagtgggtacctgtatgaatccgttctcacactgctataaataaacacctgagactgggtaatttataaagaaaagaggttttgttgtctcactgttccacaagctgtacaggaaatgtgatgctggcrtctgcttggcttccgggggggtgcctcgggaaacttaccatcatggcagaaggcagagggggagccggcacttcacatggctggcggtggtggtgggggcgatatggggggacttgccgcacacttttaagtgaccagatctcatgagaccaacaccaagagggagctctgcccccatgatccagtcacctcccaccaagccccaccgccagcattggggatgacaattcaacatgagacctgggtggagacacagatccaggcggagacacagatccaaattatgcatttttcccctaattaaaaaaaaaaatacattgtagaaacatttaaaatgcagataagctctttggtttctaaaaaactcagtcctacacaaagctgttaattttgggggtgtatacccttccagtttgtgtgtgtgtggttatgtgtttattcccccaaagtggattggatcataataggctttttttcctttttttttttttttttttgagacagagtcttgttctgtcagccacgctggggtgcagtggtgtgatctcagctcactgcagcctcttcctcccaggttcaagcaatactcctgacctcaggtgatccacctgcctcggcctcccaaagagctggggattccaggcttgagccactgtgcccggccaggccttttccacttaaacatrtaatatgtccactaaaattttccatgtcttagaatattttcatgtacttaacagcatttaaaagaaaataagtataaatagataaaatttcgacactctcagtgtggaaactagaaacaatctcagttcagaaactagaaacaatctctgtgtccagaagtaggggactgggggcccctccaaggagaggctgggcagccattcaagtgctgctttctatgtagtagcttggaaagctggccattgaaatcgccaggcgtcattgttctaagaaccagcagggaggcagcactgtgtggtcccgcccctctgcccagccaggcatatccctgccaccccagtgccttttcacctgctgtgcctgggaacccctccccacccttgtgtccaccaaataccaccttcaccgtgaggcctttctgaccccagtttaaacgtgcccatgtccttcttccccaccttacttctgcgtgccaccagtcaccttctgacagcctttgtcatctactccttcctttccttttttaaaaattatatatagatattttacttaactggttgaaatgtgattccttttttctggtttttattttgatttcagtagttttttggggaacaagtggtttttggttacatggatcagttctttagcgctgatttctgaggttttggtgcacccatcacccgagcagtktacactgtacccaacgtgtagtcttttatccctcgccaccgcccaccctttcacctgagtcccaaagtccattgtatcactcttaygcctttgcatcctcatagcttagctcccacttatgagtcagagcataccatgtttggttttccattcctgagttacttcacttagaataatggtctccaaatctgcccaggttgctgtaaatgccattattttgttcctttttatggctgactagtattccataattatatatacatatataacattttcttcgtccactcgttgattgatgggcatttgggctggttccgtatttttgcaattgcaaattatgctgctataaacatgcatgtgcaagtgtctttttgtataatgacttattttcctctgggtagatacccagtagtgggactgctggatcaatgttctgatctgtcatctccccccgaccagaatttaagcttcctaaagggagggactgtcttgtttgcctctattctcaaagcctagaacagtgtctccatcagtaggggcacagtcagcctctgttgagtgaattttccaggtatcaggtggtagaatgagcagttgaacgttactgtttgccagtgtctaagccctggattaaatgctttataggtactatttgttaagtctacgctgaagttctctgaggtggtactattatcctcatttttaaatgattaaactgagtcctaaataatttgaataacttgtgcaagagtgtgcaggtgatgaggatccagcgtgcaatgtacggatcaaagcctgagcgttgggctaggccggctaggccaggctccctgtgtgcccacctgaatgcaggtgtccgcatgaaggccgtgtgaatgaagagggcaggggactcatgggaaggtttacctgttttacctgttccatttcagcttttagtaatgaggacatactcatctaaaagtgtgccaggttttctggggttttttttgtttgtttgtttgttttgtcttagagacagggtctcactgtgtcayccaggctggagtgcagtggcaygatctcagctcactgcagactctgcctcctgggctcaagggatcctcccacctcagcctccggagaacctgggaccacaggcaygcgccaccatgcccagctaattttttgtatgtttggtagaaatgggggtttcaccatcgtgccctggctggtcttgaactcctgagcttctgtgttmcccccacctccatctcccaaagtctcctggcattatagacgtgagccactgcgcctggcctaaaaatgttttaaataaagttattttaaaatacgaatttcataacgagaacacaaattgagaggtgaacatttgagaatttccatggccgctttggcagtagggatgtttagtttgaaactttaatttaaaaagtgagtgcagtgagtctgtctttgtagcgctagagatgggtcctcagctggccatgatagagaaggrtgggcagaggcgggtgtttgagacttggaggggacagtgggggcacagcasccaggcagaggcatgtgtcagggcagagtgagaatgctaggatcctggcccccatcctcccacttgccacacagtcaagaaaatgacaggtgtacgggaagacccaattcaatacagagcagccaggtatcaaatcacagtgctgctctgcagagcctatcccgtgtccagtaaagcagacagcattccagtgttatctggaattatttacaaacgcagtgtccacaatacgatgaatcacaacttacartttagttagattaagcgaattataatttttaatagtcagtgaatattttcacctgcctagatggggagcaaggctctgaatcctctcttgccccagccccttctccctgggtgaggcaagcatggcatgagcagattggtttttgtaaagtgcctgatgtgcagtcaaatacaggaaggccccttctttcatacatgcacgttgagytccctaaacccaaaatccaaaatccgaagggctccattgagcattgccttttagcgtcatgtcggcactcaaaaattttcagatttcagaacatttcggatttttggattagggatactcaacctgtaatttccatgataattttttttctggaaacacctatgaagttgaattggtaagaagtgctgccataccacttcaaaagagggcggtggccagggggtgctcttcccaaggagctgaaaaataccatgaaattcctgattatgccacctctccgcctgttcttctgcaccgtgtctccggatcatcatcttagtctctttcttcacaactgaacagatctgcttaaatccctcgaacacccaaggctgtgtagatttgccgctttgggcatgcctagcgaattccatttttgtgctcttttgtgcctcttttgcrtagtaagcttatgagcgccatgctctttttgctaatatcagttaaaatctttccattttccacttatcctcgtaaaacaaaagcaaaacatgagttggtccagctgcataaacagccttggggctgagctaccccagccacgccgcacccccgagcacgtggaccctgtgctcgtctctgatcaccacagtaccaaaggccagagtcacagctcatgcagaatggaaagttctgccaggaaaaatagactccctcgcctaggcaaaagtatcatggatctagaactagaaaactaactggaatttcgtggaagaaactgcacctgtttcttccttttctgtagccagcgctgggaagtctgggaagacaccaaaaatagcaatgaagcagctccctggagggttgctgggagatgcttggrcacagagagtgaggtgtttgctgggaaaagccatttgggatgggtgaaggtccatgctggagttggagagcgcagaaaatggggtgagtgtraaagtctagcctgggttacggccccagtgatcctggacaaatttggagtaagaaactcccgccagtctcatggccagagtgcccagggaaagtcttctctcccagtggtgactccgggtttcccyagcccagcacaaggacttgggctggtgagctacagaattgcaaagaagagcaggagccagccagccagacctggccatggctgtgccataggatatcacagggtgtgtgggcaggagcaaatgccgggagtatatgcaagagaaaattatggctggtgggaacctgcaggagttgcaggaggagcaaagggatgtactcctgaggtttgggggctggcagcgctgggaagggagggagggaccctgattctggatgagaggtgggtggatagtcactgacgattttaacctcaccccaggggatgaaggctgctgtagggaagaatgaccagagctttctctgctgaatagccagccagccaggattctgcttcctgccgcatccacccctgacccttccagcagccacaggaggtcagggttttgcttaaagaaagagaggaaaatgtcaattattacattttggagcacaatcttacctttcagtttattttaaagcaattttccctaaagatcaaccacagtatgtgactgaactgtattaacgaaattttagcttgataaaggaaatgctttaaactcacagcaaatgtaactcgggatctccaagcacttttttttttttttttttttttttttttttttggctggacagcccaaattccaagacactagtaaaaataatatgataaaactttggtggtgcaaacaaagtcagttcttttttacaaaaagaatattctaatagtatctaatagtaatggtgaattactcatagttttctgctggaagtaaatttaattctagtttttaaatatcattaattctggaggttgcactctgaatgatttcttattttgtggaaaatacgaaataaagaagacacatttggccactgtgatggagctgctttgaaaggctgtgctttagaagacacttccgactttgatctgcagttgcggatgaagatgctcacgagtggaggtgttggtggagatagttatcccaagtagaatactcgatcgatgtccacagcacattcaaattatctttcatgttacaaacttttccagcagttaccagccccaggtacgattatggacaatgctgtcagtcatcgtgagacagagtagcatggaactgaaaaatgtgtagcaggttttcaaacctcttacttgcccaaagcttagtcaaaattatkagatttcctctgaactttgttcttctcgttatttttggaatgattgcagggttggtttaagattgccatgaccacatattaatagttgcactgagaaacaggcgtaaacagaggttgtcccggraaaggcagaatgaatgtcayccaccctggggaaggtggctcgtgtcactaccctttgctacagctgttgtttctcactgattcattctcgggaatcgcttgttgtctgttggtacaaaataaacatttcctcctatcctggatgactggagccttgggctgcagatgagttacaccacaccagtctcccagtcccatcacacacaggcagtttttacaccagccaaacttagagcttcataaatgcaggaaactgtcaggttcctttcaagaggaagtcttagctacagatttttggtggaaacaaatggtccaccctgatctactcatttaccatctggtttggggaaccttctgtcatcctacctgctrtgtatttgtgacctgatatattatttttaaatacagttgtttaatagtgtagtcaaaaatgaaaggtcataagcctcatcttctcattaacaccacaccagattgattccagtattcagtgcacagataacctcatgtttcagcttccttattgaygtgaatgtgctgagcagagctcacctgcctcttgtcagagacatgaatgggctgataatatctagttttcaagcagaggaagttagaggtgaaccgcagcctcagaatctacataaaatatgcagcacagtcattagtcatttgcagtggcccagcaaaatcctaaaacagcaggagagaaaaatattttcttttcagtgtctgtcaaagaagttataacataggttttaaaaaaaaaaatttcatcagccaaatccttaaaatttaaatatgcagacttttttcctgtatttttatcaaaaatgtttatactgttaaaaggttatccaggtaccagataggtgccccaggcagctcatgatgcaaatgtagacaaatatatgttgagtgcccctgtgtctgtaagtcagtctgtatcagtatagaattaggattggattagtgtgaagtgtttgcactgtaaattttatctgtgtttttttttaaaaaaaactggaaatattctgtttygttccactactatttccccagggccttaaacagtgcctccccctgagtggccctgggtagttgttgatcatatctgtaaatatctggagtttccgcacacacagacttcgagtgtgccatcaagatggtgtccctcggtgctgagcctcaccatcctggtggtcctgagcagttgcatcccctccttcagctcagccccagggccttctgttcagggtcactgtggataaattaccagtggaacccaagccctcaaagctgccctatgggctgggcggctccaagagccagagtattgctctgtgacctccagccggttgactggggcaattgttagagccaggtgtggcggaaggacccatacagcctctttcaagtggctgggccttctgtacgaggcacctgacaccacgatgctatcaccatcctcgctgactgggacatgccacccacctccaataaaggcttgggagtcgcaaggatcccttttcataatgaaacttcctgtccacagtttaggagagagtcttgaaatcacctggaacaagaagtttttcaaatattttaggtgtttacaaaatatttctatgaggacagataagggggaatgaattttgcaaattagcatttgatttaacccccaaaaaagtaccccgatggttcccacagttgccttctaacataacaaaaggttacatgtgatggccaagggaaaagaaaacgtaatttatcgttataagatgttaattttttattctccaaaatgttcagactgcaaggatatttcatacagatttgttagctggtatttaaataatattcaacactcctaagccttaaataggcaattagaagtatrctgcatttttttccctccagcatttcaaagacattactcaaattttgtttgttctttgtgctgcagtggtcttacttggcaactccctgtcttgacagacttgattacggagcacctattttgtgcatggtgcttgctggccactgagcatctgtaaagaaaattttttccacgcctgtaatctcagtgctttgggaggccaaagcagaaggatcactcaagctaggagtttgagaccagcctgggaggtatagtgagaccccatctctacaaagaaattatcagggcatggtgggtcatacctgtggtccacgctccttgggaggctgaggcaggaggatcgctggagccccaggagttcaaggctgcagtgagctttgatcatgccactgcactccagcctggtgagggtgagacattgtctgaaaaagaaaatgtacttttaaaaatcaggccaggcacagtggcttatgcctgtaatgccaacattttgggaggctgaggcaggcagatcacctgaggtcaggagtttgagaccagcctgaccaacatggagaaaccttgtttcttctattctctactaaaaatacaaaattagccaggcgtggtggcacatgcctgtaatcccagctactcgggaggctgaggcaggagaatcgcttgaacccgggaggcagaagttgcggtgagccgaggtcacgccattgcacccagtgtgtgtgataagagtgaaactctgcctccaaaaaaaaaaaaaaaatcagagggacacagccacataaaggagacatccacagaagcaatcatagcacactaagggccatgaaaggggtgcagtgtccaagggagctgggaagagaggctgcctcctgtgccactgaagggcaggcttcagccctccaagcgctgctcataggcacggtggtttgtgcagctttcattgtggcaggtctaactgtatttcccaacatcctctctcatcgttctctaactttctccttacaatgcctcatcttttggcggaagtgacttgcatctcgtatgttacggttctgtgttgaggtcctgcgttttaactgtgtgaatgataattgtctggaaaagctgggggccctcgacagccatgtttgcacgttctttaggaacaaggggagcttcagcacaccagcagcctccacaccccgcctctacctgccaaccccttgtgagtccttcaggtttgtccacagcccttgtcatccctcctcgtggtcaatatgcacacatatatatgcttattaactctctccgtttgctggaacctaagctctttagggcaggagctttgtttatttactgctattatcgcagctcctaggagacagcctgaccagggcatgggtctctctgtccctccatgtgtctggatgttgtctagccccacaccaagcacatggtagatgggccacatggcactgcctccccttggtttggcgtggagggtagagttgccttagtcagtctttaactggctcttggccatcttagttgaccaagatggagaagagagcaagagtagggtgaggccggttgagggtagaggttcaggggtgctattttgttcatttcctgtgtgaagaaattgaggctaaaagaaatgacatgcccagggtcacgtggccaggtggctaggctggggctggagctgccttcgagtctgtgcggttccagttcatggagcactgtgcagttttctccctgacctccatctgcttccttcttgtaccctgggtgcgggccatcctgaggagcggggacctctccatcagcacgtgggcagggtgggagctgaagtgtaacaggcatgtcggctccagcgacacacagcttggacatccttacacaccgttggtgggagcagcacagaacttcggctcmgcagcatgtatccagagccccacgaatgctcatgttcatgagcctgtgtctcaaaagctgccccaaagtcataatcctaattactgaaaacacacagaagtactgatttatggtcataaatttggaatccttctaagcagctgggaactgactaagcaaaccaaagcatattctgctctttatgatgttaaagaagaaaagaatcctattacttatcttctatgacatataacactcaacccatgggatgatatctcacaaccaaattgcctcttttttaaggctgggcttctgcatatcaggttttcccatagctgaggacaccaacacactttttctaaccacataatgtcagtagataagagcagggatgtacttcgaagcagcggcctgagtttggtgtattgctgtaccttgagcggagtgaagtggccaggtgcattcaggaccctggacaaagcccctcgctgtactggcctaaggagcccaccttccccactcagataggacactttcctgtgcagcagtgggtcatttgactgcatgtgacttttcatagaaacagctaagtttctaaagatgagaaatgtatgtgatcaaagagggctcctacatctaattaccttcctgatttaattgagttttctgcaagacgcattcagtctctccccagcctgctcaccctcacacgtgaaacagaatctcttttcaatttagcagatctgagcacccaacttgagaaatggtagtggctgattatgtaaaaagggaagaggctggggagaagcgggaatctctcaaaatgatttcatttccacctaacagcgctgcgcatcgtgccttcccatttatcggagttcaccgtattaatttaaactttgtgctgcttgcattcagctaaaaatcagctagagaacaatttgatttttgagccttaactataaattcctgatatgcattgcattcccaagcatgctcccttctgtcacactccccacggcttccccaggctttctgcctcacttggccactctgtgttccttctgtcatcccttcaaactggatgatgccattcggcaccagctggccctctggcatgaaaaaaaaaaactgttgtagtggacaagaaaggagagataccaggaaacggatggggtgcaaagaaagtgacaggaaccaagaggagagagcagaggagtatgacctgggaggcgagaacacagagaagcttgagaagcccagggctgtcccacctgtggtcaggaggaggctgggggacaccccttcagggtagggccccatgagcagctcaagactgggacctcctgtgggtcagctgtgtagagccagatcctggtaggtggctggaggccagacagccacgtccatttgttcatccagactcagctcatggcccaagtctcatgatggcctttagcttcagtttctgggggaacccagccaccctcctgtcccctctgaccctctcccccgtctcactagaccgtatagtggacgttttaaaatcttccttatttaattgctttgtagcatttaatacaacgacctctcccattttttttaaacagctttattcagataaaaatcacataacacacttctcccatttaacaggtgcaatgcagtagtttttagtatctcacagatacctgcaaccatcaccacagtcaatctcagaacattttcatcgtctcaaaaargaaactctgttcttgaattggtggtcagaatatgtacttttttctttgtaaggctttataaacatatttcagtaatcaaggtcctcatctcaatggaagatcaaatttcctaaattcctactgactaggcttaatttagagagatctctgggcgtaattgaaaatggcccaagtaggcaattcttctctcctgtgtgttctcttggttctggctcctcctattgtattcctttcctccccgtttttataactcagtctaacactgtgttgtcttttcctttcgccaacacctgtcatcttcctgggccccctgccgtgtccccgctgcccctctgacattgtgtacctctgtgtgagcggcaaagggaaagggacaataatgccagtctctgaaacatcttcagagatggggaattcaagtcaacctcctcccgctgaaagctcccgtcaaaaggactatgcgaaggggtgaggttttgaacctcacttcacactcaccttttaacagagacccaggatgttgtgatttccttggatggcaaaggtggcctgttctttatttaccggcctacacatctctgtaagcttcagaaagaacagagcccttattaaagatccaaattagctttatatcgttggccgtgtatcaaaggaagtgcgttttaatttacragttcctacaacgacttcatcttgagttcacagggggcttcagccctcaactgatttcctctcctggcacctacaaatgggcctgtctttgataattttaaattattttaataccaagcaaaaaaggatttttagtcatgtacctgacactgccaaataggtaaattaaggtgtgggtggaagtcagcaggggcagggggccgatacatacgtgcttagcattttcctctctcttttcttttgtctktcttttcctttttttccatatagatgcatgcttcttatgaacatgttttaaagcattttgtatctttaatcaacatgtagaaaatgaacagccaacccttcgggaaccattgcagctctcccagagtgagtgttgcctgctcctagcaaattcgtggcgtgcccctcatcaaactacgtcccctgagggagagtggttggaggtgtttctggagggccctgtactccctgaaatccaggctccagggtcagggaagatctgacccgggagaggattagggccctgctaacggcagcagtaacagcgggagtccttgcagcagggaggcttgcagagatcaagtgcacctacgcccagcacctcccccagcggacacatttagagaccctcgggagcgcgagggayatgagaatcacaagcacagagastcatctcttgaatatcacccgggatatcaaaaacctatcagcacacctggcgaggaccctcaccaaggcgagctccctgcaatggttcatcaaaaattgcccagctaatgatcggctgggcagataatcggaggagagttaattgtaaggttcgatatggcatcttgtcagcagagataagttgtcacgttttccacttgagctgaaactaaatgattgtaaaataagttatgagtgtccttgggcctgtctgccggaatgatagctaagaatacattcctggcccatcagtctcaagcaggctgcttgatatttatgcggayggaatgttattttattccccctctagtcatgcttgtcagctctccgagtgaaaagtgaaactgcttctttgactcatacttcacgttccgaagctcggagagactgcagattgtgatcattattgctcgtattatatattttttggggtgtgcgttgaacattgatgcccgattgggaagaactaatggctgacattgaatgtgcgggatggtgccggcccatcccggctcagcgccgcgcagctcgggaccccagtccctccgtcagagccggtttagatgtggagtaatgaggcrctcgcttttttaatttggcatggcttttttctcttagcctctcccctcccatacttaacrccgtcgacagtagtcgtctgtcccggtgcccggtaattgatacaaaataaaatgcattctttgtatgcagccaggaggagcggatggcgctccgtgggccggctggagctcatttacagtgtctcaggcggggctttcggggcctcttcaatttgaggaataccttgtcaggcgaggggagtagttggaatggaaaagcacagcgtggaagcctagtgcgttgtgattgctcatattttaaaccaggggaatgttaaacaactccttgaaagcgagctctcgacacctagaagccaggggcattcatattcccgtggccgagctcagcgcccagtggacgggaacccggtccttcttgccatgagaacacccagcccaggagaggtcagggcctggcctccaggtgggtcctctctggtcgctcctcactggtcttgagtcccaggtgacacttcctgcccgacttctgtctcctgccacggcccccctcaattcacatcctaattcaccccgccatcaccttctcagcaccatgrtggccactccctcgtgtagccggttcccctgctgctgcagccgggccctcccacaggcaagcatctggaactagcaccagagcttcctcctgtcaaagctgtgccactttccccactggctgcctgtccgctcctgccaaacctgctcccacccgccccagcccagagcatgtggcttctctaagggcttgagtgcctcccttttgggccaccgtagacaccccacctctgagtggtcaggcgccactggttgtctccttccagcaagaaagttggagtaaaatgtccagggcctgggctatggagtgttggagcattgccgtggcaggagaacgcagtgggcagagacgcaccctgccctgcctgcagcatggcctggaaagtcactgcctcaactccatgcctccaaatgggggcggggagggtgcttgcggacccaccctggaggacctcggccctgtaagcagcagatcagagcgtgggctggtgctgcttccaggatcacaggtgctttgcacacgtcagttactcgagtcatagcctcctgaggacgactgcaaggagctcatgaatgctggcctggctttctgtttccattcttgagattgcagttgtttttatcccatgacaaccctgtgtcctctgaaaagcttgcctccttctccccgcagtggccaggacaaggctcacatttttctgttctctgtctccccagccctctcctgggctttctcccggtgcaatgacaccttcatctccctgttggtcccattctctggggtggctggaggtggcctgggtatgctcggtccagtgcaggtgggcgtgcggactcttccgtacctcacttctccctgcacctgtggcccctgctatcggcgtgcttactggagatgcgattcccctcttccttctttgttcaggtagcagggcccaagaaaaatcgtcttttatggaaggcatcaagcaagaaatttgataggcattctcttcactctagaaatcagccccgtgggacaggggtcttgccctttattctctgacagcggccagctcctagggcacgcttggtgcgtggggacactcaacagggagatgctttctctgtgtcaatagacttcactcatggactcagtcgttcgcctaaaaatagattccaaatggttggaaactcataggacagtggtttggcacaaaagcgtgcttgtggctggttttaaaactaagtcgcgaaattgatacactgctgtgtgatacaccagaaagtggtccgttccatccacccgcgcaagtgtctgtcacacagaggttagttctttcataaaactttattacgtatcgaaccccattactcatcctgaatctgtttcaggaaggatgtgtgctggtgaagaggatgagcgaaggcctgccttcctgaagctcgagcgctcatagggaagatgttccgtaaacaaagaaacacgcatggagcatgtcatgtccccatgtggagagagccacggagcacagggggccgggaggggctggatgcgccagtggccagcttggggaaggcctctcttggggcttcctcctttggctcctggagtctaaaacttcctggtgtcccttctgcctgcctagcagaacccctccacacggctccccgtctaaggcggcagggatgagctgtgtggatgctgctgagactggtgtgactgctttgagccttgtccactgatgcagcacctgcagggtgccgccggccccagcaaggacacaccagtggttggtgggatgtgagcgggactggagtgaggccagccgtggacagcagtgcagagggacaggccctagggagttgtgctttaaagaagggcaggagtcaaatgtccagggtggaggtgtgcggccaagggagagttgtgttaaaaatgtgagatgacagggccgggcgtggtggctcatgcctataatcccagcactttgggaggccaaggcggatggatcatgaggtcaagagatcgagaccatcctggccaacatgttgaaacccgtctctactaaaaatacgaaaattagctgggcgtggtgcaggagaatctcttgaacccaggaggcagaggtggcagtgagccgagatcacgccactgcactacagcctggtgacagagcaagacttcgtcacacacacgcacaaaaaagtgagatgacagctcatgtttagtgccgggtgctgggtgagcgagggtgggtgagcatccatttcccaggggaggggccccgcgcccatggagactgctggggacaggctggggcagggcggggtggagggtgtcctcttctgatggatgcttttggtttttggttttgttttgttttgttttgttttgttttgttttgtttcagtgaagtgaaaagtgaggtcatcgtgaggatggtgtggggcgtggggtgtttgaagcgggaggagaagctttgaaatagccccttggagagtgggaagtgggttactacagaagtgaggtaggattgaagggcaggccagaggccactgaggggtacactgaccacacagaggaggccggtgtgcatggcaccaccctctcccagccctggcccatgacggtgctgagcaggtggagggctggaagtcagtgaagttggggcttcctactcaggagagatggtgggagaagggaaacttacaagggtgagtttcaagtcgtgtgcgatgctgcccggctgtataagaaaaaccgtgggatgtgagcgggttggacgtcagatggcatggaactcagggcatagaggagccacgggagtgaaggcctagtgagctggggaggcaggggtgggggtggcagttagaccctagaaactgtggttcttgctggtagcaagcctgggtgagaccatgagagagggtgtctgaggtccagggcagaagagattcatgagggtggagtggcacagaggccagggtgctggagaggacacccaggaggctgagatgcagacagaccaaaattccaaaggaggtgtgtgcgagaggttgaaaactagaagctctggttgaaattccatggggtttctcgctattgatattttaggtatttgagactgttctttgtggcaggggctgtcctgtgcattgtagggcatttttcagcacctctggcttctaccatctgatgcctgtagcacctccactccacccagtttgatacccagaaacgtctccagccattgccagaggtcctgggtgggggttcctggagaaccggtggatctgtgggaatccagagtcccatggggctagaagtgctcgtgtggaaggacacaaaaggaaaacgtggatgtggaggaaatgctgatgggttggctgtggtggtctcttagaggaaggtgggtggtggtatttccaagtgctgtctccttcccaagactgccacttagctgcttcctccaggtgagtccgggatttctcggactcaccaagagaattataaatattgcaagatatggagaaagcttagaaatgagagggccctgtccctgtcaactgttttgcaaaaagttttctacagctaaaagtgggaaggggcctagaaacagacgtgccattttgatttccagaaacgtgaattctgagctagatgccagtgagtcaggtcacaaccaggtgggattctgaattcagttgttaaagggctgctttgtgtgcacatagaaaaggaaacagatgtatttgaacagaggtagtttattaaagagaatgratagacatcaaatagatgkccctttatcgttttcagttgtcaaaaatacgtgtgagttgggtaccatatagccctcagcagagtatttgacaagatttttccttggtttcctcataggcaagttgaaagatatgtgagctgaacacaaagacagtgtaatttatctaggctcagtggtcactcttagaatcttccaggagcggatggtgcatgttaaggtgggaagctctatcttgactccaccctgttcaccatctttttcattgatgtggatggatatatgggagtatatgctcagaacggtcaagcataactaaggcgatagtgaagagtaacaacrcataggcttagaacacagagacatagagtggtggcctggaatagagagcctagcggtagacctaccacgcccctgtggaagcctgtcgtgtggacggcatagctaatgtgtgtgttctgagtgtcttcgaaatagcggtgtacactcataaaaacaaccgctggataacrgaagagagtttatgatataatgcacctactgtaggctcagcattgcacaagtcaccacaggggaggcgagcactggtggttgccctgggcacaggcatgctagttagattgagataagcgactggcagcctcgtgcagaaggtcctaactgtgggctccgtgggagtgtagagatgagaaatgttagtttgggagagagtgttacaaacacagagtgacagagggaaggacgcacagttggggatgaacatggcctgtcgaaatgagaggacacccaagggacagagtaaaataatatgattttaatataataatattacttaatagcggcccctggcagccgaggagagttgcgtttgcctgttctgcttatctccctgcaggactagggttgagctctctgagggcaaagacagtcacagtgaccattgtttcccatggcctggcaccatacctggcaaagtgggctcctaacactgaatagagaggatgggatggtaaagacttgggaaccctgggcagaaaatatttaaaatgagcaaaaagattgcctgcctggtttgagcattgaataacacagagaagggttgctttagaatcaggtaatgatcttggggtctctggatgccccaccccctgaacgttatgaggcttctgaacactgttaaatcataaataaaaattaattaggctcgcccttttttttccaagatatctatagcttttatctgatattcagtggaatctagtatttcagaaatacatataagaaccactactttagaaatatcagtattgtaaaatcatgggacagcttaaaaggtgaaagtctgggaggagaaggacctcgtggagctggccgcacagtctaggcttgggggtaaggtaagaactggaccaggggtacgtggtgcttaaatggagagcaggcagtcatggagcggctttgtgaaaacaggctgagctcgaggtcccaggctgctcaaggcaagggaagtgtcttatttaaacctgcccgctcccacctctgcagttccaccacaaccaaactgtcatagtgcaggctcagggggtctcaggactgctggctacacctcgggtacagttaaccaaggaggtttaccagatgtccaccgtggaaagcaagtgttgggcagaagtggcagggaagtggcagtttcaagggtgaagcccaaggtgatagcagagaaagctgcccggaatgcaaaggtcagagtgagtgctgtttcttgggagccggctgccgggaagagagggtcaggtagagccaagcctggaactggtgttggtgtcatgcacatggagaatgcccctgtggacgtagggaggagaggcaggaaaacatggcatcttgggccagcacagttagcatgataagggaaaggaagtcttacgggggcgaaggaaggcacagtgaaacagtgtgccgttttgaagaagcaatggtgaaggaagccagacttcaaggagtcaggaagaaacacagtggatttaaaccctctatctggataggaaccttgtctggagaggtctgcagcggttttgagcagacctgaccgagctctgtgacttcagcaagttacttaaccttcccctgtgccttggttttctaatctgtaaagtggaggtggtagggataccacgtgcctcagcggattgcttaagagtcctgaacgcattgctgaaggtagagcctggaatagcccctgttgggtagtaactttggatgagtgtttgctgttgagactgtggcttcaagggttaaggaaataaccctttaaggaataatggggtttaggaaagtgggcatgaaagatcttgggacctctgaggacagaagtgacgcagtggagagggaggaatgagtggaagtgacctggccaagacacctgaggatgaaagatgggaccaggacaagctaggaatgttcatttagcaagagaggggagcccattcctctagggatggagagaggggagtccgttcctctggggatggagagagggagccctttcctctggggatggaggagaggggagccttttcctctggggatggaggagaggggagcccgttcctctggggatggaggagaggggagcccgttcctctggggatggaggagaggggagccctttcctctggggatggaggagaggggagctcgttcctctggggatggaggagaggggagtctgttcctctaaggatggaggagaggggagcccatttctctagggatggagagaggggagtccgttcctctggggatggaggagaggggggcctgttcctctggggatggagaagaggggggcctgttcctctggggatggagagaggggagcctgttcctctaaggatggaggagagggcgagaaggccagtagaggagccgtgatggtggagtcacaacagaggcaccccaggaagctgacagccagatttctgccattgatgttacctctcacctaccaccaggggacagtgacctgtccgtgtgcctctgcatctaaggatgtgcgtccataggaagcacctcctgcctggtagagggaaagttgctgagacaccgaattgccacatttctcgcaactccttaaagtggtgaagggaacttccgccttttgtgagtgagtgaccacccacaaggagtgcacatggttgacacagtctcaggtgtctcatggtgtccagtgctgcctgggctgccctgcaggagccctggggtggcccttcaccctcttcgcaggaggagctccccacagccctcttcttccatgtgtaaagggtgcatgcaatgaagggtgacgcttccgactgtgcagagaggggcgaggggtctctgccttagggcggccaggaacgtacatcagggtgttcttgggaccgtatgtatttctcagataccttaaattgtgtgtttgtacatttctcaacatatgataaaatttcctagaacttcacaaaataaaaatattttcaattcattttgatttccattatctttgtatttgaaatcatgtcactgttctgctcagaaccctgcatggctccccattccccccaaagcacaggcgagggtcctcacggtggcccgcaagccccctcctctccagtgccaccttccgcaggcctctcccacccacaccggccaccgccactcgggccccctctccgtttctggaacacaccaggctccctccttggagccaggctctgactgtttctctgctctcattaccttctcactcctctgccattttcaagtcttgattcagtgtcccgtgctcagcgagacctaccccagctaccctattttaaatgacaccccccatcactgccgcctctccccagcctcccagccttgatgccccgcgttcctattcggtctttcccataactcttaccagcttctgatggactccaggttctggcccggctgccatgtcactgccactccactttacagagtccccattggggcaggaatgtttatctgtttctcctcgatcaatgatggctgccaagcatcttgaaaagccgctggctcacagtcagtgctcaaaaaataccagctgaatgagtgcggtgtgctgtacagaactctgactttggacttaaagatgctgaatcgtgaaataaaaacttttcaagacgccgtaggcatgcaccacctgtttttcctgcacgttttcagtgggcttttttccacccggcttgaattatatgcgcgttctggtcatgtagtaccgctttggccttctctttgataaagatacaaatggacataatacattgagagtttcacttatagtgaataatcacgtgtgcactggttttgaaactgttctaagtagcttcaatgaatcaaaaattggcaggcctactatatcgacttccaaacactgtcactggacattggtgagagagagaaaaaaatggcatagaatttttcactgataataaaacaagatgaagttatagtcatctgtaatattgaggccggaagaaaggatcaggaatcccttatcctgtgcacccacaggagtcaaacccacttaagatgatatttccaaatgtattcttaaatgcatcgttttcatttctaatatatcaaggtaattttaagaagagaaagataactaaaaagcataaactcacccctttccttttgcagagctccagtcatgcagaggagagaaggagaatgcatccatagcatgctgctgatagaaaaagaaatgcttgtgttttaatagcgggaggcacagtagagcaagggggactgagcccatctcataccagaggctctaggcctccaactcagcaatacagtaatgggatgttatttgcagggcctgtgtggtatgagaggagcgtggctgtgctgtttctgcgcattctgctttgtaagtgctcactctgcatttttttttttttttttgccttttccggtccaatggcagacacagggctgggtgactccgtatgctccagccccagtatctccagcaccaccagccccaagctcgacccgcccccctcycctcacgccaacagaaagaagcaccgaaggaagaaaagcactagcaacttcaaagccgacggcctgtccggcactgctgaaggtaagggttccgcggtgccccgggagagagtctccactgcggaaaattctctgttatttttcaaatgcgtgaaattagacacccttagcacaacaaatgcacagtaatgctggtcaccgtatgtgctttctgtttgcaaggtggcacgagagggcccttgggaccttttcatcactgtctgattctcatattacgcaaccaaatctgctgtcatcactcttggccgccgtygctggtagcgggtaggagtgctggtctcccagccaccagcctgatccagttctgaggtctcgccccaccctggcagcctgggcgagtgtcctctccagccaaggtgggccatgctgcgtgactctgctggggacagtgcccacttctagtttaggaatcatctctgatattggttactcttaactaaccagacacctgccttgatttcagcttttagcaacgtgttatgataaacacttcttctgttaatgtccatcagctctttctggtatgtgggctctattaatattccagttgtcacagctcattgtgagtctcctttcacctgagtgcttccttagtttttattgccactgatggctggatgtcagcttcctgaagtggctccttcaaatgaattccctttttttttttaattcatagatgcaagtagagataggtaagcgcatgcgtacacacacacatacacacacaccccccacattatgagaggtaaaattaatgcagttgtaacaaaggaatacttaaaaggaaaaattaaagtttgagaaccttgttgttagaacatgaattattacctgtgagaccgacaatggtgagagagtgtggttacctgtgagaccgacatggtaaaagcgtgtcttcagtgagggtctcatgcccaggggcaacatttatggcttccatcctttctctttctctatggctgccatgctttttccagatactctacttgatcgagggttcaaacctgcgagctgtcagacagtggctacattagagggagtggcccatcccgtccacatatccagagcggagcacgcaaacccacggtgcgtgtgttagcagggaaggggcagagtgtggggtgtgctgtgtgtttccataacaccggaggcagggagcatcatttctttcatcatcaggaagctgaagttcggagctctgagtagcccgccagcctccgcagaagggttagaagcctttctccttcaccacgtttcttcctgttttgcctcctgtaagcttcctgctaacatatttagccaataaaaactgatttttcgtcgggcacggtggctcacgcctgtaatcccagcactttgggaggccaaggcaggaagatcacctgacgtcaggagtttgagaccagcctggccaacatgatgaaactctgtctctactaaaaatacaaaaattagctggatgtggtggcacatgcctgtaatcccagctacctgagaggctgaggcaggagcattgattgaacccaggaggtggaggttgcagtgaaccgagaccatgccactgcactccagcctgggcgggcgacagagtgagactctgtctttaaaaaaaaaaaaaaaaaaaaaagacgatttttctcatgttgtggggagtgaggataatcccattaagtcagcgatggtggaaaataatggttatgggtcagagcagccacagatgccactgaccttcccactgaaaacagtatcagccgcaggcgctctgtgttggtaagactccttcagacaaccgttgggcaaaaatcaccctgccaagcacgtgcagccacccctccctgattgggaagaaggttagcctcccccagggtgggcagcctgtaccctccacgcccctaaggtgcacacacaggggcgggcgccagattccctttaaggacaggccttgttctcactttcacaggcacgygtcttcttgcatttgttgtgtgtttccaaccgaggtctgtggttttttcttatgcacaacctggtgggaactgaccgttgccacttagatacacgttcattatcccacccacgtgttgaccgctgtgtaaatgagtgaataaatcagtagcgtttctgcacatttratggagcagctggcaccacccagtgttccattcagcaccggtgagtttgaaggaagtttgacaagtgaccgtgaccacgttggacgcctgatgtttcaggtccacttgctgagtgagtgggatggtatgtgygtgcgaggcaatagtggatacccaggctgagacacgggctctgtccaagcagcaaatgggggcccctttccttaaagggtcttactgctgaggtggtaacaccagcagaaagatttcaggcaccatggaaactccaatattaggaaatcacaggtgtctcaaacatggatgtgtaagcgggtgacgtgtgtttggaagtccaaggcagaggttccaagggagccacctcactctctaattaggagagtctggtctctacgtcagcggctatgacatctttccaatagcaaataagtcataagttatttataaaaagaaaatgtatcatttttccctaggaaaagttacttatcagactacaaatgagtcacttttgtgaaaaagtctatatttcattttttcaaagccacattttccccccaaattgtaacatatctgaagtcagaacatatcattgtagattcagtgatatatgatatttttgatagttttatttactgttaattccttgaaagtacattgtgtaaaacacccaaattaaacattctgttctggccgggcacagtggctcacgcctgttatcccagcactttgggaggctgaggcgggcggatcacgaggtcaggagatcgagaccatcctggctaacacaatgaaaccccgtctctactaaaaatacaaaaattagctgggcatggtggcaggtcccagctacttgggaggctgaggcaggagaatggcgtgaacccaggaggtggagcttgcagtgagccgggatggcgccactgcgctccagcctgggcgacagagtgagactccgtctcaaaaaaaaaaaaaatctgttcttgaaactaaagctagttatatatgttttattttatttatttatttatttatttatttatttatttatttatttattgtattttttgagacaggtcctcgctctgtcacccaggctggggtgtagtggtgcagtcacggctcactgcagcctcgaactcccaggttcaagtgatcttcccacctcagcctcccaagtagctgggaccacaggcaggcaccacgacacctggctaattttttgtatttttgtagaaatggagtttcactcttttgcccaggctggtcttgaactcctgggctcaagcaatcctcccacctcagcctcccagtgctgggactacaggcgtgagccaccacacccggcctatattttatgttttgagaatactattctattataaaaaaccatttctgcctctctttcctgcaaggctctgtgactggttactactagtgtattctctatcgcctgaccaagtgctgaaaagatggaattacagatataaaacttctatagaagatttgtgtaaagtagttgaattttatggtttttaatataccctattggaacaaataactaggttcaaatctctttagagtataagaaaaatagaattccattgaagtaagcaaatttatcagggtcctttgaatccattggtcagtagaatccattaaactcagctgatgaatctggaatgggatggggctccccggctggttcgccgaggagtcttcctgggcctgtctgcagagatgyggggagaaagtgggtttggtgtagaacccggggtgtaacggggtgaggagagggcaactatttgggaaagcttccagctaggagctgtggccttcaagaaagagacctgtccggctgtggtgaccgggaaggtgagggtgwcctcactcttctccctcccactggtctccagtggcccctccttggccaaatccaaccagaggccaaaagccctgagagcccacgatgccagtcacacagttggctcccaggaccaagacaaaaccaacagaagccgtagagtgttcrtgcctttcacagcacctcctacaagcccctgaagcccgtgccatgccactctgttggtggtccacaaacacaggaaacgaagctctagagggcaggggtatgtgctcccctccatcatcccccagggtctggctttagcctggcccagggagccctcgcggcttcctgaacagacctcagtgcccttccccagctgtgtgcgacaaggaccctgcgagaaggtcttcctagactcccagctaagcacagaggttctcactctggccgtttcttacctctgtggcgcacttattcagaaagtaaaggctaatagtaggaatcatcagtacctgctgctgcaaacccagaaacactgtgtctacacggggctgtcagggtgaccratggaaattgggccgttcctgccctggagtttctccctgcgcaggtgctcgctgtgctctttttgctgaagaacagccactttgttctgcaccagatggcagagggtgtcagaccccagcccagggagagcatttattttcttaggtttaccatttaaaatgaatcggaggaatctggaaagttacagaagcagggacggtgactggagaatccctyatctttttgtgtatattttgggttctgaggattaccaggagatgtrtggatgacagagcccgtcgctaggctcttatgtcacagatgggctgctgtgctgcgtggtcattgagaccaatggaaggaaattgagatgtgactgggcaggatggtgacagggcctgaagcctatgcatggagggaacgtgcagtgaccagagagaagggtggtgatgaggatgagggccatgaggcatggtgactgtgaccagctgatggaaggtttgcaaagaagggcgtcccaacttgtcctggatggcccaggtggtaaccatgggacctgatgggtggaagcctcaaggaggtggattttgattctgatattaaaagctctagaaaaagctctacgaaccagggccacctgagagggagtgaccccgaccctgcatggggtcggcatgggttggaccagggcagaggaacctgggctctagaaggtgattgcaccacggccctggattcccaaccaggtccaagttcaagggtatgtgccagggaaaagcgcctgggcagtgggattttgcagatctttaatggcttgtcagctcttggcattgtctttgaattacagtactttctgggcatcttcatatctcgggtccagtagtgaggttgtcattgctaaaatgaacggtctctgcagtcccattctgtggccccgaacctggtggttctcgttagttttataacattcatgcaagtttgcattaagtgctaatttccctgtttccccagtgaaaaggctgaagtagagagaggttaagtggctttcttgtccagggtcaggttgctggtaggtgacagaactgtctcttgattctctgcctcaaactctttccaccaggcaaaaagcaagtctttgaggtatgtggagctgcttttgaatctgggagtggggcacactgaatagcttccttgatatttctcagattccatgtaaagacactgacttttatatggctcataacatctagaagttgtgtagcaaagatctttctttaaaaatgcaggaccagactggatttacccaatcttattatacaagagggtatgcagaaatcctggtgttatcccccccttgggttcacagcgctttgttctgaaggtctcagaagggaatttattttatccttctcatcttgttcctttggttgttcattctggtctttatcgcaccattgtgtggttgatcctggatggatattgaaagattctcctgtagagggtaagtcacaaacgggcctctcactgttatggtagaaaatgaattgctcatcacagctgcactcactgagcaatgaaatgttgacaaatttcattaactccagagttgcagaggtcacccaggacttagtttcccttcactctttcaaaggagaacctgaaattgtagatcattttattctttcatcaaatatgaagcaaccaccacagggaaagcactgtgtgcttgcctccatgggagacgttgagaaataaaactcggttcctctctctctccaaggagtttagagcctgattatggagataagacatgcaagaaactgtaacgaggatgtcaggcagaatattcgagaaaggcatgggaattcagaagaagcacaaatacacactgagttgtaaaagttagggaaggctaacctgttgtagagcttaatttttattgtgcagatttagcacataatggttatcttatttaataaaactgcagaaatcattactttttcattaaatgttgcctacttacaactttaaacaccagtggtggtgatttaattagtcacaaaatggagttttgtttttacttagatgctaagaaacagatgttgctattgatcagttaccttttacctgaggacttttttttattattattaattagttgatgtcttggaaggcactttggagagaaattaaagaatcgtgcatgcatatcgtacagtgttgttttttttcttgcaggaaagcaatacgtgggtgcgtggaagctctcagttaatctgtaaccatccggttagatggactatcatgcagcttgagccattgctgggtagtttggggattttgcatgccgtgattgggagggcagtgtgcttgttttgttatttagaatataacaaggttgtaagagtcttattagcacaaggctctcatcttttctcactcctggggtgcaattagtgtgcacatgacggtgagcacatgactggcaaggagtcagggcccagaaactgttaccttccaggtttatatccagtctacaggggctttcacattgaattctgtgttatttggaggtggctggaggggagatccagttgcacaagtgttactgtcattcttccctcaggttttctccttttcttctccatgaacattccaccggcacctcccgtgtctgctccttgtttaacattggcagctacccaggaaagggaacgagaagtctccacaatcagctccctaaaaactgcataatcaacagtaatttttgatacaataaggacttattaattaaacttccttattagcaaaccactggttagtgcatctgaacagttgagttgaacagttcattatagcgaatgtggaaaaccaagaatgagaacatcttcctgggagatacactggaaatgcagtagcgaatgtggaaaaccaagaatcagaacatcttcctgggagatacgctggaaatgcagtcacttcactctgctaaggatatcaggagactggctgggtttcatcacccttgggctgtcagtgatgggagccaccatgcatcccgacggacttgcctcctccccacaaactagatgacttttccaaagacagtttgctctcaggttgtaactccagcttccaagagaatgaacttgctgaaattgagtagatcatctgggtttactctagacattgacattgtagattgggcacagttgactcaaaagccatcctgcagggtacagtccggccgccacaaacacacacaagcagtaagcgctctcagatcctttgtggaagccagcaggtcggaaataaacaaagatgagtcgatcacagcaggggcagccagaacggaagattcccatcgtgatgaaccgacgcacagaaggatgtttgtagtgtggtttttgtttgtttgtttgttttaatttttttaaccacacacaaacttaaaggggttagattcaggtccaaaaatgttcattgagcacctactgcacgcaagagttttgtctgatgctggatgggacatcaactgaagcggcccagccatcaggacacacatagaccagtggagaaagcagaaacacgccggggaacttggttatgcaggagcacagggcacccccagctgcctggaggacctcagggaggttccccaaaggggagtagacactcacacacgttgtatagacaacgaaatatctgctattccaaggaggaaaaaaggaaaaaatctgaaaagtcaaaacaaactaaatcttgtaaakaggtggcttggagctcctgggggtacctaggcaactcctgacgccacagacaagcatttgagctccttagcctgctacacagaagcataaactcacctttgaaaaatgctgactactcacaaggtccctttctaagatacagaaatgtgacggacctcaactccttttttttagctagacttagagattctcttctgcgagtggggctcggttagcacaagctgctcacaggctccggcgtccatcagcagagaactcggggcaccgtgttttcctgtgtgcaccctgggattggaattcgggctagcttgggagaccctgcattggtcgactttcattagaatctaggatctgtcttgaagtcattttcttgatggtctcaaaatgtttgagctctgaggcktttcggatgtcatttaagtctcggtgaaattatggtccacttggaccaaggtcctgaagccagaagaggggctggttctagcggccagtgctgttcaacttgtgtcttccttactattctaaatcctcatctactctttctactttcctcagctgcatgtattttacacacaaagtacagggatacagattgaaatgttcagcagcaaggtatgagaggtccgcatctcatgcacgagggtgtttttctcggcctcwgcagccctcagatgttcccacgctctgttagacacatgcggcctgggcttcaggaagtagagatgcccgggggttatattttcagatgttctagctgagctcgctttgtctttcctcccaggcctggcaataatgaaactaggcagtgttttatctcacaggcagtggcgacttcattcctctttctaaagatgtaaaacaaaaggggatattgactaatgcaaaacttagtctgtgtggaagcaacttggcaaatggggaggatgaaataaaattgcacctaccgtttgtcttagctcagcctgccatatcaaaatgccacagactgggggcttaaccagcagaaactcatttatcatggttctgaaggctgcaaagtccaagatcacggcaccagctgattctcttcctagggagagctctcttcctggcttgcaggtggcccttttcttgctgtgtcctcatgtggcccttctgtggtgtgcacacacacacagagagagaagctcttctttttcttataagaacacccctcccatcatgaaggcccagccctcatggcctcatctaaccctcatcacctcccaaaggcccagtctccaaataccagcacattggtggggtgaggaattagagctacaacatgtgaattttggagggagacaaacattcagtctgtaggaccattctactttctattcctggctgtgggattaatgtccctgtggcccccacccacccactcacccacgcaccatatgccatttaaggatttcatggactgtctcaggtcagaaactgcttggacagatcacagctgtcctttccccttcactcttccctcccaagtcttggatttgttgtcaggagacatcatccagtgcaaaggaagaacaccatggatttactgcctgcttgtgcgctacctcattgcatccttaaaacaaccctgtgtggtgttggcaggtgggtggtggcatttctgttgtcacaaatgaggaagagggttgaataaagttgagtaatttgcccaaggccagtagatgagtggcctctgggacttggaagtctgtattttgctttgcatttcatctgttaacctggaaaaggcttcagggggttggagtgggaggagagccttctgcaggcctcttactctcaatcctgtggctctcagagttgcttctccctctgtgcatgtccatttctgcagcacagcagggccatgcccacggctccccaccactgcccttgagaactgggaagcagtcattcctttgctggttttctcaggaggcctgttgtgttgtggtatggcttccttgcaaacaagtgcatgcacactctgatacgtttttaaaaaaaaaagatgcaaatcactgcttcagctgctttgcagacagttagaacctacaggattagatgggctctgttataaggggacatctctcttgaaatttttttggacttacggacatttaattcagatgcagtgaacccagtttttctgttcattttaagattgatatgctttttytttttttggatgacagaagtgtatttgtggggtttttttgttgttgtttttgtttttttttttttgggatatgatctcactgtgttgtccgggctagtctcaaatccctggtctcaagagatcctcccatgtcagcttcctgagttgctgggatttacaagcatgtatcaccacagccagctagagtgcacatttttaagggcagtttgaggttggagggaggagggtggtgattgattaagcccccctgtcgttcatttgaatcctgcatcgctgatttaagtgttaatcaaatgcctgtctcgcctggctgcggggtccgatcatagttactgactcgcgctcattttatcaagatgtattaatgctttggagaaggtgtagttgagataaactttgtgtgtttatttagtaatctttgctaataccctcctggctttccactccacccctttctcatctcagacataccataggcaccaaggtgtggagccagtgaaagaacaggcgcagcgaacgttccggcaggcattgccgtgcacggacacacaacttcacaagggcctcttgtgcacgtgggacatggagaaaattggccatttgtctgtggggtaatgggctttgctgcaatatgaaaatctatcaaatgggtaaaatcaatgacattgtatcagagttcatgaaaagtgcctactgcacacagtttaattctatttaatttttttaagtggaaaaaagcaaaggaaaaatgttttagttttctcttaagctgatttcgctctgctttttcttaaaagtgcctttctagttgccacacagtgatgtgatcattatctgccacctcgtcgccttgctgcctctgcatgcagtaaaatacaaaaaaaagagagatagagaaagcaggggagcttgtgaagtatgactccctatcccaagactcattgcctgcgattcgtaccgcttgacagtaatgatcttattacagtactgtggaccytgaagagatttcatgaggagagtgaaaggacgaccctccgtgtaatcaagtggcgctgaatattccacgcgtttttgatcacacactgattgggcacagttttagcccatcttctagtcaattatgcatggcccctgtgctcctcgaatagtcggaaacattgatggctgttgtctgggttttggcaggcagccaggggtttgaagtgccttgtacatcgtcatcccaggataagtgctttttagttggaattgattacctttctttgggttttgcttaatagcaaaactgcatttggagagggcttcaggtgaaaaatggacatattagccattgagagcatccgaactcctagtcaatttttaggcttcccttgtttccgtctaatttctgtttaatgatacagtgtttgataatatttaagatatctcaccgcatttgccgctgagcacacatgttgagcgtcgaggacaggttcaattatgtggccactgtgttcaggttcccggattgatccrggggaggctctaagctttgaggagatctggcggttagtttccatcttggcataaaagcattaattatctaaagatcttttcatctgcaggaaaataggcagagaattcttcctactgttgagtggtcgctccgtgtgaccgtggagctcatgtcagcattgctaggtttgggctcagcctgctaccctgtgcccaaaagactttctcccattgtttcctccctcccctcgctattgagcttgaagtctggggacatttgaaaggatgggattgtttcttaccaaaatgaggcatgatgttgcctcttaagaaaatcagacaattaaaccaatgttactatgtagaagtgaaaactggtataaaccaagattttttgcctcctcctgttatgctcttaattctgattcttgtcttacggattgtcttagaatgattaggaaaacttctaaggtgttttatttttttgttttaacattttgtgcaaggctaaggaattagacaccccagagtatgtgatcactgtgagatgtttctcaaagtctgtcttgaacttgccaacacatgctgcctcggggcctgtggtcactaagcttatatgagggacgagagccgtagcattgctccagcaggtatttcaataacttgatttgactcttcttaattaaataaataggtagctttgttctttggcttgattattcatttgggtctttcttgctttcttcaggtaggaatgattttccccttcagttggttttctgcagaagccatgatatactgtaggcatggttaccagaacacccctaagagagctgaccagaatttctaagttcatgttccatgcgtmcacacacacacacacacacacacggtgttattttttttctttctgaatttcatgaaaataaaatattttctaccagaatacacatttagtgatgcctctttcaaagaggaaatcaatcacgaaacagaaactcagagttgacaatctattagcaataatatcactatcaattattgaccactgccatgtgtcaggcactgggcttaagtgctttacacgcagcgtctcataaccctcacaagaacctgggaggtgggtgccgttatccgcatttttataactgaggaaaccgagggtcataaagtttaagtaacttgctcaaggccatagacgtagaaagcagcgatagggccaccgatccaggcgagggcagcagtgctcgccgcctctaacacatctccacggtgaccttcccttcccttggaagggggcgcttgtcttttcagcggtcttgcctccgaatcttggcttgtctaggattcttcctacagaagaagttcatataaaataaggggttttattatgggttatctgaagagtgtttcttaattttaataagttaatattccaaccataaaaacttctgacattttacccgaggctgtgcttcagcagatygacagaatgcatttttacagcacttagaaaataccagatccacgaagaacaaatgatcaaagtttcaaaggctgtaattttggaaagctggcatatataatgatgatctcttcgcagcctggtaattttacctggacaagtaaatccatttctcacatttaaagagaatcaaagagtcagtaaacatgcagaaacacttttagctgtgaatgcagagtaactcttacaattaacatataattacctcaacgggccaattaattaagcaatttaagatctataactattttcatgattttcccccaaaatattactttattctgcacaccgtggggacatcagctgggagggtcatagctaggaggtcagaaggaaggggggacgattcatgcaatgaggcactgctgttgtggggtgttggtttgaagaactcataaatggtaaaagtaacctgtattatcattggttctaggggactactgaagataagaattttcaaccttcctcttcgttgtctgctctcccaggctcattgaaggaacatagagaaggtttaggccctgtttcttttcgagcagcacagaaatacttgcccagtccgttcgtggaaggaaagaaccgaagccagcccttggctgccattctttccagacttccaccattgtgccctgagtggttccagaatgtcattgatgggaaattggttttctttccttctggacattcaaagattaatatgttactgtcatcagtgacttgttaccttctgtttctgattgccagctcatcagcttagtttgcccaggagagccactttttcccacgttcttttacttgagttctgagacaagatttgatacccattcatttataggccaaatccagttcttattttaattttttttcccaacccctaaaaagcatttgcaaacactcctccacactgttcagatgagcgatgtgtgagcatgaggagacattccttaagccagcctggtctgtggaggtgtgctcactgctgcagggccatttgctgagcaggaagctggcctcaggggtctcccaggatgctggggctggtggacgaccccagagaagggacaggatggggggttatggaagtgcccagcaaggggagctgcaggagggtctctttacaggtgtgcaaaggaccagcgctgctgcagggaacatggctgggagggcatccaccggggcaggggtctgggcaaggggcttctccccttgctaggccccctccttttgttcagctcctcctctccagcaccaacctcccatcactttmtacattctggcccctttttctcctttccttctttctcttccattctcctttttcctgtaagactgtccttgcttctcttgtttaatttcttttttcttcttttcccatccataacctcatcattgtctttttctccctttcttattctcttttttctttgaacttttttttattgtggcaaaatacagtcatgcatcacattacaacattttgttcaatgatggaccaagtaatgtgatggtggtcccatgagattataataccgtgtccttactgtgccttttctatggttagatgtttaaatacacacttcccrttgtgttgccactgcctacagtttttgatacagtcacatactgtatgggtttatgccctgggagcaataggctctgcacatagcctgagtgtgtggtagccacaccatctaggcttatgtatggactctgtgatggtcacacaatgacaaaatcgcctaacgacacatttctcagaatgcatcacttaacgatggggatacatggctgtatgtaacataaaatttgccattttaattgtttttaagtgttcaattcagtgccgttgaattatattttcacattcacagtgctggacaaccatgaccgccattcccaaaacattttcttcactccaaacagaaatctgctaaccattaagcaacaactccccagcccctacttctcccagcccctgtgacctccagcctgctttctgtctgtgaatttgcctcatctggatatttcatatcaaaagaatcatatgatagttgaatatggatccttttgtgtctggcatcttatatttggcataatgttccatgttgtagcatgtgtctgtacaccattctttttaaaggatggataatattccatagtgtggatttacaacattttgtttgttgacagacacttggattgtttccgccttttggctgttatgaaggatgctgcgtgaacattgtcacacaagtatctgtttgagtccctgttttcagtttttcctagggtataaacctaggagtggaattgctgggtcatatggtaactctgttcaacttttcaaggaaccaccaaattctttttttttttcctttatttcttaaaaaaaaaaaaaaatagatgcgcagattgtgcaggtttgttacataggtatacatatgccatggtggtttgcggcacctattgacccatttctaagttccttcccctcacccccgacccccaaacaggccctggtgtgtattgttccccgctctgtgtccatgtgttctcgatgttcaattcccacttatgagtgagaacctatggtgtttgactttctgttcctgtgttagttcgccgaggaagatggcttccagcttcatccatgtccttgcaaaggacatgatctcattcctttttatggctgcatagtattccatggtgtatatttagcacattttatttatctagtctgtcattgttggacatttgggtttgttccatgtctttgctattgtaaatagtgctgcaataaacatatgtgtgaatgtgtttttatagcagaatgatttatattcctttgggtatatacctagtaataggattgctgggtcaaatggtatttctggctctagatccttgaggaatcgccatactgtcttccgcaatggttgaactaatttacattcccaccaacagtgtaaaagcattcctatttctccgtagcctcaccagcatcttttgtttcctgactttttaataatcaccattctaactggcatgagatggtatctcactgtggttttgatttgcatttctctgatgatcagtgagttgagcttctttttcatatgtttattggctgcataaatgtcttcttttgagaaatgtctgttcatatcctttgcccactttttgatggggttgtttgtttcttgtaaatttgtttaagttctttgtggattctgggtattagccctttgtcagatggatagactgcaaaatttttctcccattctgtaggttgcctgttcactctgatgatagtttcttttgctttgcagaagctctttagtttaattagatcccatttgtcaattttggcttttgttgcaattgcttttggcatttttgtcatgaagtctttgcccatgtctatgtcctgaatggtattggctaggttttcttctagagtttttatggtttgggttttcatttaactctttaattaatcttgggttaatttttgtaaaaggtgtaaggaaggggtccagtttcagttttctgcatatggctagccagttttccgcatatgactagccagttttcccagcaccatttactgaataggaaatcctttccccattgcttgtttttgtcaggtttgtcaaagatcagttggttatatatgtgtggtggtatttctgaggtctctgttctgctccattggtctatatgcctgttttggtaccagtaccatgctgttttggttactgtagccttgtatatagtttgaagtcatgtagtgtgatgcctccagatttgttctttttgcttaggattgttttggctatacagggtcttctttgattccatatgaaatttaaaatagttttttccaattctgtgatgactgtcaatggtagtttcataggaatagcattgaatctataaattactttgggcagtatggccattttcatgatattgattcttcctatccatgaggatggagtttttttccatatttttgtgtcctctcttatttccttgagcagtggtttgtcgttctccttgcacacgtccttcacatcccttgttagttgtattcccaggtattttattgtctttgtagagattgtgaatgagagttgattcatgatttggctctctgcttgcttattgttggtgtaaaggaatgcttgtgatttttgcacatttattttgtatatcctgagactttgctgaagttgcttatcagttcaaggagtttttaggctgagatgatggggttttctcaatataaaatcatgttgtctgcaaacagagacaatttgatttcctctcttcctatctgcataccctttattttcttctcttgcctgatcgtcctgaccagaaattccattactatgttgaatgggagtggtgagagagagcatccttgtcttgtaccagttttcagaaggaatgcttccagcttttgcacattaaatatgatattgcctgtgggtttgtcataaatagctcttactgttttgagatacattccatgaatacctagtttattgaaagtttttaatatgaagagatgttgaattttattgaaggccttttctgcatctattgatataatgatgtggtttttatctttggttctgtttatgtgatgatttatgtttattgatttgtgtatgttgaaccagccttgcatcccagggatgaagccgacttgatcatggtggataagtgttttgatgtgctgctggactctttttgccagtattttgttgaggatttttgcattgatgttcatcagggatatttgcctgaagttttctttttttgttgtgtctcttcctggttttggtatcaggatgatactggcttcataaaatgagttagggaggaatgtctccttttcaattgtttggaatagtttcaaaaggaatgataccagccctttgtatttctggtagaattcagctgtgaatctggtcctgggctttttattgwtatttatttatttatttatttatttatttattggttggtaggctattaattactgcctcagtttcagaatttgttatttgtctattcagggatttgacttcttcctggtttagtcttggtaggatgtatgtgtctagaaatttatccatttcttctagattttctagtttatttgcatagaggtatttatagtattctctgatggtagtttgtatttctgtggggtcagtggtgatatcccttttatcattttttattatgtctgtttgatttttctctcttcttctttattagtttagctaatggtctatctattttgttaatttttttcaaaaaaacagctactggattcattgatttttttycccccmaaaaaaccagctactggattcattgattttttttttttttttttggagggttttcctgtctctactctatcaattcttctctgatcttagttatttcttgtcttctgctagcttttggattagttcgttgttgcctctctagctctttccaatgtgggcatttagtgctataaatttccctctgaacactgttttagcggtatcccagagattctggtaagttatctctttgttctcattggtttcaaataacttcttgatttctgtcttaatttcagtatttacccaagagtcatttaggagcaggttgttcaatttccatgtaactgtgtgagaaccgccaaattcttctcttacatcattctgtgacttcaccttgtcctcatccgttcatgcrtaatacggaattaaagaagctcctgtaattaggctccctcctaattacaaaaataggtgatataaacatgttaaaaatattgttgctttttccagaaaatcaaaccgaaagtatgcagaatgttggtagttaaaactccttttgttattttgtgttygttcgtttgttctgttttgttttttgaaacaagagtctcactctgttgcccaggctggagtgtggtggcatgatctcggctcactgmagcctccacctccaaagttcaagtgattctcctgcttcagcctcccgagtagatggggttaaaggtgcccaccaccacgcccagctaatttttgtgtttttagtagagacagggcttcaccctgttggccaggctggtcttgaactcctgacttcaggtgatccacctgcctcggcctcccaaagtggtaggattacaggcgtgagccaccgtgcctggcctaaaactccttttgattggtgcgtgggtgacaatggattccctgtccctgctgccatgaatcagtcgcacctgcttcagatactactcagaatttcttgtccttaaatgccacccccaacccccgccccgaagtcaggaagtgatttctgaactttagcgtaagtgttctctggcaggtatggctgtttttctgagcagtaggtacttagtcaaggcatgcaggcgtttctccttgttttagttcatctgcagaggtcagctttttccattgtctctgaaacacttgcatttttcctgtaactttccagtaatgagggggcccagtgggtaaatggaatcttaaagacgagaaatgattatttttttcccgccgactccactctggccaagacgagctctcagattgcacttcagaatcggtgatgcgcactcattcccctgcacccacccttttttctgtggtcagcatgtgtttcccagactgggcgtcactgtcgcctccttgactctcatcactcacatggtcccccagcaggtaacttgcttcagcgccactttgcctgggtgctggtgatcctccagttctcacacacctgcaccttggggtcgytgagttttagtttaggtcttccgaggaatgcacagaccacacgttgtcaggcttcccttggccaataatgtggagtcttttggtttttctgttcttcagagtttgcatcccctgagaattcctctcctgtgtccttcaaataataatgtgagatgaagatgatgatgatggttgttgttatttaaaactgcaagacgtaggcaataccaggtcttaacagcttgttgtctgtggtgtcttccttcttccctggaattagatatttttcgttcaagctgctgacaggtatttattgaccaggtactgtgtagaggtcgctgctgcgtgtggcttcacccagctcctctgcccatctggtgactttgcaagctcacaatgtcctgaatgaaaacctagttcctaagcccttcccccaactggaaccatggagggaggaagaacagaccaggtgaaaacatcaggaggagggtccgcagctcgatggtgatgagtgtaggggagaggtgggtgctgggacaggatgagctgggctggaggagggtttgccctagggaggcagccccaggcagggcctgggcacactggtggcgtagctgaggggctgcctgcgtgcaaggaggacatgaggccacatacaaagcttagggccacccaggaagatgtgggagaaactagaggggattaggagagttcgggctgcaccagctcctgggtgttggttggagaaagagtcatgaatcaaggagcccaggaggacggggaatccctggaggaggtgggtcagtgggaggaggactgaagacattggcaagcatcagtccgtgcgggagacgtgcatggagtggaacggtcacagcagcagctcacagggagggacagcctcggaagaggaaatccatgcgtcttccttttgcccacaggagaagagatgaaagagaggggaggggctggccagtcagcaatctggacagtttagatcattcaaatgcgtagccggggttgggaaccagtggtttaggttaagatcagctagatctgtgtgaaggaccagtgtctcacggagattcagactcataaaaatgtgggccacaccccaggacccacagccacacaagccgttcttatgttgtcccaagtgctctaccgttaggattcctgttaaaaccttttttaatgtttttcctaccctgtcttattggtttaaatcaaattgcagaaaaataaaagctcaaatattatctgttatgtcaaagttactatttgagctgtagatgctgttttcaaaacagatcatcctccttaaagyacccatctctctccactgacatgtgcccctgygtccagccgcaccttccagcagagttccctgcaaagacgcttccctgcagcctctgtgggtcaggaattagaatgggtgcagctaggaaggcctgtgtctgcctcgtgatgtttggggcctcacctggaagactcagaagccaggactggcaacatcccgaatcccagtcactcgtgtgtttgatggttgatgctgcctgttgggtgggacctaagctggggctgtcagccagaacacctacacatgacctctgcaagtggcctgggcttccttccaacatggtggctgggttccaagggcaggcatcacatgagagaggtacatggctgggcagaagtcttgtttcctctgtgaccttgcctcagaggacacagagtgtcaattttactccatctgtagtcaacacagtcagagtcccacttagggtctagggtagcagaaatagactctgcctctggatagagagtggcaaggttctagaagagcatgtggactaaaatatgaccatggccatttttggaaaatgtaatttgcaacagtaaataagtgaatgtgtattatgtcagattgtgatcaacacaatggaacaagatagagtaagaggaattgggaccaccaggggtggggcaaggttcttttctgcaaaggcagccaagcagggctcaccgaggagaccacatagcacagcccagcaaaggtgaggctgtcgccaggtggccctctgtggtcggcatcttcctggccagggaattgtgtttgcactgttgtggtggccaccttaaactgagtacttgtttgtagttaacatcacgtgctatatgcttatgttctactgtattgtgtaaaacaagctgaattttacctagatttttgtgttgtacttattctctggtaatatgactggagaagtattttatgtctcaagaattattatgcatttcttatttctctgtcctttaattttgaagggtcagtwtaaaaatactttattcrgtatattctagctcattctccacatacaattatattccaatatttgtagggtttattctctccaagcagcatgatcaatcagaaaattggacagttttaaaaagtggtccagagaaccagcaaatatgaaggcaggctaataaaaatgcatatcactctaacagtttcaaggcagtttcctcgggagactgaggtgggaaggtcgcttgagcccaggagttcaagtcctgcctgggcatcccagtgagaccccacctcttaaaaaaggaaagaaaatggttttttaaatcatttcatttcgtataagattattttscgaggttggtgcatgacattggagttgcccagcaattggaaaaagacatgagcgtttaatactgggcgttctttctaaggctcttaaagtgaaggcaatcacataaggctatcttgcttcatgggtaattaaggcatttccttctgcagttcccaaatctaatgaagaagaaggaatttctcttttgctgaaatatttcttgtaaggttttcatttcttctcattgctccgactttggaaaaatgttctttttacctctgattttctcttgtaatgtcttcttgaattgtgagtcggggaaaaaagtaaaagattcgctacagattcagactkgcaaaaaaacgcttagaatcttgctgtccgtaaaactgaaacatccagcctcacraatgtccacatttctctctcatctgtgaaggcccgttgagactgctcagttggtgtctcctctgtccacaggacatggccgtagccgtgtgtggagaagggttgtgatggtggccatcacgagacccagataacaggagtggttagaagcgcagcggaggagcctgtcttcctgggtccgagttgcgtggttaggagcgcagcggaggagccggtcttcctgggtccatgttgcgtggttaggagcgcagcggaggagccggtcttcctgggtttgagttgcagctccacctcttcctggcgggtggcctgggcgagtgcctcacgctcccgtcagtgctctcagctgtaaaatgggaacgatcaggttgtctacctccaagactgttgtcaggattcactcaatgaactcctgtgctttgagtgtctggcgttcagtggcaggggaccctccatgtggggacagagactgccacccattcctttctgaggattcagttcttatagactacagtattactcgtgggagccaaattatgtgcagtgtattttcagattttattgactcacctaagaaaggctcggggacactgttgtgttctgatgtaagagatcacttgttatattatgctttttaaatgttgaaggcaatactcatcagagtatgcattaagtagcattgaaccacatttttaaggtgactcttcaactcaccaagaatatcgtggccgctgaggtcctgcacacctggggatgcgtcgtgggcgccgaggagagcgtagcctcctgttaacgtagcctcctgctgctctttggggtagaccagccgtttccacgcacaggctgcacattgtttcatggcctttgcagttgagcttgtgttggcctctttccgtcgtgaaccatggacgtctctccttgacctcctccctacctgggagaacctggctggccacatagtggaactggaaatgcctccatgctgacgtgtctgcctttcatgaaagatagtagcaaaagttattgttatacgttacaaaaaaccagtttaagacatggacttttttcatatgtacatctgaaaatgactttagcagagattctagctaatacatggagttgtgcttcctaagtattgatagcggcgtatatataggattcccacaatttgcagttgtacagttcaaacaccaaactgtttgtggggaggagggtgatttgcagtgatcttttcctcaactcaggccagtctatacaatactattgatatttactgccttggagcagccttggcagccttgtattctgagctgctgtcagtggtttaaacatttcacttgggttagccttgtcccttcgactaggctggaagcccaagaaggcaggagactcgtctcagatatttcctggtgtccctgaaagtccagcacagtgtgtgcacgtggtatgtccctgatggaaactgcttctcaaagtggaagacagggagcacctctgcaggcctatagggaggtagtaattggatttgcgatgtatttcttttctgcaagtatggttttgtgtgatagaaaccaatgcttcccaaagttcacattgtggaaactgaagccagcaagatactgtgaaggaaaatgcttggagaatgttgcagcctgtgtccctgttggagtttttgctgcccaataccaaattaagggctctgaggaacgcttcctttgaaaataccctagtttaacttaaactctttcttaccaaaccagctatgccacgcccttctgctttggctgtgtagatgctgttccagtcctggggagcacaggtgtgtcctcacgtgcgcttggagaaagtggagttttaattacttacccagcaacattcaggacgtcctgagacctcgtcacttctgatttgggaaaagtctgtgagcaaatgggattttactaatatgaaaacccagaacattccagatgtcctaggaacacaggtcctaggtgtttttttttagcttgggaaagttacgatgacccataagcctgctccacagsatggctgtagcacagacaccttcccctgggacccccattggctgtgtgtcccccagcttctaattcctctagaatatcatgcccaggttaggcactctttctgtattccccaaagcttcataacatggttccatatgtgtcctttttaagagtcttgtcgtttcatactctcattttggcaagacaccttcgtcttagagtgcctacatccatttctgttgaaactggtcatagttagcatttctccatgtctgtgcttttatgccctcctgaaagctggttccatttaggggtgttccctgtcattttcgtgctgtgcaatagttgatgaagataacatagtttataacgcacacctcaaaattcatttcttctcacgtaacaactttcttagtgcttgtacttgtgtgcctctyggagttacttgttgataggacagcgttaagggggtcgtttctttctggtttgaaagttgagaagtaggtcatcactgtcatcgtcatagtggggacacactgagaggttactttctaccaaactgtttcctaattgcactccctgcattgtcttattcagtcccgactttcccaaygcctcgcagcccgatgatacagagacggggcagcagtggagagctcggctcaaagtgcgaagttgtttagatttccacgttacacaaacacacaagcttctcaggggaagagcatgatgaatttctttctttttttttttttaaactaaaattagaataggccgggcccaatggctcacacctgtaatcctagcactttgggaggccgaggcgggcggatcacgaggtcaggagtttgagaccagcctggacaaaatagtgaaaccccatctgtactaaaaatacaaaaacattagccaagcgtggtggtaggcgcctgtaatcgcagctacttgggaggctgaggcaagagaattgcttgaacccgggaggcagaggttgcagtgagccgagatcgcgccttgcactccaaccagggagacagtacaagactctgtctcaaaaaaaaaaaaaaaaaaaaaaaaaaaaacagaataagatacaacagtatcttattctgtaccacagtagtaaatatgttatttggaatatagcttataaataaaatatttaatttacttaaagctgtcatgcccaccaccctcccatagtgaaaaaccaaagaaaaggctaggcccagtggctcatgcctgtaatcccaacactttggggagccgaggtgggcagatcacttgagatcaggagtttgagaccagcctggccaacatggtgaaacctgtttctactaaaaatacaaaaattagccaagcttggtggtgcgcacctataatcctagctcctcgggaggctgaagcaggaggattgcttgaacctgagaggcagagtttgcagtgagccgagatagtgccactgcacttaagccttggtgacagggcaagactgtgactcaaaaaaacaaacaaaagaaagaaaaaattctacttaaagaagaaagaccctctgtgcatcatagatggcaggcacattcaccgtgcacggcagccccacaacaatgtgtggtagacaaccttagcagggcagcttgacactgcgggtccgattctgccatcaagaaagctgcacagacctcatcagaagccactgatgctttggtcctattgaggattccatctctctgtctcggagccatactctagatgcatcactgcaagctgtggcctgagtgtggtgatggtgaggatgaccctgtggtggtattcctttctttcttgcctctggctcttctctccctcactttccctcacccattgccaaaaatgggtttggaggtcattgtgcagtgggtttggaggtcactgtgcagtaggtctggaggtcagcctcaataaaagaccagttttcagccctcacagcctccctgcagtgttattagctgttcctgatttggatgtgtaagcccaagccgccacgtgggctcggaggggtacagagattaactggaggcttgccaaccrtttgtcacacaaatagcagtgccagttaactgagatacgataaatcatttttctcaagattgaaaccttttatcagttgtgtcagtttcattattcgataagcaattagtagcagccattgtcatttagttatctgtagttaacaactcaaagctgctgccagcagggcacccgcttgacacctgcacccaggtggaaacccgtccactgcccacctctccagcagaaattaggccaaactcgcctcctactgccccttggccgattggagattcgtatctgacaggtgtcttctaatttttttaacttacgctctgacacatagttaagttgtgctgtagttaagagaatagtaaacaggtgagcattattctattaccacctactgatccttttatgaaaatattcttgccttttaatttaaatgccaaccatcttgattagagaaatagtgttattccttcctgcacccaagccctgacgtcagyatgacctggcggtagagccagcccctgccagctggctgcccccggggaccttctgttcaccatcaagcggcagttcatctggagtaaggagagaggmtggagcacagctcccagcctgcaggaacagacctctggagatgccaagggcctgaaatctgtgtgtaggtttatgtagacagaagtaaccatatattgaaattgtggttaatggaaagcaaagtcgttttagaatgttgccaaattgtgctcatcaaaagacgcctgcatactttttaaaaattgggaaccactgaaagagattaatccttgccaattttttcactttttcactcaagtctaatttatcagaaaaaataattccaccactagctaagtgtaggagaagaaaaaaatcactgaatgtatgtatcattgagacctatttaattattctaccagtgttctggctttacccataatgaagacaggagtgtgtgtgcatgcataggtacatagatacatgcatattgcctttaatgaagatcttttttgttgttgttgttacggagtttcactcttgttgcccagactgtagtgccacggcgcaatctsggctcactgcaacttctgcctcccaggttcaagtgattctcctgactcagcctcccgagcaactgggattacaggcgtgcaccaccacgcctagctaattttgtatttttagtagagatggggtttctccatgttggtcaggctggtctcgaactcctgacctcaggtgatccgcccacctcggcctcccaaagtggggattacaggcatgagccaccgtgcccrgcctaatgaagatcttttaaaatataactcataatttaagacgtcattctaaattgcatttctaatgctttccagcacctttctctactaccttaaggttagtgtttggtatttttgtagcgcggccatacatttttgtgaggcctggagccctgtcttgtgccttccacgcccgcagcatctacactgactgtgtggtaactgcccactgtatgtggggactgcatatgttgatccttgtgaaagcttttggtttattgtttaagaagaagcggttttgagagcttctcagccactccagctccccagcgcagtccgtctccagaatcaccaataaaaacttttttttttcctaactaaaaaatctgaagaccattcaaatggaaggttctggtctgccctcttaattgtatagtagctcagtcccttctgtagggattgtatttttaagaggacttcccagtacatttgtttatggggtattctttgaaaccacgagccacagtcgtcttccacgtagcatttcggggtctcggaggctggtgttacacatgaagggcccacagtttggatgcagttaggtcactgttatctgctgttttactctgaaagtggaccccaggcatttttaatttcagtgattaacaaaatcatgtcagtaaactgagagactaacaaaggattgaccaactttgagttttgccaagcaaggatatttaaaacaataaccaccgtggactgccaccatcatttcatagaagaagactgcataagtgcccacaggagagagcaagcgttaagctctggccgaggtacaattaactgacttaccctgatgctgctcagagcctctttttctaattttattgcagatgggagaaaaacattttgtattagtgtttaggaagctctgctcagttaccacctagtggagaaatctaggagaaagggctaaagatgacctgagacatatgtcaggtttccttgactccaggaacaggagtgagaagatggatgccttggaggtgagccagcaggctccagggtccctctaactgagcccctatcttacccctgaaagctgtggggcttcaacctagttcttacacctctggaatggagatagattagtacttcactcatggaaaggctgggaaaatggaatgagataatactttaaggccaactttctaaatataagtctatggtaagtgctcagcatggtacctggctcagcaaaagttagggatggtgacggtgatgatggtgagaggtggtggtggtggtggtggtgacgatggtggtggtggtagcagtgatgatgatagtggtgatgatgatggtgatggtatgatgattaatatggtacagtggtgatgatggtgagaggttatgaagggggttgtgacagtggtggtaatgattgtgaccttggtgagagttggtgatggtggtggttgtgagtgtggtgaccatggtgagagttggtggtggtggtggtggtggtggtagtggtgacggcaatgacgatgatagtatgatgatcaatatggtatggtggtgatgatggtgagaggttatagggctggtggtgacggggtagtggtggtgattgtggtgacagtggtgagagttaatggtggtggtggtactggtgatggcaagaatgataatgatggtatggtgaccaatatggtatggtggtgatgatggtgagaggtggtggtggtggtgacaatgatagtgattgtggtgacgatggtgagaggtggtggtggtgatgatgatgataatggtgatggtgatgatggcagtgtgatgaccaatatggtatggtggtgatgatggtgagaggttatagtggtggtgacaatgatagtagtgattgtggtgacgatgctgagaggtggtggtggtgatggtgatggtggtggtggtggtggtggtgatgatgatagtggtgatggtgatgatggtagcatgatgaccaatatggtatggtggtgatgatggtgagaggtggtggtggtggtgatgatggtgagaggtggtggtagttatagtggtggtgacaatggtagtagtgattgtggtgacgatggtgagaggtggtggtggtagtggtgatggtggtggtggtggtgatgatgatgatagtggtgatggtgatgttggtagcatgatgaccaatatgatatggtggtgatgatggtgagaggtggtggtggtggtgatgatggtggtagtgattgtggtgacgatggtgagaggtggtggtggtgatgatggtggtggtggtggtcgtggtggtgatgatagtggtaatggcgacgatggcagtttgatgaccaatatggtatggtggtgatgatgctgattatgatgttgttgggagcaggagatgaggaacctgtatcttgatgcttccctgaatgttgggggtcaggtctgagatgtgtcaagcggggcagtgttctgacttccattcattaaacttgtaagtcacgatttgtgggtgctcctgatgtgtgcccataacaaacctgctacaccaagaacgtagttttatagtcatgagttccgaatagtctcatagaccattgatcctgcttctaatgactgtcagaaagaatacgtgaaggccagcttctagaccagtgtcctcacgtgcaggcgtcctcgaaggtttgtttgttagtagccataaccgtgcagcatccatcgggaggacacacacccctgcaggccagcttttgtctcaacatcactggagagctgcatattacgttgttatttttgtctttccaattacactaactcctcactcaatgtcattcatcaataggttcttaaaacttcgacttgaagcgaaaggacttataatgaagccagtttttttccttatcagcatcataatgaaacaacgtgggaggaaacaaagttatttgaggacctgctgtacacagttttgcttaaagtcacacatttccaagaacctgtcaatggcattgaggactttctgtacaaaaatcactacgcgtgacagctcaaataataaacagttgttcagagacagtggtactgcgtccccctcctccagtccagtcccccaccctgagcgttgatggtggggtgtgcatcccccaccccccaagcctgttcctagaaggccatggcgcacctgctctgtgcagaggctgggcgaacaccagcccgagcctgacttaagcaggatgggcatggacatcgttggcactcacttccctgcagggaggtgcacagtgaagaataaaacacaggtgatttcagatagtggcacatgcctgaggcaatcagccccgatggtgtggcggggcaggtactagagattgtgtttgcagtgagggccactaaggggggcggagaagacccctgacagcaagaaggagccccacttgtgctgttctgtaaggagggtcttccaggcacagagagtggctgatgagaaagggcctgtgtggaaggaaccagggccaagcgagggaggcagatgccgcgtggcgtgaggagggtgagagtccatgccataaaggactgtcatccatctgtcattggctgaattgtgacctccagaaagagatgagttgtcctaacccccactacctcagaatgtggcctcatatggaactagggtcatggcagatgtcattagctatacaggaggggaggggatggaccctcagaggcgagacggacgtacaggaaacaccacatggagactctggcggtggctggggcagcgcggctgtggggcagagaatgctgagataaacgccaccatcagaaaccaagagaaaggaaagggacaggtcctccggggagccttcatggggagccctggcatggccttcaggcctccgaggaacccagaggaggaaacgcatttttgtggtttcacgccacccagcgtgcggtgcattgtggcaggtgcaggccgctagtgccccccacccagtctctgtgtcctctgcacagtagggagctggggaaggtgtgtggctactaacgtgagcctgttaacgttgaaaatttccctctggcggctgggcagagtgggctgcaggggctgaagtaggcagtggtgacagtggcttccccaggcatcagcgccacaggaggagagacacagactgtggcttgcaagcagagctggcaggacttgctgaaagagttaatatgggaagtgagaggacacagaggccagggccgggagaccaggaggccgagagcggtagaacgtcacatcctggaggggcggggatttccccttttgttttgtttctgtataagatcataccatgtatattctggaattttacttttctaatttaacaccccgtgggtctccagttcttccacaagctgtttgaaaggccacagggcactgcgtggaatgcgtggtctctaataggttatgccagcccctctcgttgggcattgaaattgcctcagcagtttttttaacaattaccagtaatacttccctgaacatcattgcacatacattctgaagcgctcacgctttgttcctgtggacatctctgcctgattggaagcttgcgttgcacattcagcccacgcctccatggctggtcctggactgggtgaggacaccatgagaaacagctagacttgggatgtctgtgttgacagggccatgggtgagaacagagagtttctcaagcgacatgccaggaagagctggcttccccgcacaagcagtgctaccaagggtccatttgttactgagtcattcattcagcagactcgttgagaacatgtgtggtaggcacgtgctgggcactgaaaataaacagacaaacacaacatgacccacgcacccagcctgagcccaggaggctcctggtcccgtcctggaacagccggtgactcaaagctcaaatatcatccccacctggacagtctgcaaatgactttccttcttccctcatcccctttcccatcctcactctcttccaagtatctgattgcacgcatgtgcacatgtgtgagtaggggagaggctgtgtgttttcataagcgaatcctgattttctgacaaaagagacatgaaacaaatatgttaacaagtaatgttgctccctctcatgagggggtcactggctgcccttatagaaggccttggaaagaattacttcatgcattcctgttcattggcggtctttggcctttgagagtggaactctgcatcttcttgtccctcctggatgaatacaggacacttaaacatttaaaggggggacacagagatgggcaggactgtgagagtccccctgaaaagcgagatttcatagaagtattgaattttaccaaaagtttcagaagtccaattcattattagatttctataaatataaatatttatatgatatttcttgygttgaattcagtatgtgctcaagttaagtgtgatttgaaaaatgaccaagtctcctaaggtgaagtttgtgtgtgaacaggagggccggggtcgctgggttccaggcgcagccatgagacacctgctctgcacccagctcttcttttgttttgctcaccgagaaaaagaagactcgggaaccacagaactaacacagaagtaagttagaaaattactcacgtattcgcccactgtgtgccaacagagtcttgatctattgcccaggctggagtgcagtggcacggtctcagctcttactgcagcctctgcctcccaggttcaagcagttcttgtgcctcaaccccccaagtagctgggactacaggcacatgccgccacgcccagctaatttttgtatttttagtagagacggggttttgccatgttgcccaggctggtctcgaactcctggcctcaggtgatctgcctgcctcagcctcccagagtgccaggattacaagagtgagccaccacgcccagcccaggatgctttcttttcatgggtctttgtcctttggagggccttgacctcacgcagcaggggaggatgctggcccacaccaaggcaccaagattttacccacctctgtgtgtggtcgcacgtcctcctcatggccacgctgggatggaggtggactctgagcacagacaagggacccatggcccagagcccagagtcacccgcagcccccctgcgctgctgctgcccgcatggggtacycttaagtcccacatccaagctccctccaccccacactctcccttggatttgcgcctgttctttctctggctgtgcacctggcagtgctgagaggagagcctggtgggcacttccaccctgatcaaattcagtcattaaccccactgaaacctgacaaggcctgtgtgcagctcactgtggaggggtcactgctgtcctaccacttttttttttttctggaagtttgcatgtcctacactatctataaatatgtaactttttttccaaagaacttaaaatgaaagaatatgagaaaacccctaaataatacatacatggtatagattgatgcataaaacagtcagcccctggactccatggctctgtggaatgggcggtttagtattcctttttctggcaactcacttagggcttttacaggtgcaatgagctttggtgaaaatagccaatgggcacctcgtatcttgtgccccaaatattcctatttagcacagtgtattctggatgcctgagtgactgcaaaccctcctcctgtgtaactttgttactgtttttcctgtctcaggaaagatgctcattttgtctcctgactgtggcagttgggggtcttgagaccattcctgagtttagaccttcccaggggagatcagtgaccacagatgtgcctcggtgaatttcacaaacccagcttagcgtgacccaagtytccagctttaccgaactttgtcattgttattaaaaagatgattttagtgtgctgattagaaactgggatccacattcaacataagcacaaactttttttcccagtgggccaaagctcatttctgatcattaaaagctaatcctgaaaattagctggagcatggttcaagcatacgttgtaatctgttaaaagcaaaaataataatttcaagcagtgttctgcgtctgtgtggaaacagctggtctaccccaaagagcatcaggaggctataccctcctcccacaattccaaataaaatatatggagacagcacagcatccggaagaactggcattggtaaattattgcctccaaagaatattagttagcaaacatactttgaaagccatcttcacaatcataaattcaatagtacttctttcagtcacaactgaatgccagttggggcagcctttcgagttgttaagcagtttagtagcaaatgtgacatatagtgtgtgtgccacagtaagatttcaaattgtcattaatttgtaaaatttaggagaagaaatgatatattgtgacgagataatagttttctctgtatgtactccaagctatcaaatacttctagcctttaacttggcagtgttactcttggcattttattctatggaaacaactgaaatgaatggaagaaaaaataatattcctgttcaagatgcttattagagtgtatttgatagactttgttttctaggaaagctttagacttttagaaaaattgaggagatattataggttattcccataggcttcccaccacttccccctgacaagtttcccatgttttttgtgtgtgtgtgtgttttggtttttgtttgtttgtttttgtgacagggtctcactctgtcacccaggctggagtgcaatggtgcaatcttggctcttgcaacctccgcctcccagactcaagcgattcttgcccctcagcctcccaaatagctgggactacaggagtgtgccaccggctaattttttttatttttggtagaaacgttgtttcaccatgttgcccaggctggtctcaaactcctgacctcaaatgatccacccacctcagcctcccaaagtgctgggattacaggtgtgagccaccatgcccaccctctcccctgttaatttacctctttcattagtrtggtacatttcttagagttcatgagtcaataytgatatgtttttattaaagtccacactttatttgcatctctttagctttaacctcatgccgtgtctctgttccaggatccaaatcctattccattgtcatgcctccttagccttctcttggctgggacattttctcagacttttcctgtctttgatgaccttgaaggtcttgaggcatgctgggccaggtgtatgataggaatccctctactggaatttgtgcaatgcttttctcaggtttcatcttgagttacaagttttgtggagaaggaccacagggtgaagtgctatttccatcctatcctgtcaagggtatataccatcaactttatttatggctgctgatgttgaccttgatcctttgacttgaggtagtgtctgtcaagttattctgctgtaaagtcattgtgcccctccacagcccatactgaacttttggaaggaagtcactgtgcacttaaggagttgggcgttagaccccctgtccttgagggtggggtgtctatgtaaattttttagaattcttttgcaggggagatctgtttctctcccccatttatgactatattcagttgtctatttgtattcatgtggacttgtgaatatttattttgtattctaggctgctatccaatactgctgtggcccagattattccacccgtggctcctgggggctcctctggctgctcccacaccctttgccctacaccccatctctgtggggtttcttttgtttgagcactttccttcctttctgtcagtacaaggtgcattttgtatctttcctgccacaatcttagaatcggctgtttcccaaagagctctggttccttttactggagaatggtattagaaaccagtgtcttggagctaggcgtgctcgttgcttctggggtgccatttcttggttctcttggccaacagagtaaagaacgaaatgtgtgtatactaacctgcatatgcatatatatctacaaatatttctatatgtaaccatctgtatctatatttaacagatttcatattcttactggcataaaattggaaataactaagtgttttaacatgaggaatggctacaactatgttaatacyacctccatgatgcaactgttataagggacaggttggaaaactgtggaaacataatactttacattaaaaagtagtattttttattgtagagtctccaacaaaggtctctgttggagttacgcttacaatgtgatagttgtgtgtgtgtacggatatgaactttaaaggaaaaatggaaaaggtagataagccatggcttattcatattaaactaacataaaattaactttgcttctgccataatgttagtcttccagtgagttcttgctgaaacctgaatgaagttgatgtatttaattttaaatgaaagaaatgagacactttttattccgttgttgtgttagccctgcagtgctttttcaggccctcccagattaataatgaccttgtttactcattsacagtaaccaaagagcctgctaaaaaagttgtgaagttaaggtcaaagcagttttatgggaggaaatctgtgagtgtttaaaggaaggtatttccataatagcaagaagagcccaaagttgggaattcttcttttgcttttccactctgatctttgtattaatgcttgattgactgaataaatgccatgtatcttatggttttcatgatgatttctcaagccacacgtcaggatacttttgggaatttccagagaagtccttaaatggaaaagctaaaattatctctagtagatattttcaccagtcttcagttcagatggcttacatataagaggagcatgattgactggataaccctgaagtgtatcatttcacccgctgtagttgtcagaactcaactacaaagatggcagatcaaatacttcaagaagggtggttgtttgccattgtggaggctggtggtccagcgatcacagcccctcaattacggccctgcgtgagagcacaagcagcagtcattacataattatacctctgattagttggttgaactggccattgcctttgaaatatgataacacaatttggagttttattaaaaaacaatttttttggaatttttgaaaaagattttgtgtttaagaaaaaagaaccaaagggcctgcaatatattctgttagaggagattaaaaagaagaaagggatgagggaaaaaaagagatgaatgtttcccattatcactcatttctgtctcaggagggctaaggtggcccctgctcaccagccttcccctctcggcatcaccagcccccagcctgctatccgcttcacagagcagcgagccagtccttggagaggggacgtgagaaggggcagaagtcaggggacctgaggctgctccccrgcaccagtgctgctcaacacacacaattgtgtgaccaccactgaacaaatctcacaagaaagaggtgcattttactccacacgtcatttggttttgaaaaactaatttgaacctcatttttttctaagtgagaatttggtttgctgtgtgtgtgttttcaatttggattgccaagtattcagtcctaacatatgttatggttggagtgcatataacactgtgcagccgaataactagacctagaaaataaaactgatcacggtaaagttattttccaggcaggggatgcctcatgatactggctggggcccaaccacacccaaggcctcgtcggtttctgttctcatgctgttgtcatatacccagaagtaggggaagcccaggagccatggagcctcagtgtcagttccctgacaagccatcctccaaaaaagcctttcctttgcaaaatgaacaggtactccgtgaaaacagggagagaaatttctgtttttcaccgatgcatttctcacgttcatctgacaatgtgcaaaacaaaaagtctacattagaaatttatcatgaagttatactctacttcaactcacttcttttcagtccctgtgaaaacttaatactcttggtgttgtactgaaatacccagtggatttggggtgcacctgtacccttgatctccacttctgcgtgtttctaggccaaagggaaaaccaactctctacctaattggaacttctggttttattgcatatcctggaggtcttgcttcgtttttattttcccgggttgatggtctttcccatgtgcacctacgttagcccactatgtagaacgccttggcagttttcacagagtaagaggttgaaggaagccaccaatgtgaaaatcatatttgctgtaaagaaagaaccattgtgagttgttggaaaccagattaaaattccataattggagattgatgacttttatttcatgagttttacttagttaggtgttttatcttctgtgttttgtggctccaaattacgaagactgttggccttgcaagaaactgatcacggcaaagttattttccttactgaacacgtgtcctatatatttgcttggcctcgggttttgtttaatcccttcaaaggccctttgaactgatgtttcaacatgactccttctctgtgagctctccgctaggaagcggccatcatgtcaagccccttcacagctaaagtagtgagttcacatagtcgaagaatcttctgggttgcatcttatgaaaaaaagaaatccactgcctttttataagagaacagaacatttacaccgtcttgttgagcaaatgaacgttcaaatggccagcacaaaagaaatccccaatctctaacctcacaatgaaatcgccacggacaaaagatcacgggataccgggagcactaaactggaagtgacacaaaaccacagcagaatccgctcacacctgccgaggttcctgggggatgatctttgtgtaaaggatcctggtgccgcagtcagcctgaaacactccaaggagcagagacgctcccctctgcaacagtgacatttatactgatggcgtctttttaaataaattaatacatgtctgatgtggacagagtagtgctgtctgacaaggtgatcatttgacttttcttagaggtacaaatttacgctcccttctatgaatagagagggctatttgtttcattcaaagacaagacattgttagaaatgagtggcacacctcttcaacccatccccttcctccatggaggtaaaaagatcctattagttctcataattgattctgagggctgcagcgtgcctcatttagccgtccctgctcggttcacgccaaggatgtaattcatgcacacttggacgtccaacatggctgacgcgccttggacacacagcctcggcgctgcatcattttttaatcagctatctgaggaatatttatctgatcaacaargagtgytgtcaggaggagaccagaggtgacattaataagcctgtggtttcctggtacaatgatggaggaagagtttggaataaaaccctgctcgtttgagcatgccagcagactaaagaatatttttattctgcttayaaagagccagtcaaaagagtctcagtttgaagtgttcagttaagtttaagtctcagtgataagttttcaggcattcacatgtgttagtaaaaaaaaaaaaaacaaaaaacttttagagaaacaaattaacaaattttatttcaaaataaaaatttaagttcctcatgtcgcaggaacccagatgaaaagctgtagcttctaaaaatagggagaggtgtaataattgggagctgttaacgctaaatgattccagctactctaacttagtagaaagacgtagtaagctgcacactttccccttctgtctgtctttgaaaagatcgtgactgtctgttagtaattacaaggagctgagtatattatgccaggcctcgtttggtcatccagacacaagatttgctgtttataacgatcagatgccttaagaaatgttctgtgaattaaagtttctatcacactttcttttctaagtgcatcactgtttgtgcaccacatgagaccctcatgagtggagtgacacccatcccatctgccaacctgaagacgcagaaagtccatacatagccagtgtagacatcagcacactttgtccacgttaggatcgtggtaccagaaggtgccacagtgatctctctttgtaattcaaagactgcctcatgaattcagtttgctaacgccttcggtgttcctcaacaggagggctctgtgtgtgttttccggaaaattaataccattgttatattacacaaggataaataaacattttgtcttagagtttgggagtgagtctctctgcattgtcttaacctgagtttttcaaagttttgatccttttaatccttagaaaatacactaaaaaagtacaaaaaattagtcgggcgtggtggygggcactcgtggtcccagctactcgggcggctgaggcaggagaatggcttgaacctgggaggtggagcttgcagtgagctgagatggcgccactgcactccagcctgggctaacagtgcaagactccatctcaaaaaaatgaaaaaagaaaatacattccagccagcatgatgatgagttttccatgtgtgttttaaattcccagcagtcggtggtgattcccttgtttgacctcttgctgtgatacccgcatgtagcacccttgtgtttcacctgagttcacggttcacgttttggcaccattgtggggacagtgctgtcctcccacgagtggcattctctcccaggcccactgactgttctgcctacccagattagagctcagaaagttscatttaatttgcagactaaagtgagaagagatcagtctcgytgtctacactggagctgacagtcagtttgtaccacatctgaaattatacttgtgggatttcatgtccattgagattcgcgtatgtgtttttaaacatgtaagacagtgctgagacatcctgccgcatacatagctatgggaggcattgtgaaactctgtttacsaaagagacttttgcttaygcagcaagcaaaatagcagaatggaaaacactaacggaatgctcacaccctgctgcctttttgtttaataacaggtgaaattttgatactagaataatagattttgtgagaaataacattagtaacaaaatcaaaataagttagcctgtgtttaagaggaagaaactgtattcctgaaagtagaacaggaattttactaaaaattttaattaaaataaagacccggaaagttttagtctattgctagtccccctgaagtccccgagartcgccttttattccaaaggcctgagaccagagggaggctgccagtggtgggcagtggctgggtggcaccaaacatcagctcggagcctcctggttccatttggcacagtgtctccgtagcccctcaaagtgattccaggcagcagcatccgacataacccaaggtgttattgatgataataggattgtattttctygttgagaagcttctaaacaagggaacttagagcartcaatgcccccggagaccgatgcacatatcaggaccttgrtatcagctagaaaacatycatttgtttaaggggaagaaacaggcacgacattttgcacattaaaatggattatttcatcaataggttaatagaaagccgggctgcaagttcacttcctgcttatacatcctgtggtaatgggagagcagagtgtgaaaaatggaaggcataaagcgggcgaggaaagaggctttctgcactcgggcacccctcccctcccgaggggtgcccagcctccattctgcctatttatatgtaaatattgctgcaagaggtaagttgtactcttgaggagtgcagccttctcatggctacctctttctggaacttgcgaaatactgtcccagacaccagagctgcagcagttaaaaattaagcccatgcctaattctgcatcatcatgcctggggcccctggtacatacccatcaagcatttctaaagcaaacatttgagacccgggacagatttggtttccttcgttcctcatgcatggtatttgtaccggtgggtacctgaagatccttttcccaggtttggagttacctgagacagatacttaggtaggaccttatagatagtgaagaaacctgaaggtatagacataaagaagtcttcacttgtgaaaaattaaatgtagacccgtatcctttaacaccgcagatgcctgctagtttagaggttgtttcttactaaawtattattattattattattattattctcttgagatggaatctctcactgtcgcccaggctggagtgcagtggtacgatctcagctcactgcaacctccgcctccagagtagctgggattataggcgtgccccaccatgcacagctaatttttgtatttttagtagagacggtgttttgccatgttggccaggctggtytcgaacttctgtcctcaagtgatccgcccacctcagcctcccaaagtgctgggattacagacgtgaggacctggcctatttgttgattttcacrctgcaaaggaattgttagatgtgtttagttataacaagttaatatcactttaaatcaagaagcaactaaatcacagctagtttttacttgtgaataatgtaaaatttgcatcctaaatatacagtgctttatcgcagaattgtatttgcttccttaaaggctcaggtttctcgcgtatgttttgtgttgtctctacaaagaaatccagtgtagttagaagcacttgagattcatttctgcaacataactcatcccaggcrcctagtcatcaccctgggtcattttctggccaccagaacttggtgcacacgccraacctacaaccacagcctcagctgtagtgttcgaaatggagaattttggctcaaacactacagcaggcaagaagagttaacctgtcgtaagtcaggaacacgttggggttgattagggagctgaccgttggccarctcatgctttgggaaccrgagggccagcctggctgcctgctttgcgggcttaagacctgcctctggaagggtaagggcctgcccgtccagataagtgctgctcacctgcattaaacaaacggccacacagagcccagtgggagcctgcactggtttctcttcctgcctgtggmagttgagagagacagacggtcctgtgagaccccttcttcagaaggtgaatgacagtgaccgccactaaacattccattccacctgcctgcacggcagtccaagccctctagccctgtgacctggggctgtgcctttgcttgcatttgcctgaagagttgagccaccctgtttaactcttgggtttttataaaatgtctcctgaagggcggagagaaygcctcaagtcgatgtcttccctgccacagatgtcagcatttctgagttgatagttgggagggtaagggcctggtggggtggagaatgtgtctctggagggtgggggccccatctcagtgagccagccaggcactgcacacagcctgagtggtgggcctgctgcgcccttgttaaattggttctcttccgaacccarcgtcccactgtcggtgacttggcgttttgtcctttctcctgagaacctgaggtggcatttgctcttctggttcctaggagctccatttagagccgtaactcccccgagtgtcaaagagaatagactcctccctccaggacagcagaatggcactagggggttttgctgctgtaggtattgcctgaatcaaaatctgtctcgggaagacaacttcacttttaacagctcttggttttaaaacctaccttctccaacacataggcatgaactgctcataaccagggtctcttgatttgacatgctcctaatatttggccgaatcaaagggcttgtggcgactggcatcatagctccttcaaagggtgtcatcatttcccaaggcagaggccagtttttgtgctgttttgagtagccacgtgtgaaacccagcagggcgaagcagacttctgygcgtgggtagttctttgacgttagatgcaatcctgatgaccctgctccacctctgcccttcctgagttcctctgttcaccgcaggggagttggagggctcagcccagggagctccatggcacccacccgcttcgcgcagacagctcggaggcaacgtcacgtgctactttgacctttttttttctccccttttcatttgttttcttttcctttttgttttctctctttttcccctctcccctttctgctctcgggatgcagccaaacgcaaagcatggaaactaaaccgtgttggtagcctgcgaaatatatacagcagcagcaccaacactgaaggtaacgcctccgcacctccacccgcccacacctccacctgcctcttcccctctcatcccctgcccgccccttcctttccaacacaggcatggaaatgcaatttgcccaaagccgcatgctcccttattgtgtttgcagagtcattcctgtggtcttttcatctttttgtttgtgtgttttattttaccattcrtgttcctttcagcttacttaaattttgacctttcccttcagtcgtagagtagtgatgtttaaattacttcagaaacctattttctcctcttttttcttttcctttatacatgtgggcactcagtgtaatatttcccaagttattacagtttttaaaagtgttagtatcaggtgtaatgatctgtagccaaatacaatagtgtgccgtgacatttaagtaacagtcttaatttgttttgtggaagcattctccataatgctctctgcagctctaatccacaggcaggcaggcccgggccatttgcatgggctgctatttgcttgtaaagtcrgtattttgttgtgtttctaaaggtcgtctggtgccaaagttcacaaattgacttgcgttgcttttttcaccgaagacagccgtcattgcttttgtataatagcagattgaatttttcccccaccttcatttgaacaacataattataaattgcctttttttttatgattacaaatgtcaagggtcggaattactttgatgccaggcaagggaaaaccaccaccatcagcccaagcgcacataagggaggcgggggyatcggrcgtgtgatgcaaagcaggtcacaatccagcgatcttggtataatagggggacattttttttcacttaagtgcaagccaaatgggtcaagtaatcgcaagctcgtgccctaacactaattgacttatttggggattattataactgtaatatttttcttaatgtcactgttttctgggctgttgattttagcgattgccaagcaatggcattaaatctcttgtaaattttaaattgcacgttatttctgtaaacaagtccctctcttcacatcctggtcattaacctttgccgatttatatcaccatcctctttttttctttctttcacaattactcctgtcttgccgctgaacgccctgctctcagccaggaaaaaaaagaaaaagaaagaaatctggaaaacaaatctacattttcactatggcttgttaaagagccattttttaatcataattttttttttcatttctcaagggaaaattgttgtctgttaagataccagtggagcttggcctcattggtatcttctttcaaagcactcaagaaataaccaaatgaaagagggaaaagaatagaagttaagaaacggtcattcattatcatttttgttgcattttaaagggtattagtatactcttttcaccgttttttaaatgtttttcaacttagcgtgcatatcatttctcctccctgtgtccttatcaaatatgttgggtttgctttttttttttttttttttgtatgcatgtgggtttgtcgcaacaaatttgtttattgacttccagcctttaaaaaaaaattgtgaggtctggtttcaaatgcagtgtatagaaaattgggggacagcaaggggacatacctccttagccttgagggcaaatggttccctgagacttgctgatgggccttcctggagacactggtgggtgacacgggacccagtagaaccaggartgaggatttgcagcagtgcgaacttctcagccttagcttctcaggtaatacacagcatctgctctgcccagcacctcggaggggtggagagcgtgaattcctctctgaaatctgtcagtactggatagcactgcaaacatggggtccctctgtcagtagctatgaaaggcattcctggggatactaaatagtgactgcatatccaattgtccctcacaatttctttcatttttctcagttatastaagtttctgtttggtgttcaaggtcatgtatgaattttcaattaaaagacagcattcttcatttactttgggtttattttaagattaacatgtgtacacatacaatctcatttcatacggtttttaataatgtattacagaattcaggccagacgcagtggctcatacctgtaatcccagcactttgagaggctgagacgggtgggtcacctgaggtcaggagtttgagaccagcctggccaacacggtgaaaccccatctctactaaaaataaaaaaaaaaattacccgagcatagtggcgagcacctgtaatcccagctactcaggaggctgaggcaggagaatcgcttgaacccaggaggcggaggttgcagtgagccaagatcactccactgcactgcagcctggacgacagagcgagactccatctcaaaaaaaaaaaaaaaatacattacagaatttataaaattatataaaataattgtcaaattcctttctgatttacagccttttgatgtatgaagttatcacatattcactgtctataaagtgacccttcatgaaaatttgtatcctgaacattttaacttttgttttaacctcacgtcgtgagtgttacactaaatatatccatccccaagtggagtatcttttaaagtggtccacttgagtgatttactcaaaggcacccaaaaaacaccacccaagtaaggtggacactggagtttcctgtgtctagagggagaacttgagcttcaggaataagaggagaccacccactaggagctgggagtggactcagctgttctgggactttcctcaggatcctggtttaggagagacagrcagagccaaggtttgagtctaaggatctctctgaagccctttttcttttatgtcctctctcttccggcctctggaccacattatctcatttaatcttcacactccccctgccaggtaggtatcatgttatggatggaaaattgggattctgataactcaagtgattttctgcagaacaagctagcatgttccagaggcaggacgtgtgcccagatctcttgactgtgggacctgctcacagatccacgtggaaggagtttgtggatggaagtcaggagtggataaaaacaaacaaaacttacaagggaaacgcacagacaagattaaaaaacaaaaatattttatcttttgtctgtccattgtggctaacactgaaactgagatagaaactttggatatatatgattgcactaatgtacaaacttttgttgctttttaacaattaactttctcaagatgggtgaaattgagttttcttcagccagaatgcagctgtaactttaacatctcaggaacctgtgaatggaagggtgtcttaatggtatgatcctccaattaacagctgtctcccaacccaagggagaataagatctaaataccagatgactgaggctagactcaccaatgttcaactgaaagtaaatgtattggagaaagaacaaagaggaccaagtggcagaagagtggacgttgtgcaggaggaaactcgggagggaggcctcttcgctgcaccgcagggcagaattgcacaacacctggacccatctccaggcctcacctgccccatgcagctaaacagatgacattatcatccgctgtgagttgggtgaacacatgggctctttcaagagcatttaagctctctgtttttgcagaagaaaagtacttccagtacctaaatagataaaggagagaggtgttaggaaacaagggggcatttcttgggatgccaagcccattccctggcagcagaatgaatacttaagataggcctcttcaaataggtgatgacacttgcatccaggtgttagccagattcagtactggcctaaagtcccaattcgagcccgtctatgagggcccgtttctgtggatttagagctcgccccagcaacaggcctgggaaacctctgctttgggtacttccgttcaccacagtgggccagatcgctggaacccagtctccccgacactgcgattccaagcataggcattgccatggggaaacagcaaacctcctcttggaaatttcatcacagatacagcttcgcgcctcaggcctgcagtcagacccgcacctgccttctccactgaacagcccagatggtcactgttcctctgagcagatgtgagcaggcctaacttgttggccattccctccaacactcgttttcttgrtcacagttctgagacttccaactcattcacagttaaacaaattacaggcccacatctgagaatgatggtcttgctgagtgtgaggtaggcctgcctccttgttcccgactctcaggtccctgctgggatgcgccattgcctgygctgggtgctggggcaatggagagggtaagggtgcacccgcccactgccctcagggagcttactgtcagtctaggaggctgcacaaaggatctcatgcagaaggagggaagaggccctggatgctctrggggctttgtggagagcagaactacatttgatttaggggtcaggacaggtatcatggcctgcgggatgtgacaggaaccacagtgaccgcatcctcagtgctgagaaatttccaacatcctgtcgtgcacccctagcagagggagatcttttcctccttgttttataaaagaagaaaccgagcctgggagaagggcaggcrtcagccccaggagctctcaggaagacggggctggaattccaggtggaggcagcagcctgcacctggacggggcttagtacagagcctgcagcgcccttaggcttgagtgtgaggtgtgtgccgaggattcttttgggaccagtaccagtggaggggactagatgatccacagatctgcagacagctgtcatcatcatctccagcagaggaagaaggcagccctgcctgacaatctgtgacccattgtgttgtgtgtttcctgaaggactcactgcagtgtctgatcaaggcccccgccaaatgccccggcagtctccccagtgccccgtgtgggtccccactgtgagaggctgccttccagaacctgctctctgcagtgagcattctccaggctcagatgggttctctttcacactgaatcactgctcttgtttgtatgaggcaggcatgggcgccagactcaagcccagatcttaactcaggtggtcttgkttcagtcccacatccccacttcatagctctaaccttgggttcttgatgtgtcttctctgtacctcagtttccccacctataaactggggtgatgacacccactgcacagggttgtggggaggagtcagcaagctaacatacctagagatgtggaacatggcccctgcattgctccttgcctaggaccagtaagccccagtactcaagcacccagattctctctgttttcaaagaaaattgcagtgtttgaacgttgtttatgtagccaggaacagagatttgaaaagacgtgttgcccatgaagcataggggggaatttagaaatgaaacttaacctgttatctagacttttaaacctaccctcctgcttccatttgctgtcatctgagaagaatcgtcagttgtagaaatttggctaaaagcgtgagctgtggagtcacacacgcctgggtctcatcccctctctgccacttcccagctgtgtggcttgggatgctttcctgggtctgtccttcctctctgttcttttcttcctcgcatgcagacaataaaacctaccttgaagggtaattgaagaagaaatgaagtgaagcctgtgaagtgcttcccacagagctgggcacatagggaagctggccgccgtggctgctattaaattgctatacagacttatttaatagaaaaatgacccaaagactccatggagaatatctgtggactattcagtaggcctttttaatgtatcggtacagagcagakctggccaaagccacccctcctcagtgatgagcagcaccaactaagaactaatgcaggtaggccgggcacagtggctcacacctataatcccagcactttgggaggtcaaggtgggtggatcacttgaggtcagacattcgagaccagcctggtcaacgtggtgaaaccccatctctactaaaaatacaaaaattagctgggcatggtggtgcgtgcctgtaatcccagctacttcagaggctgacacacaagaatctcttgaaccagggaggcagaggttgcagtgagccaagatcgtgccactacactccaacctgggcgacagagcaagattctgtctcaaaaaaaaaaaaaaaaaaactaatacagataacttcagatttaggaaacccttgcatggggaataactagaattgacgttttgggaagagaagattgctcatttttctagccccctccttttgaaaggatgacagtcttgggtatcaatcacctcagcgctgagcagcacctaggagaggaagccctcaccgtggacagtggagggtgccgctgaagattcctggtaagcccgggtctcctgatggccatgctggactcttgcagaggaacccgccctaggcctgcccaacatggccgtgctcacttattcctataattaggagtccgaggggacctctgcaaagtggggagtgtgtcaggatgagtaacaaacagttaccgcttagtaacaagataaatcaccgcacgtgcctatcgttgctttgtctttctaaactgaatgtttgggcctggagctttcacagggtatctgggacagagaaagtacaagggagatagcaacactcacccctgctgtatcgcaagatgttttcaatttgcggtcagataactatttttttttccccaagagctttgttttggagtcttttcttaatttaagacaggcacgggccagacatggtgactcacacctctaatcccatcactttgggaggctgaggtgggcaggttgcgtgagttaaggagttcgagaccagcctgggcaatatggtgaaaccccttctctacaaaaaatacaaaaattagccaggtgtggtggcgcatgcctgtagtcccagctactcgggaggctgaggtgggagaagcgcttgagcccaggaggtggaggttgcagtgagccgagatgaagccactgcactccagtctgggcgacagagaccctgtctcaaaaaaaaaaaaaaaaaaaaaaaaggcacatatggcaccctacagctctggaagccaaagctttcaaatggagtttctttacacgtggtccttgaactgctatcccagctctttataatgtgtttgaaaaataaaaatgtcctttgtatgtcatgagaaccttcccgtggtaatatttagtagttaaacattcctaagctcgtaattgacctgtggggatttgcttcttcacagaattaatcacactgttctaaattaagccacaggacaacacctctgttggactctcttggctagacaaagatgttgaccaaattcagagtttccaaaaataattagctgagaaccgtgaactgcgtgtgtttataatgatcttttgtttttgtttaaaattaataacttctcaagtatactaagtatatccataggtttcttggttctgtacaaccctggtccatattctccaggcttgcctacagtctttgtcttttatttttggacagagagtctcactctgttgcccaggctggagtgcagtggcacagtctccgctcactgcagcctccacctccagggttcaagtgattttcatgcctcggcctcctgagtagctgggattataggcacccgccaccacgcccaactgctttttgtatttttggtagagatggaattttgccatgttgcgcaggctgctcccgaactcctcacctcaagggatccgcccccaccccaggcctctgaaactgttaggattacaggcttgagctaccgcacccggtcagcaggctttctttcacatcagtcttttcctacaaaaatgggagaaaatttgaaaataaaaactgactttctaatactgtgttttggctgacatcttagtgtgtgagctttttgtcataattgggtaaaatatctaagccacacgcctatttaatagatgsttttaaaacagaaatattggaggattttacaaagtgtatgaggaaaaatagcattaaagcccgggtgtgtgcgtgacattgccacacattgcctcttagggtcatggtagagggagaaagaccacaaggtagcgagtatattccgtctgagtttccgaccccgttgcattgacagtggctacctggagaactgtgtgaagaggaattctggggctgcaccagcctcttcaggaacagttaggaatgtctgtttttaaaagaaaaggagagagagcttccctttgtcatcccgggtccagcctggcacctcccttgcagataaagctgagatcagaaagatgaagtgggctgctcatgggcaccagtccgtcgatggcaggatgggaagtaggttccaggagagagaaccccaaagttggagctccagttcagacagaaactgggagaacccatagcgaaaactcacttgttaataggggaaaaagaaaaagggcttggcggaaggtaagcatcggtggtaatgtgttcaccacggctttgtggtgtgtcctaaaacagaagtcccaactctttcaccaaggtcaggagtggagaagatggttattttctgcccaggccttggctgttgtattgtcccgtcttttcggtggtgctgtctggaggcctctgggcttggtagatcctgcactctttgtacagcaaacatgcccgtcccccaggctgagcatgtcatctctgcaccgttgcgatatcccatttcattttcatcacaggttgctcattaaatgtgtcacaaaggatgcttagccttgtggacagaacactggatgggcctcaggagcctggatttcaggctatagggcaccctgggagaacctcctctctccccaggacccagattctcatccggtcattgaagaacttggagtaagtgacttctgcatcctccttgagcccttttctattcagaagagaaacatctcggcattgcacctgcacccatcagtagtttgtggttggttgttttttttttttgtttttttttttttttggagacagtctcactttgtcacccaggctggagtgcagtggtgtgatcttggctcactacaacctccgcctcccgggttcaagcagttctcctgcctcagcctcccaagtagctgggactacaggcacacaccaccacgcccagctaatttttttaatttatattttagtagagatggggtttcaccatgttgcccaggctggtctcaaactcttgagctcaggcaatccacccaccttggcctcccaaagtgttaggattataggcatkagccactgcgcccggccccatcaacagctttgagccatttctcatcgtagctcggggcacagatccaggtcctcttggcctttgcaagagcacagtgcagttgtccttttccccagaccctttccctgagacctgtgtgtgcctctgtgcctccctccttccctcccctcgcacccacttctcccccatgcatccttgtcagatgcctcctgttgaaagcaacttccaaatgtgaaacggttttcagctgcttttagccctttaaccctttgtctgctagaattccgcaaaaaaataattgatgacggattggcccattaacctttaagaaaaaaaaagtttgacagcccggattcatgtaatgaggagggattccttgtgaaatcagtctgatggctgagtttcttgcccctaaggaggcaaaattagccccatggggccttgtctgcatagaaactggacacaattagtgtaatatccggtgttattaatgtcgtttggaataattgggcaggttgatttcgacaggttcatggtgctaaaatactattatagtggacctttccacagctaactgttaaacacagaaaactgtttaaatccctgtgagcccaatcacaaaactttattaaacagctaagccctggaatgtcacactgggaaacagtacaccgtctgttacttcaggctttggggtgtggtggcatcttgatttttcaggaacagggggattaattttgctgtctgtgtgtgtatctgaaacttcaacatgcttttaatagatataccatcaggagcttctacaacctgaaatctgtttttacagtgaatgaaatagaagccactgcaattgtcacaaataggtagtttgtattagtgaaatgacaccactaaaagtgaaagctccgaacagggcatcctcacaggcacatgctcgttctgcacgtttgaagtgagggtggcagtggagagtaatgctcggctctgtctctgactgatgggcctcacgctgccaattactgttttgatcatttttaatctagttgctcataagtaaaatgtcatcaccgtgtcacttcgtaatgtgctgcagcccttcggggccatcggtgatttgaataaggctctatcatctgctaaaaattcttctttgaaccttaggaggagcatgttcctgttctctccacacagaagaagggaaattgggtccaaaaatctattcactstttacataatgagcgtaaatggtcactgcaatgccaccgaagtgtaaacacggattaaacacggattaaatcttgagatttgctaggtgttgacctaataaagtcaccagagcagcacataggagatcaccaccaggatagatcttctctactggattagtcagaactaggtttagtaacaccagaaatccagttttaaaaaaaggagacgctgggcgtggtggctcacacctgtaatcccagctactcaggaggctgaggcaggagaatcacttgaaccccggaggcagaggttgcagtgagctgagatggtgccactgcactccagcctgagcgacagagggagactccttctcgggtgggtggatggatggatggatggatggatggatggatggatgtcttatgtaacgaactgtaggacaggcaggagcttcagggacctcagaggcaccaggctccctgccacctcccatccctggcttcactctgctgggcagcagcattcatacctgtccacagggagtggcctgataacagaagttttccttcccatggagagggcagaggcacctgcacctgcacctgtgggccatgtcctgacaggtcccagataagaggggaaggcactctatggacacaactcagatgtgaaaccctggaagacacttgatcatgtgcccccaccaggactgatcagagtggccagggacatcacgtgctccagttggccaacatagatggggccatccctgctccctgtgctggccagggagccagacacccggcaggtggcacgtggaaggcccagaggaccaccacctctgtgtaccatgtcccccagcatttaccagactgacctgattgtgtgactggacatcagttagaaagaagtatgacacgccgggcacggttgctcatgcctgtaatccccgcactttgggaggctgaggcaggcacatcacctgaggccagaagttcgagaccagcctggccaacatggcgaaacctcagctctactaaaaatacaaaaattagctgggcgtggtggcaggcgcctgcaatcccagctactctggaggctgaggcaggagaatcacttgaacctgggagggggaggttgcagtgagctgagatcatgccattgcactccagcctgggcaacagagcgagactccatctcagaaaaaaataaaaattaaaagaaggacagtaagacaaactgttgagggatttctggggaagctagtttcaaaaggcccaaccatcttgttctcttggcatgaggaataggagaagataacggaaagccactaggagacccttccagcccctatgccgtctttgattcccaaggagagctcctttttttaaatgttaatttgtttttaggaaatggaggaagagtactgccactttaagagaggaaaatgattacaagcaaaaatggctgtaaagtcctggcgttgtgcctgacagaatttggagcccagtggtattattttctatgtttattactccatgcagtagatttgttatggataaacagatttcttcctggaagttgtaacatgactatgcagttgctctataatccttgtgcttattttttttaatcttgggaggcagagaaaagtcatatggcagatataaattagatctgaaactctacgtgtgggtattcacctattaccctccctcaaaataaaaaatgaagccacctaaagacaggatcctgggaaacacatgggcctagcatagctggattccactcggcagtgttggtgtagagtggccttaattaggctctgtgctcagatgttaatccttcctcaggaagcaaggtccagctgctcggacccttgtcgtaaatttcagggcctgaaaatccaaaagaagacacagggtagtcctcccgccggtgcccacctctgcgctgagcatgtagggttccatctcccgcctctgccctgcctcccccagggcagactgagcctctcccctccaggtgtcccagatgtttgcatcacagttcagccccggtccccatcagcacagcctgcctgggagaggccagcccagggtcagcagcgccattgcctcttgatttgggagctgatgctggaccccgcattgacgagacagagggggccatcttgtgcttctccagggctaggatgaaccatccggtcaaaacagaacagaaaccccaaagagctgttcatcggcgtctcactacatggtgaactgctactcacagggaaaagcgtggcgtttagacctgccctgtgatcacagggcctttgtgcatgctacatacacgtcagagacagaccatacccaaggatcacagagatggcacagcttcctgcccaccacactatcacagagctgttggtcccggggattgcgattcgtgtctttatttcttcattatttgtatagtcctgtgcttttccaggtttagagttattgcacgggactccccctcaagaaaagaatatcttaagtgagtctggggttgcagttggtccttaggatgtgaagcttagctgtgctttccwcggtcagcagggtctgtcatggggctgaccttcccaatccatgcctttacctgaagctggtgcccatcagcctgggtcacagggtgtcttgcatctgtttcctctttactctgttgggccttgttggtgtttcatggtaattagccaattagcctgggtttcattctccgggagaggagacctgaacctgagcaggccaccctcaggctctggttaatccgtcacctccaggcaaagtgtaaagccttctctttgccacctcttctgagtggctgcggataccaagtggtcctttatgttcttacttttagggaagtatttagctcattcacaagtctttgtatctctactttgctacctcagagatagaaatatatgtctattatttgtgaaggcatgcttaaatacgatttttgtttgctagtgtacattttgcaattaatatttttgtattcatcttatatcttgcccatttgccaactgctgttatgatttttaataatttgtaggtgatttggggttttctatgaagacagtcatataccatgtgaatgtctttatcttcctttccaatctctcggtctttcattcccttatttttgacttaatacactgggtagcagggatggaaaaaagcagttacagtgggtgtccttgtcttgagcatcctgtaactgagtgttcaaaggtatgtttctgacatctcacccttaggattagtgacattgtggggtttagggatagattatctctgtccaaggtaatggagtcctcttctattcctcgttggctaaggagttttaatcatgcttctttctcttattrattttttttctttcttctggttgagaaattggacattctacttattttcttgcagaggtttaccacatggacttaatttacttaccaacatgtgaagtgagtccttacctctcccagtagagcagtacaaggccctatgacatcgtaactcccatgtcctcaccgctactctcacgttctccagcattttgacctttcccatggtagacattgtcattagcagtcatagtcggtattgtttttatttagttttttttttttgtttacatatttatcagttcatttgctcaccaacctgtctttcacaaacctgccttctaggatcttcctgaaatacatccttttttctttttttttttgagatgaagtctttccttgtcacccaggctggagtgcagtggcgtgatctcggctcactgcaacctccgcctcccaggttcaagtgattctcctgcctcagcctcctgagtagctggtattacaggtgcgtgccaccacacccagccatttttttttttttttcggtattttagtagagatggggttttgccatgttggccaggcaggtcttgaactcctgacctcagatgatccacctgcctcggcctcccaaagtgttgggatcacaggtgtgagccactgtgcctggccctgaagtatatcatttagtaatttccctagtggacgtctattggtaataagcacttttgggtgtttttgcagaaaaatatattttgttctttccttctttttctttttcttttctctttccctttcttttctcttcctttcttttcttctctgctcttttctgttttttctttcatagggtctcactctttcacccaggctagagtacattggtgtggtcacagctcactgcagcctccatctcccaggctcaagtgagcctcccacctcagcctcccaagtagctgggactacaggtgcaagccaccatgcctggctaattttcaaattttttgtagagatgaggtctcactgtgttgcccagaccagtcttgaactcctgggctcaagtgattctgccacctcacatcccaaagtgctgagttggcagacatgatcccttgcacctggcctgtgtttcactcttgttcttgagagagagtttatctgaatctcaagtctacactgttattttctcttgaggatatcattccactatctggcgactctcactgttactcttaagaagtctgtgatcgtcttgatatttgtttaagagcaatctgtctctagagacggggtctcaccatgttgaccaggctggtcttgaactcctgacaccttaggtgacccaccagcctcagcctcccaaagtgctgggattacaggcgtgagccaccatgcccagcctgtatcagtaatactttggatctaaatctgctgtcttgtttgcagtgtgttgggtgatctctggttttgagttcagatgtagttggtctccgtccatgggaagctttcctgtagagaagataccagaagccaagggagctctgagacctggggcctcccggctcctttccttgcaggattgccaggtgctggaccctgggtttatgtttcctatcttaggaccttatctgttgtgctaccaaaggtgtttgcccctcagggtagccttcacttttgcaggtttttagcactttaggctcacaattctagtttcacctcgtgtatttgatttggggaaggagaaggagggtcctcttgagatcatgcctcactgtggactgctgtgttgtgatgcagtcagcttggaggggaagccaggccccaggaacaagggagaaatgcttaagtgttggaraggagagcgacagcacaaacttcttacacagtaaactcagcgaagtgttaaaggtgggccagaaccaatttcacagtcaggcaagggctgaaagtagaaggaagtggaagggtacagattggcagatattgctaagcagggctgtgactgatgagatgaaagtgggaagagggagagggaggaatccaggtgattttgagattttatgattagaatagcattgtaatcattaacagaaatacagaaccccaagaggagcatttgaaaatgctagcaaatctatgtgatgcatgttaaatttgatatgaggacaaagtttttgagaaacatccacaggcattttaaaatccaaaactgattagatatatgaattggagatatatgtatgagaactgtacatgtctgtaggaagtgactctctaagcttcggaaggaaaggaacccctaagaaggagggaggaggaaggaggaacattaactaaacttgaagtttgccttcactaaaggccacatgcagaggaaccagggaggagaaagagaagcagtgatcagaaagctcgaaagagaactatagttgcacagtgagaagatggcaggcacgccacgggcacccctccttgccctggggtagacattgctagctgatcgcagatccttctccaggagcctggagccagccttggagatctcaacacaggattctctgcagctgctcaaagctgccttcattgagaacacaaatgcaagatagttctcagctatcttgcatcactcccataggatctcagagttgcaagggccctcccaatcatgtgtgagacgctgaattcccaccagtctcctctgaaagggccacattcaagggcctgaaacccccagggagcagaacccacaagccccatctmtggatagttgtgagggggacagaatcttccacttgcagggtctccatcatttttttctgtcctgggttgactccagggcacccrgaacaggtgtcatccctcttccatcagacagaagttccctgtgctcagagtccccagtgagcagtccctggcattgggytctctctgtggtgcctgctggccaccaccctgagtgatagagacaggaccacctccccaccattgtgggtgacacactcacagccttcactttcactgggagcctcgttctgggcctgccgttcactgcagtccttcagccttttcatatttgtagttgggaagcaaaatcttctcccaaacctcacctgctgttggggtccaagagaaggaattctartcatgcatttgaccatttgagttgtcagttcagctaagagatcctcctctttttagaccttggggatggggataaaaccctagtttatctgctatcccccaaaactctttgctttcacaatttggtaagcagactttatatgtctttatccaagtcattgataaaacattgaatattgaatgaggcaagacagaggtaatagttccatggttgaccactgcagaccttctgctagtttatgctgcttagtaccccttagctgtgaatccatataactctattcacatctctttcattcaccctgataaaagccttgctcacatctgggtgagtcttcagggtgatcaagcatctcagaagactaagggggaaaataytgcaagatggtggtgcccatcagcaacgtcaggtgctccagaaagaggggggtcagtgagamagaagactaagcacagcccatggcccctggctgttccttgatctgtaatcttacagagtgaggtttcaatcaggtggatgatggggaagcattattagaaaagagagggtggtaaagagctggatgcacgcgtgcacgtgtctgctttgcagattgtgtgagtgaaggatgaagaaaagaggtgatgatctctctcaaggatggagtgagatcaggaagtgagtgcaggaggtctgtagaagggggacatgaagtttgcaagagagtgaggaaaccatgccaaatccaggtccgcaagaaggtatgaggggaccaggtaaaggatgcagagagacgggaggaaaggaccaggagctgaaaggagagacagaaatgttgagtgacatagaagatactagacaagggaactttcttctgtccagtatacggagaagacaggtggtgggatagatttttaaagtgagtgatcggccaggtgcagtgacttatgcctgtaatcccagcatttggggaggccaasgtgggcggatcacctgaggtcrggagttcaagaccagcctggccaacatggtgaaaccctgtctccactaaaaatacaaaattagccggatatggtggcacatacctgtaatcccatcttctcgggaggctgaggcaggagaatcgcttgaacttgggaggcggaggttgcagtgagctgagatcatgccattgcactccagcctggacgacaggagcgaaactctgtctcaaaaaataaataaatagagtgagtgatgaagccatagaacagccactgtagggagcacatttagaaattagctcgaaatgggttctgatgttcctgtgaacacttacatgtatttgttcccctaagtagagtttgcatgcataggtaaaatttgtttacataattaatcgggcagagccaaactgcgctttagcaatttaatttgcaagttttgtctttgcatgagatactgagagtattacagtgcaagataccagatagcagctactgcgttgggatgaggcaaaaaatagagacgttcccttggagcttcattcagatttccattgtttttatcactttgtgttcagtcatctgcctgagtgtgtgcccgtcctcaccacgtagacacgtttagagggcacaggcttctcctgcatgctggaatcccttccacccagcccagtgcctagcacgttggggagggcagctgaggaccacagtgaccgagccctgcacccatacagtgtaatacaagctcagctcttagccttagttccagtgactgtagctcatgactggctagagccagacatttgagcaggaaagctttacaggggaccagttgtgcagaaatttaaccgggaagctaatggttgtaatttttttcactagaagatccaataaatgctgatcagagggagctttgatacatgcatttgaatttcacagattaaacaaagtgtgagcctgtcgagttgatctcataatgaaaaattgtcacatcccacctatgaattaccaagttttccttatgatctaactgtgagttatgtagttttttcataccttacctatctgttcactaggagagttttgcataaaatacatgaattggggcactatcctatgagaatctgtatggaaaaggttgtaaatcatagtactaggacttaaaagcccatggatcaagaagctggaccaagacccacagatgcaatggctcagccagtacttgcacgatatcattgtaagtcagccatggtgaaacctatgtgaaagttacagttacaatgattttttttttttttaatgaaatctccaagtccctgagtgtttaaggtcgttgttgaaggcatgacctgcagacaccctgacccccaccttcctcccccacccctctttccacagcaggtggagtgtttcattctgcataaatacacaggtggcgggggtggggtggtcatttgttctccaaattcaagagcccagtagattgggataaaattcctgagcaaccagaccctcccatcctgacctcttgtcaccagctctccagaaatcgggaaccagggtgactgagagcacaaaggacacccccataccgtgtgggccagctgagggcttcctccaaagactcttctctcccctcccactccagcccgtatcggtccctttcaaggacagggtgggtctcagtgccgacaccccaagcggrgctaaccagccagggcctcaggcccgacctccactcagcacgtgcatcacagcactttcctgcagcccccagaatatgcccagggcacagtggctgtcagcacctagggagtcacagaccactgaggggctggtggaggccatgggccctctctggctgggtgctgtccccacacccctgggagtggggcttgggagcatcactgggctgctcaggtggaagggatctctcagccacaaagagggctgcatatccacccagccagaaaggagtggggaaagggtgagtggggtggcacgtcctcaygtcccaggctgcaggcgcattgtgaggaagggcctgggagagccagtctaggtgaggtcagtaagccgtgcttggaagctgggctagagggaccaagagtctggaagatcagaggtccgtgcagtagacatgagccagcccaatggccacgggctggtgacagagataagtaaagtggttggcaggcaggtaggtgaaagtcagtactaataatagttgctcgccaggggattataatgcagctagttcacaggccagggcccggaaacattgagtcaaatgagatgttgtgtctgaaaacctagttgaagatttcttaatgagggtctggtgcagtggctcacacttgtcactcagcactttgggaggccaaggagtgaggatcacttgagatcaggagtttgagaccagcctagggagacaccatctctacaaaaaatgtctaacaattggccaggtgtgatggtacacacctgtagtccgagctactcaggaggcgaaggcaggctcgcttgagcctgggaggtggaagatataatgagctgtgattgcaccatggcactccagcttggacaacaaagtgggactccatctcaaaaacagttcttcgtggttgtatgcaattagttatgctttttgccagtggtgcctcctcctttggcggggacttgggggccgggagtagggacaggaataatgaacagaggccgacgtggatctgtggagtgtctcctatggaccaggtcccaagtccgcatgggtctgtacacttcatggaactagcagaaaagcattagacagtcggtgcccttttccttcattttatgggttagaaaaaatgaacctcaggggagtccaggaacttgcccaaagacttagatgtggcaggtggggtcgcagggtatacccccaagttcctctcttcccattgcagacatggccccagagtagctaccaagtctggggcctgtctcagctgagatcctcctaaggcacgcgggatcccatgcactctccctgtctgaaaacgtgggaattgatgcctctsccacggtaacaggtcctctgccataaaagaacagaaccttcccgcgttcctctatccatggagtgtctgtggatctacgcragtgcttagatagaaattaaccctgcagccggagattagcggccctaacttaattttcrtcccacagataaggatggtcagccatgagttacatggttattctcctaagttgctttgtgtgtgcaccacacagagacgctgacatcactcgttgatttcatctggccttgtgccctgagccttgattgaaacctggctaagtcatgctggccttaggaaccacatctggactgttgggaggtgcatggattcaaatctccgccgccgtggttgtccagtgccgtgcgcctcaccggtccatgcaggggcagctgaacccagaggcgcttctgtgacagagggcccgcagggggactgctgtctcataaaagctaaactcttcatcccacactctgtgtttcagaacaagaagaaaattttgagtttatcattgtgtccctcactggccaaacatggcactttgaagccacgacgtatgaggagcgggacgcctgggtccaagccatcgagagccagatcctggccagcctgcagtcgtgcgagagcagcaagaacaaggtgaggcccctggctgcccaaaaccaaggctggggctgctcagggggagtgcgggccccaagtaatgccccagggaggagaaaatagaggaccagtgtgaatgacaggacctagctattctttatgagcagaaagctcaataactaaaacgatcagaagcactttgtgtctataccatcatacatgagtattccagcctgaccrtgcttccctggcaggagagccaaggttaaatcttcagtctgtcagccaatcccagagggaatcttttggactcttgtggcttctgggtccacatttatttttgttttggacagaatacactcagaaaaaaagagagacggacttaaaagatgcactgttcaagtaaatgcccagaattcaaatcgacatcaagttggaaaaccgtctcttgttagggacataaatgaaaagtagatgggtctgtatgagcgtgcagggagtttgggaagataaagtttctattatctaaactgataaagcctggtatgtgttttattcaataattagaggtggtggtgcagctcttttagaatttgtccagcaggttttctggttctcaccagaaaacgccacccccaaatgtttctatattaaaaaaataatgagaggcaatttgttttttgtagttacttagctagaaaaggaaaaatattttaacctgtatttttttttcctttggagagagtctatctctgtcacctaggctggagtacagtggcacaatcttagctcactgcaacctccaagctcaagcaatcctcccacctcagcctcctgagttgctgggactacaggcctggcttgcttgcttatttatttgtatatttatttatgtaatatatattatttgtggaggtggggtttcatcacgttgcccaggctggtctcaaactcttgggctcaagcgatccacctgcctcagacacccagagtcctgggattacaggcatgagctaccacgcctggcttaacctgtgttctctaggctactgcccagtgatgttccttctacaaaagtcctttttcccatcaaggattgcttcagtttcattattttaatgtttgtttgtctttaacctctttgctgggacgtcttagacttttggagagcattttgatatttcagactatgatcaactagaaactaagagaaaggatgttacccaccracctgcagtttcatttgtaaccatttaaagaaatttctgcctatgatttatgtgcagctttgtcactaaaaagagagtctgtctttcagaaagatgaagtgtcttattttattaccctctttaaccagggtaaaccagaccacagtcattattattataatgtaatttgcttccctttttaaaagatgttttatactcaaggtggggagaaccactgcctttcattccatacaccctggctttactgggtcacgtccacatgcatccatgatgtgcctcctgaaacgagcacagggtgctttggggccacctcaatgggaagcaacagcacacagcatcctccaagcgtgggcagctcattctgagaaggaaggcagggaggcaggctgtgttaccgaacagagaggcacaggttcctgccttcatggagaaatcacagtctttcacggcagactctgagcccctgccacctcgacctaattcaggaagatctgggatggtggcagcctttcccattccacaccttgccaggctcctcctgactcgtgtctcagctcatgcacacaccagccttagaatgctgccctcggccctcactaggcgcctgttctccagggaattgctcccttgggaggaggacgcgttgagcaaccaaaggtggccgactcagagctggtcatcgtgggcattggttgaacaggtgtgagggcataaaacatggaaatrctgtccacaaggagtagcgggaggcaaaaatacaggcccagttgaccaccagctttatagtattttacctgccagtggataattgagagctgatacaggtataggcatagctagacagacagacaaaccaaccaaccacagaaatgatacaggtacacagagagacagaggcacatccctttgtatgtgtgtgtgtgtgtgtgtgtgtgtgtgtgatcacacacttgcattccagatgccagtgtaaactgtttaaacatattttgaatacttgggtatctaaccaaagggaattaaaattcaataacgcatgatgctaattagacagtagtgattaatacattataatttattatgtagcaagtaatatattatttcacatcaatttgatgagatgtttcaatttatgaagaattcttacgcaaaaatcaagcttattgtaactgtcctctgaaattgatcaattkttgctttaaccataatattaaatgcatacttaataaataagcctcaaaaacactacatatcagccagacacgatggttcacgcctgtactcctagtgctttgggaggctaaggtgggaggatcacttgaggcaaggagttygagaccagcctggccaacatagggagaccattgtctctacaaaaaaatttttaaatagccaggtgcatggttcacacctgtagttccagctactcaggaggctgaggtgggaggaccacttgagcccaggagatggaggctgcagtgagctatgattgcactactccagcctgggcaacagagcaagaccctctctctaggtggggaaaaaggtacatatccagtacatatcctttcacttagaacttctacttccaggaatctattcttagtaaataatcatgagtgtgtaccaagacttagcaatcatatgttcttacagcatcgtttatgatagagaaaaattggaagcaacttaaatgtccatcaaagagaacttgataagtaggtcttcactaagtggaatgctatgcagccatttaaaatgatgatgtcagagagtatgtgacagcagtgagcaatgaacaagtttcgttaggctggaaagggcaggtttctatgcagcaatatgtattacgctggctttttaaagtacatatgtgtatgtagatgtgcttaaacaacaggctaaaagaacagacatcaaaatgttaataatgcttaactatggatggccgtatgattgtttattaattttatgttctttttcccctctctgtattttctaaacttgcttcaatgagcatgtatgtttttaaatcctttttaaagaagaccatagagccaggtgtggtggctcacacctgtaatctcaacactataggaggctaaggcaggaggatcacttgagcccacgagttcaaggctgcagtgagctatgatcacaccactgcaccccagcctcagccacagagcgagacactggctcaaaaaataataataataaataaataaataaaaataaagcaagccatcaagtgtaaggttaagaatcagcactcccagctatactcgtgtttctccctgcccccaccctggcgagtggctttgtcactgtggcaaccgagggtcttcagatgacatgtgcatctcccagggtgacgtgtggtatgaatggggttttctgacaaggaaccatgagatatgtcttacattgctgatgaagccctaaccctgggcttataaacggattatttctttctcattcttcttaccaagtagacatgtggctactgcccagaaggttacccatttaccttctccaggttaccatggtccatgcgtattcacagrtgatccagaactctcctctttgctcatttctggcagagtccgtctcagctgatgagttaaaatgtgacatttcctccctccccccgccccatgcatgatgatttcttcttcagttatgctctttcccaaagacatcaaaacaagagtgattgtttagaaattaccctcgtcctacatttgctcccaatctgtttgatctttccctgatgttatcagtgatgtgcgtttctcccggggtgcttacgccttgtatttgtgtcttcctccgtgcccagtcccggctgacgagccagagcgaggccatggccctgcagtcgatccggaacatgcgcgggaactcccactgtgtggactgcgagacccagagtaagtgtgtgcggtggtagcaggggctggcgctgtgtagctggagaccacatggtcccactaggcccgggttgcaggggacycacatctgtcctgtttggcagataagagttaactgcttttaggaaattgagatattttgtttggattttaccttaacagagtgccttccacacaagcctcacccctggctgcagggtgcgtttctgtgagtctttccttgccttaggcatccgatgagcagcagtcatacctgaggtgcaaaggattcaaccccacacccacagcctgtgccaaatctaggaagcccaggaattcaagacgagcctgggcaacacagggagaacccgtctctacagaaaattaaaaattaactaggcgtggcagctggcttactttttgcttaatcagtgatcacttgttgattttttttttttttcataaaaatagaatataattggttcattcctgcctagagattcttgggtattgtttttttaaattcacaatcatatgttctgggttttgccatcaaatgatgtcttgtttttttttggtcttaaatccattacccactaaagcctctgattgaactgatagaagttgtaattactgctttgtgccatcgagtaccccagttttatttcatgatttccgttgtctaatccatactattactttccctttgaaaaagtcattttgttgttcataatcttgagagtagggacttattttcatggttgcagtcccagcccagagacagtattggagacattcagtaaatttcttcccttcagattttttttgttaagtagtgttttgaagagaaggaagttcagttcaaacaaggtaagaggtgctggtaccaggctgggtgctgcccaggagtcaaacgtgcatggcgtggtgggtcctgccatcctgaagcctgaaatgcactggacaaggcaccaacctgctgaccatggagctaagcgctggggagagccatcgggggcatgcggcggtcttgccacccatgcaggagctgtcgtgtcagcagggctctggagatgggcagggtttgtacagggaaggggccgaaggaatcactgtgagcaaagggagtggcttgaggagagcttctctgggtggttgtaggattagagrtgctttttgggctggaaaaccagtagaagctagttggagtgtgagtgccaagtgaaactttttccagctttgttcttcatttgtaagcagagrgacatcattggagttttagagcaggaaggagatggaccctgagctccacttggggagatggatctggccagaccattttgaacatactggaatagaggcaaagcagggaggaggccagccagggtcggcttggccgggaagggagacaggagcccaggactgytccagacaaaagggaaaggaagcgccccctccaagagtccactcagcagcatagcaggcaggggagagatcaaaagtctgtctgcggcctctctggaagcctgtcctgcgggtgagggaaggggttcttctccaggtatcttgaggttcttctttaaagtacctccttatgtttgaatgtttaagttttactttcaaatgtgtggtgaaatgaagttcgaagagagaagcagttatttgaagtgtgtttctatcaaaaagttttaaaagtaagagcttttttaaaagcacgaatctgagaaatattagaacatccattaaggaaaatgcctgcagttgtttccaccgtgcgtctgaaggtcgctttaaaaggaaagccatccgtggcttgcggggaccatgatacctggcaaatcrgaggtcgcaggtcctgtctgagatgagcttgtgcatgtgagtgcggatggggggtgggaaagggaggccagtgcaggggaggtgtgggccagtttgttctgagcaagaccacctgagcagatggacagggacaaagggaaaaggcagagtttgacaattcaggagaaagaggcgataccaagcacgcatttgctaaatgtgtggtctgtgtcagcccggtgccaaaccctcmcatgcgctgtcttttcattctgcaaccctagtagttggtgcccctgtgggccccacttaaaggggaggaattgaggagcctgaagggtcaagtcatttgtctgaggtcacagaaatagcaagtcccaaagcaggattcaaacccatctgttgtccagcctgctgtattttctcaagaatggaaaggctcagaagatgtagcacattggcaaggatttgttaagtaaaaatacccaattttggttaaagtaccgggataggtacagtgcccacactgatgatgaactgtaaacacctccatggggcctttcgacaatgtatataaaaagcttttgaagagtggatgcccttgactccagctgtatactccaggaactaaaccaatgggattgagtaaggcgggtgcagagatctgtctttccagatgttcatcacagtgctttatatggcaaaaaatcagaagcatcccaaatgtctaacaattgaagagcagttcatggtgatgtcttgtctttgctacctttaaaaatcatggaaaaagacttaattgagcctgggcacggtggctcacgcctgtaatcccagcactttgggaggccaaggtgggcggatcacctgaggtcaggagttcgagaccagcctggccagcgtggtgaaaccccatctctactaaaaatacaaaaattagccgggcatggtggcatatgcctgtaatcccggctacttgggaggctgaggcaggacttgaactcgagaggcggagtttgcagtgagccaagatcacgtcattgcactccatcctgggcgacagagtgagatttcgtctcaagggaaaaaaaaaaagtggggggggtgcttaattgagataaagaaacttcataatgtgttgtaaaatgaaaaaggggtatgacaatgagtctagatgaacctaacgagtatttacaggtatttagaggggaaagatctgtaaggctgcactctggaaggttagcaccagttgtgtctgagtggtagggtcttttgaggcttggggattttcatgcagcgtggaatttgraattgtggtaacagctccctgacccccagttcttgcagagaatgctctagaccgccaggagccccctctgtctgctcactgggcacatcccagagcactgtttccagagtggacgctgagcctctggagctttgggggtgcctgtctataaagggattctgagagccagtgaatytgggaaactcttaacaacgtccgactcccaggaagttgcagccttcrgacacctgtgcttccggggagtactgctctgaagctacctgttcagcatggcccaacccagcatgtcccaggcccatcggacagtggggcctttgtttagggtgcctgttgcctgccttctgccaggaacatgccaaggaaagtccacacctgagggcccctgagaatcctagggcttgggaccctcagtggctctcaccagcaggtctgaccttcatggacaggccctgagaggcagctcaccgtttctgctgctttctctctgcccatccatgtcgcccatgaagccctggttggagctgaccgtgcgctggtccctcccaccctgctgcgtggacctcacaggtgcccctctctcctgggcctttctcatgtctagaatcctgccttatttccctttgtgaaccccaggcctgcacacaagaggggactggcacccaccactaccaccagatagctcaccacaacctacagtaggagcacatccaggctctcatctttagcttggcccacaaatagaacctccggtcccgcaacgtcgggtctccttcccattgtcgcctcttagtccttccctgacctccaggtttgaaatcacacacacacacacacacacatccctactccctgctgttctgccctgggggcttcctggctctggtgtatcctagaattttcttagctcttttctggtttgggcgggggcaggggcgggttgagatggggtctcgccctatagcccaggatggagtgcagcagaaagggtaggctgcctctcggggcctgtccatgattgcagcagtgcaatcatggctcactgcagccttgaactcttaggctccagcaatcctcccacctcagactcctgagcagctgtgactacatgtgcgtgccaccacgccgacctgattttttaaattttttgtagagaggtagtctcactatgctgcccaggctggtcttaaactcctggccttcggcgatcctcccccattgacctcccaaagtgctgggattataggcaggagccactgtgctgggcctagttttttttattttttcctgcttggtctgtcctcatagaatctacgtcctgcatttctgtgggcagggatttttctccgttttgttcactgctgtatccccagaagccagtgtgttaatattggttgaatacgtgaaggaacagatgtaattacagccaacacctaacactgtacttcccgtggggcagtcactgctctaagtgcctcgtagcttttaatccttctgacagccccttgaggatgggaattattagcctcatttctctggaggggagctgaggcccggagagcaagaggcttgcagaggacaaaggtggaaaggcagtgctagcaggtggcacgcacacaggtgtgagggcctggagagcaggcagggccrccctggggctgtgggaccagcggggcctgaagccaggtggaggggcaggagacagtgcagaggtctgagtccgtgccaggaggctgggatcagccacaggccgaggttctccacccaggccgagacacagcgaagtgtcccagttgggccttaaggcatctttcaaggaaattgcagtggtgatgcttagataccaacccttgccgatgagtcattctctgctggagcrgaggcaaggttctcccctcagtcagccccagccttacctgtctctaagcagagggtggtgagcwtggggccctggaacactgtgcccccrccccctgcaacattttgggtttcagagaattcggagtccggcacaggaatgtgtcccacgcatgaatgtcgtccttcagatctggacctgacagcctgggagctgctggggggaggtaggagggggtgcaccacggtctgaacgaggggccagcatgagtggcttctgtatctgcaacccacagcggcatggagggcggtggggtgggcataggaaccaaatcggaggttctggtaagagcttaggcaagtggctatggggatccagatgtgagtggagacagtgtgtcagagcactccccacagcactcggtgatgggctggatgctgggacataagggagcaggagaggtgctaggttttgagcggtggtgtgacatgatcagagatgccgtgttcagtggggccctggctgctgtgtgaagaggtctgcagggaagtgacgggcaaggccgcagacaggagccccttgcaccccagttgcgatgctggtgaggacgcccatgggagcataagttcgagaagaaagcgttggacttatgagaggttgagaaccttgtgattggctgtgggaatgatggaagaattaaggtggacccctggggtcccagcttgaatagctgggacaggagggacctggcagaagaatgcatttgcagagtggatgttgactaggagattctcccaactgaaatgtacgtggtcgttgcgtatataataattcaggagccaggaagaggtgttagtgcctgagtggtgattgaagtgtgggttgggttggcctgaataagactacacagtcagaagagatgaccccacaggagccctgaggtcagggaggaagagctgggaaagagatcacaacggagcaaccaggaaagtggggaaaaaatccagagaggtcgttgaccaaaaaggtatcagaagttagcactggcccagcacagtggctcatgcctgtaatcccaacactttgggaggcccaggcaggaggattgcttgagcccagtggttgaagcctgggcaacatagcaagaccccatctgtgcaaaaaatgtaagaagttagccaggcatggtgatgtgcacctgtagtcccagctactcgagaagctgaggcaggaggatcactggagcctaggagtttgaggctgcagtgagcagtgattgtgccaccacaagagaccctatctcaaaaaaagagtagtactcagtgttgtgaggaggggtggggcagtggccagcccacaagaggccgagtgaaacgttggccacaggggtcttttgggtttcgccctggaacaggctagtgactttggttgtgctgcgtccatggtcaggaggtagaggcctggttgtcagtgatccggaggtgcagaagcagagggagccagtggggaggtgggctgtgcagacacaaagggagaggcacaggcgaggaggggtccacgccagctgtgtgccatgcctccaccctccacagccccaggccagggcctcctctgtgtccccgctgccctcttccttctcrtgccacctgtgcattggttctgactgcgcttttcagcgttgagtctctgcatttctctgttctcttctgcttgggtttttttcatttgatgcataggtttccccttcccagtcagaacctctctgaggtcacagacctctcttctcacatttcttttttttttttttttttttttgaggagtctcgttctgtcacccaggctggagtgcagtggcaggatctccactcactgcaacctctgcctcctgagttcaagcgattctccagcctcagcctctcaaggagctgggattacaggtgccctccaccatacccaactaatttttttgtaatkttagtagagacagggtttcaccatgttggtcatgctggtctcgaactcctgacctcaggtgatcctcccatctcggcctcccaaagtgctgggattacaggcatgagccaccaccgcacccagcctcttctcacatttcttgkggtatctatcactgccttcttgcatatgtagtagatgttaaataaaggactggctttctgatttctgatcaactggcgtaaggctattgctggttacttgccatttataaaacaaaggatgtctccccagtgagtcaaatgtgacctaagctacttggtcttttgttgactcttcaggtgtgyccagagtaagcattgcctattcccaggtgagtaagccgtatttacttaacagtggtgaaagccagtgactatcaaggtcaaccctatctctgcacatcagctgtagattctagcgtgaagtcaacccgggcctgagttcttggtcttctgatgatgccagccagtttcacgcagtgagtgctccagttctggggtcccagtgctgctgtctraatccatttcttgtcctgcacaatccttgcactagtcsttggtctagtttcacagcccaaagcctgtcaccattcattctgcaagtcagcgttggttgcgctgcgtgataacctcaccaaagggccctgcccaccaacttgcctgcagtgcagttgcttcagtagctatagttaaataagatcactgaaaacgatatttcttcactgtagtgtacctctctctcatctttgaaatttgcaagcatgcccgttgtgtacctactggaaactttgatgtgccagtggctgcagaggtagcaatgaaggaatgaccagagtcacggtgtcacccagctgcccctcagcaccacttctccttccctctcagcagcagctgtccacagtggatgccgagtcacacgtgctttttcccacacaggtcagccctctcaaggtgaatgctgctgtgacatatgggaaagtgcatcttttctatccaaaccaaygctgtcaattatttattgtgcgggaaattccaaggctttggcttcagccaaatgtgttctgaagctactaccaacggccagtcatttgggacacctgaaacaggactgagcactggctagggagcattttttctcrccatggatgtggttctgtcgttgtgaagtttgactgattcrtcgccttgtgtttctaagaacggttggaatgatgcatgatggtctgattgcrtttagcgttctgttcctcttcccgtagatcccaactgggccagtttgaacttgggagccctcatgtgcatcgaatgctcagggatccaccggaatcttggcacccacctttcccgagtccgatctctggacctggatgactggccartcgagctcatcaaggtgatgtcatccatcgggaacgagctagccaacagcgtctgggaagagagcagccaggggcggacgaaaccatcggtagactccacaaggtaggaactttggaagatgcctggctcccgacacgtttgccaacagttaggcaactggaagtgatcataatgacagccacrgttgggaaggccctgataacctgtaggaattcgggaattccgattcatccggcataggaatgtctgtgtttaaagtyggtcttgagcagacgtggataattcacactccttaattttttatgtttgtttttaggcctggggatttctctyccccctcttagaaatgtattaagcttctaaccttatgaatatattactttaattaatacatttctaataggcataagctgtgccgttaacactaattatgaatttttgatcctttaattttgttattcttatagcttggataagcatctgctctgtcgatcccccccccgcaccatcacacaaaagttatttttatggtaacaaaatctattttattttctaaaatatatctcaacacatttagtcaaccaagttcagcataatgtatgatgtaactcctcattaatgttaattgttatccagtgtaaaaaacgcatttattttgaggccatttagtttctcatttttcatttacagctattataaacygtttttgagtacacatgcatatttaatgttcctaaggggtgataaaatggagtgtcttctgagaaggcgtatggcatggaggcagaatagagcatttcatctccgtacttgtctaaagcaagtggcttccagggttgctcattttcacccacaataggaagtrggaggttgaggtttgctgtccgtgtttgcctctcaggtgtctgaagagatgaagggagaggagaggtctcccatcactggtactttttaggttcctctgatttgttttgctgctgatcagataaaatgaaagttcaagtggtaatctgtggttacgccacagaaaccggtttctactgcagagcagtaagaacgtgagaagcgttcgtggacttcagttcattaacactgaaaaatgaatttgtggtgccacctttggctcactggagagaatgaagctggtgtgttactcatctggctctccgtatgagggattctttggtagtggggaggacaggaaaggtgcaaagaacatatttgtttaaaattgcatggttttgatacgcgacctctttatgagttatgctctatagtgtagacaggggtaagtttcttacaaaccgaagaaattatgcactttaaaaagtatttatcttgatttgtttaatgctaccatagaaatcagctgggtcatcaactgtgaacaagcttaaaagatgaattcatgttttaatatctattttttcacagataatgataacattggaggaaacttgggtctgaaaatgaaaaatgattggaaattagattgagcttaatatatgaatgcagaaaacattgaaataagctggaaaaatctatgcatcttactgtttatatgtaaaagaagcacattcactatttttaatatcatgaattattagaaaagtttgtttatccatccattaaaatttagaaaccatttggaattattygaagcaaagatacgggttcatgttttacctgataaatgttttataatttcatcttcattcataaatgaagattgtgtgtgcacaggtattttgtagttctaatttgcatccttgaattaagttcttgagtgcagagccctgtcttttttccagtgttacatacatcacatcattatattttagagacctattgcagagacttgcttactcccaagtgcagtggttgcagttaagtcccatcttttctttagtcacactggctttcctaaagagcaggccgagttgtaattcctctccaagactgtggtgttggtgatgtggttctgtgctgttgctgaaggtaactgtggaatttctaagttccctttgcacctaagaagataaacacatacgagaactgaatatttctttgtgcctgtagtaattttcctggggagttttgttttcagtgaaaatcagcaaataatcattgcacactttctcgtagaaaagcaacggtgagtgatgattgcagttccctggtgattggtgaaggctctcagggctgcctgaggatgccagggctcgggagggtgcattctgggaggtgtcactggagaaatggcatctgagctggactctgaaatagggggtgattcccagggccagggccaggggaccaggtgggaaggcgggctggagggtgggagtggcctcggtggatgcaggctcggccsggcctgtggggaggtgtgcctgtcggcgagtacagcaccgtggacgggagcctcccatgaatgaggaggagcaggaatgggggaggcccaaagagcagaagcaggaagggcctctgagccagggctggcaccttaaaagcgaccctgggggcaggggagaggggaagggtttgtctattcatgggttctgtctgtcccacctgttcccaagaggactaaaggcagccagcaaggtctgtgtcccttcccgctggaaggccagggtcctggtggagcatgcgggaagccttaactacactgtccaaagcaaaacacacccagcccgataacagagtagaaattcagactcccaccaccttcaccacctcctgcacrtcccctcaatagaaaatggaaaagtgaaagtcggggctggaatctccgcaagccggtctgtccatgacgtgagaagattctgcctttygaagccacccccgctccctctgccccactccgcccctcctggtctctctgcagaacctacgattgttagtagaaacagctggaaggttcttttaatgtggccctgaggtaataccaaaaagaaatattttaataaatttttctctctatcaaaggaaaagccaagtgcaatatatttggtgtaattctttgaaaaagggcccagctgttttcccaaggagctctggtccattccatcttgtgcagaagattcattctgacagtggaatataattagaaatgcgtcgttcagcctgcccccacccccaaacacacaaacacacayagattcaagaccatggggaagtagaacacagcagatcttcctccaaagagaccgccgcacactggagtcacctattcgtgcggccagttaggacagcaggcgccctggacagccggcctctgctgtgtccctgcacccctgattagggcagcttcggacggcttataattggttccagttaatctctgccgccctgagaactgccgttcaaacttgagcagcatcatgatcaatggaagctgacggcggctgaagcagtattgacttcccattcctaaacaggggaatcattagtcaagaaaagcatcttttaattactcccaggaagaaaaaaaaaatctttttggatggattctgcaacaactgccattttttcccagtgcattcgatattaaatttattgtcgcaggaggggagaggatgccctttgtccccctctgtaatgggggtttaatttggaaaaagaagcacgttagaaaacagagcaatgctacaacaattaactacatctggggtagcatcagaattcccctctctaattgctattgataccatttaagcacacacttaaaatatcgattttaagtggggatgttgaagtggtggtgaagtagtaacagtggacagaactaactaggttttaggggtttaagaagggagccgtcagctgtgtgtaggacaggacttcgtaacacccggcttgtgcgtgtgtgcrgtaccataacgtagcrtgttgtagggcgtcgagcagctgggccgggggccrccagccaggcggggctctgggttccagtgttagaggtacatggtgttactgtaaggagaagttgccaagctccttggtgaccctttcaaaggcaagagtaataagctcagaggtgaagatgttaaaacagtcgtgcgaacgtctcctgcatgaatgaatgattgaacgagtaaatgagtgaaagcgggaactcgtcatcatggaacacatgtcaggtgctcttgctacttcggggccttggaattcctcatgtgagtgaaaccggggctttgacgtttgcagcaccagcaaagccgtctcagtaaacccktccacgcacatcctctctccctcgcggtacagcagtgtttccggggctgcacggcagcgccctggcccgttgttctttattgttgtccccattgcacttaaaaacatttgggattggctgcagtgcaagtgatttcctagcaggacggagcagagccctctggcgccacattcctcttggcwgaagcctcgctctgcgtggcactgcatctccccatctttgtgtcctggtgtcaaagcatttggcccccaaggccctgcagggactcgctgctatttgcatttcagtgcaggtagcctgtttacttggcggcttaggagcctgctgatttgggccaggaaatcaaaggaacctggaagtggagaatagtgttttcaattccgtgaaagagctcttgagaggcgctttaagcgcaactgaaatcacccattacctctttgatgccacttggaagggaaccgagtttgctgatttagtacgtattcttttcccttttttagcatcctttttctttttcttccccccattatttgtaagttcacctctgtgcctaaactcccttcttgtctttaacctataaaaagatgtcgccttcgataggaagatttggggccagacatcagaaatccacgtgggagagactggccgtacacttccagatggaacaagtctgcccagtgatgtgagttccatctctttttgattctggaactccactttcatcttatttatgcacatggagatattgataaaggggaaatgtatccaaactgaaaataattggatccctacagctaactctgagatattaaaagcagtaccacttggctgtgtctttgtcttgttaggtttgatcataagatcacaatgtagtaatctcgggctcaaatttctggcataaagatgcactgttccaaatgtggcctcagggaacacgactgcccacacagccccaggattgtctcatcttattatttttcaacagttcttggcctgctgaggtcaatgttttgtctcttttgagtgttcctctatgcttgacaccttttcctattttctttcttaaaaaaaaaaaaaaaaaaagggagggggagaaaggagaaaaaaaataaaaaaaggactttgccgcgatgaccagagtccatctgcagttgggtggcatctgctccccacatgtcactttcctcattaacaagcaattgaattaattaaatgctactcagaacacgcataacaagctaccggcagtgtccaaattagcactgataatcaaggatgatttcctttattatcctgctaagtggtgtgcagactctgatctccctgtctgccctcatctatttacatacccccagctcctgcctttggaagcggaggttatcttacctagttaatttgccacgatcaccgagcatggcggattgatgccctgcccctgccgccactgccgggcccgggccccctccccggctgccctcccccagccccagcctttgtatctcaagctcactgataaattaaaggccacccctgtggtctctcaagtgagtaatagaggcagaaatttcattttgcaactggctgatttaatgatccaaagggtaattaatggcctgattatcttaatgttaaatatgtccggcagcaattactgtgacctcccgcttgtcaaggtccgggctgtgctcttctttcaattaagttctctggggcttaatggtatgaataaactcctctgattctatcatcccggatgcagagggttcagggagctgggggctcgtttggagttttaatcagcctgtcttctactccggcgatcagagttaacaattatagcaaggacagtttaactttcttcttcgccgtgcagacccccctacatgtacacacatgcacacttttgtgtgtggctttatgtgccttgttttcatgtgtttctttcagtgctctcagggagaattctgtttgtggaggaagctgctgtgctctgtgagcctcgtctcttccaatataaattatcatgtgaacgctgtggtttttctatttgacaggcttaattaattggcaggagcccccgaaaatgacagtaccactaattgcaactcaaagtgaatttctgtcaccgcggcgtgcttgtcagtgggcctgccctggccccagccgcagagcgggtccaccctcccagtttccccgtccaggcagggactgtgccctgctcaagccacgacagtggcagccttctccgaggagccgtgggtttgcaggcacaccgtctgctggcaggagtgacatttactaccaataaagtttatacatcctcggctatgcaaacgcaacagctgctcagggacctcagcccttacttaagatattttagcaacttctcttagcaagccaacttggaatcagactgagagaaccataactcacttagccacccttcatgactggatggtcctcattagcacactgctaaatatgcttcagyttactagagctcagggcccggatcagaaatattctgctataaatattaagccaattaggaaaatgtacaaatgagaagtacgttaacactgcctttaaaataatacctacagattacagttgacaacagatagagcaatgcatctagtgaacctccaccagggagcttggtgggaatccaggcaagctctccataaagactggctctaattataagaaaggtgattctaagaagattctccatgaggttaagtataatgggatctgctttttcaaggataactatacttgcatttgcctttgaaccagacagacagaatggtgctctcggtttatcatgccgcctgccacacaggaaccccagttatttgtttgatcctgcaagaaaccagtgtgtgcttggagccggctttgctaccgcagagctgtctagggttgaaaatccttatcatttacgttctgaaatacggccgtcgtgacaattaaggagtttctgatgcttaagaatttttactgcccctggcagatgagaaggcaagtcatcagcaggcagcaactggcttccaggtgccctgaccacgttcaagcctgtgtctacttgtgggagtgtatgaaggaatggaatgggaagattaacctttttaggcttgaattatataacatgggccaataaatatggcctctattttgattcctccagcagtcaagcattttccaaagggccctgtctttcagtcgtgttttgcttattttgcaccagagactctctgtcttctagtgaacttttctctttcttcttcttaatgaagaggagggagacaaaaacatggccggagcacacagcgccctgtgtgcttggattatccccattcccagacgtgtgccagggtcacatgggagcgcaggtcagactgcaggcaccaagatctgactccagatgccgctctgcagtcctgctgctgctcctgttccttttctgccaaatccacgtcagtagcggcattgggagaaccgccatgtttagcagcaccactcccactcgcccctggtcagtttctatctcagtagccatcgtgtgtcaaacttactaaatgagtagtgcaaacatattatgtaactacagtgtctttccacttcacagcagcttcacttatagtaatataagtaatcataaagcctcttccattttagtttacattcatttagctgacctgacttttttggtggcgtctctctctgtcgcccaggctagagtgcagtggtgcaatctcggctcactgcaacctctgtctcctaggttcaagtgattctcctacctcaacctcccaggtatctgggattacaggcacgtgccaacacacccaattaatttttgtatttttagtagagacagggtttcaacgtgttagccaggctggtctcaaactcctgacctcaggtgatttgcctgccttggccccccaaagtgctgggattacaggcatgagccactgtgcctggccaaaactcgaccttacaagtcacacagccatgattctaaagtcttaattctcttccatcagtgctaatcctaagagcttccacagaaaacagcactgagaactgtaaaatgttgagatccacccacacaagtgcagggttagagcccccccctcaacccccgtgtttcacgtaaccacatcctgctcatgtccctgacccaacactgcgttttgggaatataaagcctgtattgcagagacctcacaatcatatttattatctgcatggtacaatatggagccatgtctcaggccatagagttcctggttctggtttcatggccagcatcttctgccattttaattttaaaaacagggtaattcctcatttctaagaagagactagtcatttttccacccacttaattatgtagagttagtgctaaaagaaaataatatttatgaagtttcctgggcttcctttttatccagaagatacaatcagctttgaggcctgggtcatgcatactagcagtgagagggacaggtggtccatgccctccccgggggttgtggagggcctgctgatatagaagatgtggcccatgtttattttgctttgtatgtatataatggtttattgcagcatcagtatcacatggaaaggtatattcttgagccccacccaagcctacccagtcagcatccctagggggtagggtccagtggtgtgttttaactctctaggtaattcttatgcacattaaagtttgagacactctggtctgcmctaagtagtaaaaataaaagtccacaatcttgcctgtgaactcactgtgttaatccaagtccctggacttcattcctcacttctttagacccaggtcttctgttttcttcctttaccagactgttgtctggcttagcatatccagtatatcccagcagatrttacagccagagagcatctacaagaggattagactctgtgatcaggtggcactgaatgcaaggaaggcaaggttggttcgacacgcaaaaatcaatcaatgtgatataccacattaatacagtaaagagagaagaaaacataatcttttcaagggatrcagaaaatacatttgacaaaaccmcgtgccctttcatggtaacaaacactcagcaaactagaaataaaaggaaacttgctgaacctgataaaggacatctctaaaaaacccacagctaacattgtactttatggtgaaatactgcaggcttttcccctaagatcacaaacaagacaagaatgtcaccagatctgttcagcattatactggaggttcaagccagggaattaggcaagaagaagaaaccaaaagcatccagatttgaaaagaagtaaaactacctccatttccagatgacataatcttttatgtggaaaatcctaaggaacccataagaaacatgttaagcaaaattgaaggatacaagatcaatgtgcaaaactcttagctggccatggtggcacagttctgtagtcccagctactcaagaggctcaggcaggaggattgcttgagcccaggatttcaaggctgcagtgggccacaatcgcaccaccactttccagcctggggaacagagcaagactctgactcttaaaaaatcaaaaaggccaggtgcagtggctcataccttaaatcccaatgttttgggaggctgaggctggaggattacttgaagctaggagttcaagaccagcctgggcaaaataacaagaccgtatctttaaaaaaaaaaaaaattctattgtatttctttctgtacactagcartggacaatcaaaataaaattaaggacagttccatttacaaatagcatcaaaaagagtaatatacttagaaataaattacctgtacactgaaaactacaaagcatcatcgaaagaaattaaagaagacctaagtaaatgaaaagacatcatgttcayggattggaatatggcagtactcttcaaatcgatgtacagagtcggcaaaatcactttcagaatctcagctgcctgtttttttcccagaaatttgacagctaatcctaaaattcatatggcacagtaagagaccgtcaaatatcaaaacggtcttgaaaaaagaatgaagaagttggagatctcacactttctgatttcagaatttactgcaaaagcatggtgatccaagcctgtgtgatattggtgtaaaaatagacacacacgtcaatgaagcggaatcgagagtccagaaatgagccccttcatcggtgggcagttgatttccaaaaaagatgccaagacatcttccccatcaatggggaaggaatagtctttttaggaagtggtgctgggacaactggatatccacttgtgaaagaatgaagttagactcttatctaatgctatatataaaaattaactccaacacctgtaatcctagcactttgggaggctgaggcgggtggacacttgaggtcaggagttcaagaccagcctggccaacatggtgaaaccccgtctctcctaaaaatagaaaaattagctgggcatggtggcatgcacctgtaacgccagctacttgggaggctgaggtagaataatcacttgaacccaagagttggaggttgcagtgagccgagatcgcaccactgcactccagcctgggtgacagagcaagacttcgtctcaaaacacacacacacacacaaattaattccagattgatcaaagccttgagtgcaaaaactgaaactataaaacttttagaagaaaatacggggtaaatctttgtgactttagattaggcagtggtttcttagatatgatacctaaagtgcaagcaataaaagaaaaaatagataaattgaatattagccaaattaaaaattttagtgcttcaaagggcagtgtcagaaaagtaaaaatgcacagaatgggtgaaaacatttgaaaattaaatatccagtagggatctggtatccagaatatataaagaacggttacaggtgggcatgatggctcatgcctgtaaccctagcactttgggaggccaaggtgggaggatcactggagcccaggagtttgacaccagtctggacagcatagggataccccatctctataaaaaataaaaaacattagccaggtatggtgacgtgcacctgtggtcataggtaagctactcaggcggctgaggcaggaggattgcttgagcctaggaggtcaaggctgcagtgagccgtgatcgcaccactgcactccagcctgggccgcagagtgagaccccatctcaaaaaaataaaaatttaaattaaaaaaaagaatacttaaaactcaacaatagaaggtagattgtccaatttaaacatgggcaaagagctgggcatggaggctcatgcccgtaatcccagcatgtggggaggctgaggcaggaggatcacttgaggccagcatctcaagacctgcctgatcaacatagtgagaccccacctctacaaaaacttttaaaaattagctgggcacagtggggcacacctgtagtcccagctacctgggaggctgaggtgggaggacctcttgagcccaggagtttgaggttgcagtgagccgttatcacgtcactccactctagcctggataacagaacaagacctcgtctgaaaaataaaataagtaaaaaataaaaatgggctaagactctaaatagacatttctccagaaaatataaaaatggccagtaaatacatgaaaagatgcctaatgtcattactttttagggaaatgcagatcacccttgagcccccaccgcacgtgctcttggacggtcgtggcaagtgttggtgaggaacgtggagacactggtgcagccacttgggaagatagtctggcacttcctcgaaaagttaaacctagagttaccgtatgacccagccattcctcccccaggtctatacctaagataaatgaaaacacttgtccacacaaaaatgtacacctgagtgttcacagcaacatcattcataatagccaaaaagtgaaagtaacccaggtgtccctctgtggatgaatgggtgaacaaaacatggtctgtccgtacaccagaacgtgattctgccatgggaaggagtgaagtgtggatacaggttgtaacgtgggtgaacctcgaagacatgatgctaaaggaaaggaagcaggcacagaaggccacaccgtgtaccattccatctgtctgatggcsaaaacaggcacctccatagtaatgcaaagtagattcctgcttgccaggtgcaggggagggaggggcagtggcgtatasggagtgattgcctaatgagtacgaaacttcttttggagacaacgaaaatgatctggatttacatagtagtgatggttgtacatccttgcaaatatactaaaaaccactgagttgtacacttttaaagtgtgaattttatggtatataaattatgtcaattttgaaaaaaaaaaaaaaggaatttccaaaggaaaacagatgagccagggcgttccacaaagagcagctggagcaaaggtgcaggcrtacaggaacgcatgctgggtggcgggggcctgggtgcgggccgagggctggcgtggctgcccctcctcaggcctggggagtagagctctgagcaggatgtgcactgcagccaaattcctgccctgcggacggcccacaggggagcgagagcaggtggaaggtggtgcctatgtccaggggagcaagtgagcctgaatcagckatcatcaccaccagatactgggagtccctgggagagatcaggcacttgacaagccctgcctcttggaatccgcacagcaaaccaatgccattctttccttttcctgggctaggaaactcaggcctgtgtctccctgagcctgtgaatgcaggacgggccagaacccaccccagatctgacctccctagaggaagccatggccagaggggaggggagggaggcagagccaggctggtatgggattctaggagcatactcaggactcgtattttgttgttgttgttgttgttgttgttacttttcatttattttcatgtattttttttagaaacagaatctcactctatcacacaggcttgaatgcagtggcatgatcatagcttactgcaaccccagactcccaggctcaagcaatcctacctagtcagcctcccaagtagctgggactacagccacatgcctccacactcagctattttgtttgtttgtttgtttgtttttgtttgtttgtttgagatggaatctcactctgtcacccaggctggagtgcagtggagcaatcttggctcactgcaacctccacctcctgggttcaagcaaattctctgcctcagcctcccaagtagctgggattacaggctcccgccaccttacccagctaatgtttgtatttttagtagagatggggtttcaccatcttggccaggctggtcttgaactcctgacctcatgatccacccaccttggcctcccagagtgctgggattacaagtatgagccaccgtgcctggccatcagctatttttttaagagatgggggtctcactatgttgcccaggcagggatcctggcctccagtgatcctcctgccttggcctcccaaagcgctgggattacaggggtgaggcactgcgccccgctgtactcaggacttttattttttttgagccagagtcttgctcttttgcccaggctacagtgcagtggcacaatctcagctcactgcaacctccacctcccaggttcaagtgattctcctgcctcagcctcccacctgggattacaggtacccgccaccattaatggctaatttttgtatatttagtagagacggggtttcaccatgttggccaagctggtcttgaacttctgacccccaagtgatccactggcctcgacctcccaaagtgctgggattacaggcatgagccaccaggaatggtggctcttaaccaaagtgaatgtggggtgtgggaaagacaagcatccatgttgatgtttagttttctttcttgggccattgggaggatgatgaggcctttaaacaacaagcaaaacacacaaaaggtaattccagttgtaaaatcttgacgagattattttcatgttaagaaaggtaaaagttgcacacatttgtgctggtgatttcgacaagattaattgattgatttctaggctggccacccagtgtagcagaggcccagcctcacctttgcagtcttggctttgtgactgggtcactgggctttagaggcaaactgtccgaggccagtgggacaaagcaagccactcctggctgcagagatctgacttcacagaattacttgaggcccagaaagggagaacagcagtgacaataccattaaagcttcaaataattaaatgtcatttataactgatacaaaatttcatcaaccaggggtctggaagatgaacattatctggagcacacatcactcaattttagggacccactcatataaaaagcatctctgatgtacgtgatctaatacaaatgaccctggaggatacatacataatcatratgacttacctataagtctctcctcaaggacctcgaagagctgccacaatgtcttcatgctgatccttgccatcttaatgaaattaggagataactgtttaaaatcagagaagatgacacccagacaggaaaagtgacttgcctataattaacccagtgacttggaccaagccagaattagcctgtgaaccygtcacccagagactcctgagagaagccaacagcgtggcttaggagcatggagttatggctgcaaatgcctctagtagctttcagcctcaaatgctaaagcccaggacactcctacacgtgaaaatttgctctgccgtggctcgcgcctgtaatcccagcactttggggaggccgaggtgggtggatcacttgaggttgggagtttgagacctgcctggccaacatgttgaaatcctgtctgtactaaaaaaaaaatacaaaaattggccaggcatagtggcacacatctgtaatcccagctactcaggaggctgaggcaggagactcacttgaactygggaggcggaggttgcagtgagctgagatcgtgccactgcactgcattctggacaacagagcgggactccgtcttaaaactaaataaataacaaaatgccagtagcactcctgctgaggagcatggaaagagccctccaaaaattaaacccacactgctgcagagggacccaggatcagctcccaccagctgattgctggtatcctttwaacagcacgtgaaaagacctggaagagcctcgcacccttcctsggagaattctttgggggtgtggaaggaatgaactgagaaagaggaatatgttttcattctaaattgccaaactatacctttctaaacacataaaatgaaaacaagaataatcacctgttctgtaatattccagaggagccatagtagatactcaataaatatttgagagattgtgttactttttcattgktttcttyccaaaaactaaagttagggtcatgatatatgactgataaaaaaaggaagtggaagtaagtggccaggcaaaggctccatggagcatcagcctgactgatactgctggagaggtgaggcasatacagacagacagcagcttatcggaggccggaaggcttacgtgctgccttcatcacgggcttcgtcaaaacctctgggtttcaacacagcattggaaaaggctctgttcctgacgttcccacttgtggttttgaaattgccaagccaagggaagttcaataacttattcgcacacaggggcacgtccattggctttgagttaggagtgtcggtggtggtgtcttcagctcctcgggcccctattgttgctgcctgcttgtgactctgcattcgactggatgcattttatttctgaaatacactcgccccgtgggcggttttcatctggctgtgaagcagccatcaaagaaagctcccctaaatgttctgttcgcaggcagcctagaaaccttttctgacatgttgctaacactccatcaggctctctctggaataggaacagtgttcggccagcctgtggacagttgggtgattatcgaaagggaggcccacaggggctgcagagcttagaaaaaggaacgcttttaaatgtgcatatttacaacaaaatcctgcttcctaaggcaagcgagtggggtcccattgttgccggaacacatcatctccatcatccttttaaaaatggggctcttctgacagctgcctcctgctgggttgtggagctctgtggcacccagttgggcttcagggcaaatgaagccttaggacccaccatctagcactgctttcagcaaagccttccagagtccttccttctgtccagcagcttccttatcagatgggaaaatccttgcatcattaaacgtgacaagtcactgtgcttgtccccagctgttgtgctgagattctagggagtagctgtctgatggccagggtggcactgtggtcggcatgtgtcagcaacatcagagtcactactcgtggccctcagtgggatgtgccctcagtaatggcttgcccatgtgtcctgaaaacccttcttccattgcttgtcccactagggccaccctgcccaagctctggaggggacactcactgtgcaaatccgtttactgacacatgggcctcaggaagccctgatttgcaggctgcagtgaatgcacaaattactagaattttggtttttgttttttattgtttttgtttttgttttttgagacagagtctcactctgtcgccctagctggtgcagtggcacaatctcagttcactgcaacctctgcctcctggactcaagtgattctcctgcctcagcctcctgagtagttgggactacagacacctgccaccacgcccagttcattttcgtatttttagtagagatggggtttcgccatgttggccagactggtgtcaaattcctgagctcaattgatccacccgcgtcggcctcccaaagtgctgggattacaggcgcgggacactgtgcccagccaaattactagaattttgaatacctcattcttaaggtcccagtatcatgccattcttttgagattgttgagataaatcatgaactcttaaaatggttggattatccagagcaagtggtatattattcttttagctttttaaaaaatttatattggggtataatttgcatactgcattacacacattttgagtatacaatcaattcagttggttttgataactgcataggtctatcaataatattcctatcaccccaggaacttcccctgtcccccctcctgtttattctccctgttcagaagcagccatgaatctgacatctgtcaggataggttagttttgcctcttagaaaattcatggaaatggaattatatggtatatacgtttttgtgcctggctactatcactcaaaaatgtaattgaaaagaattgtttatctaccaatgatacattttccccatgtaagggaatatctgaaaatgtcttcttcaccaaccaattttttttttttttatcactgagacctaagagtttactgtaagtcagatgtactctgtgtagatctgcttctggagttggggttcagagttccaactcaggtcagactggcagcatccaacctggtctttaccactggcttgctgtgtgacccgggctggatgttcaccctcactgtgcctcagtttcccattctgccaagtgaggggtaagtgtagtacctgcctcatcaggatgatttcaagaattaaatgaacaatatatataacacaatgctgaacacctaatcttctcaatagagggctaagttctaaatagaagtcatctattagtttttttaaggaaaaatcactacgcttttaaaggagaaaaacttgtaagagtgagacactctgagcaagttcagaaacatcgttaaaaattataatgaaaaatactrtgtctacctgtcatatttgctataatgctaaatcaggtgggcaggacaagtcttcagtatctacagaaatgcctagtattgagctagcccatttgagaaagtaaagatgtttctggaaagacaatctgattattttcttaggaagtagtgtgaaataatctatgttactatgcgctagatgatgtggccaagactgggagtaacacgtattggaagaagagaatggggtcctgtcttttctctgttctggggaagaaacctcatctcttaacagacgttccgcacatcctttccagtatgccgtgttcacgtgaggtgagacgaggaagagcgagtgtttttcacaagagtctcatggaatccaaagagtaatgaccgttcctggatgttttgcatcatgttccaaatcatagccaccgggctgtcagggtcagccatccgtcctgtgctatctcatctggcaaagagaaggacatgttgtgtatgttcctgtaagacagagtggctcttactaaaatcaaataattggctgggtgtggtggctcacacctgtaatcccagcactttgggaagccaaggcaggcagattgcctgaagtcagaagtttgagaccagcccggccaacatggtgaaaccccatctctgctaaaaatacgaaatttagctgggcgtygtggcatgtgcctgtaatcccagctactcggaggctgaggcaggagaattgcttgaatccaggaggcagaggttgtagtgagccaagatcacgccactacactccagcctgggcaacagagcaagactccatctcaaaaaaacaaaaaatcaaatagctagcgcagatcactgtgaaacatctgatggtaaaaaacaaaggtcgttttgttccataatataataacccttcctgttggccaactccctctcctctcctctggcactgctggtaagagtgaaagttggggaaaccttcctggaaggaacttggcaatatgtgtcaatagcctttaaaatgatatgctttttgacctagcagttcttctcttaacatttatcctaggccgggcgcggtggctcacgcctgtaatcccagcactttcggaggccgaggcgggcggatcacgaggtcaggagatcgagaccatcctggctaacacggtgaaaccccgtctctactaaaaatacaaaaaattagccgggcgtggtggcgggcgcctgtagtcccagctactcaggaggctgaggcaggagaatggcgtgaacccgagaggcagagcttgcagtgagccaagatcgcgccactgcactccagcctgggcgacagcgagactccgtctcaaaaaaaaaaaaaaaaaaaaaaaatttatcctaaaaactgaaggatgtaggctaggcatggtggttcacgcctgtaatcctagcactttgggaggccaaggcaggcggatcatgaggtcaggagatcgagaccatcctggtcaacatggtgaaaccccgtctctactaaaaatacaaaaattagctgggcatggtggtgcatgcctgtaatccaaactgctcgggaggctgaggcagaagaatcacttgaacccgcgaggtgaaggttgcagtgagccgagatcacgctagtgcgctccagcctgggcaacagcgtgagactccatcttaaaaaaaaaaaaagaaagaaattttaaataaagcaaaaattcaaaataggcaattaaataaattattactttagtatgcaagtaatgcatatagttacattatataaaatacatgattttgtcgtgtacacgtgacaatgcaatgtaaatatacatacgttatgatgtataattgaatatatatcataaaatcttacatttcatataatgtaatgaattatatataatgtataaattttacatggtaagtatatgcattatttatacatatgagcatagcacatgatataaacagtgcaactttgtttttctttcgatacagaggctccctctgtcacccagtctggagtgcagtggcacaacctcggctcactgcaacctctgcctcccaggttcaagtgattctcctgcctcagcctcccaaatagctgggattacaggcacacgccaccacgcctggctaacttttgtatttttagtagagacggggtttcaccatgttggccaggctggtcttgaacgcctgacctcaagtgatctgcccacctcagcctcccaaagtgctgggattaccggagtgagccactgcacctggaaatgtgatgatgcaggtgaaaatgtgattacatggggagatagttatggtattctgttaaaatattgtgtaccccaaattgttaattgtgacactttctctaggggatagggttctgatttattcttatttattgcttatctttattttctaattttctgccattttaaaaatttggttagatttttaataagctatctatgacatcagagccgtagagggccgggaatgtgtcattgacatgaatggcatggcttgcctttcacccagtgtgacagtggtggctgacgccacccaagggcacactggtccactgtcagtggcgcctagagccctggcatctgctggctgtggcgctgtatgagagcattcgtgttaggagtaccactggggtgtgacccccacattgctcccgaaagctgtgcagccatgacccgcaccctccccagactcagtttcctcctctggaagtggacctgctagttctccttttgttcccagtttgctcttggtttggatttggcatcagggcgagtggttaggggcagcgtccggacaccatgctcacctacccagatgaatgagaaagagcagcattgaaatcctcaggctaattctgaaggactcttagcagctgaggagcatctataaagttatgagttcctctgaagttttagtgaaattacggggctactctgtggcctaccacttccacccctaggcgtatccacaagagaaatgaaacctgcgttcacacagaaacttgcacataaatgttcatggcagcatcgttcctattagctacacagtggaaacaaactaaaatgtctatccaccaatgaatgcataaacaaaatatggtgtatccacacaatggaatattgttcagccacagaaaagactaaagcattgatgtatactacaacgtaaatgcaccttcaacattatgaagccagtcacaaaagacttcataccgtgtaattacatgaaatggccagaataggccaatccatacggacagaaagtggattggggtggccctgggccggggcaggggcggggaggcatcagggggatgggcagtgcttgctcatgggagtgggacttctttttggggtgatcaaaatgtccccaaattggttgtcatggtggttccatgactctgaaaaatgctaaaaccattgaayggtgcatttggagatgagtgaatcgtagggtatgtgaattacatctcagcaaagctgttagaaaaaagaaaagatatgccacattttaagtggtgggaaaaatcaaagagagcatgttctgagttttaaacaaagctagaggagatcatgtttctgagaccgttaaggaagcccacggctttgccggcatggagtgagaagatgggaaccacctgcccagtcgggcttggagggcagcgctggttcatttctttgacatcagtggccttagccccgaataatcctttttagaaaatcaaagaagcactcaggctaaatatgcaggatttttgaagtgtccaacagattttatttgagaccataaaaggggtttgtgaactgtctgggacagtcatggaccaagtctgagcccacctggcctgcagatggcttcctgctgagcacctcggtggtcccagccactcctggaaggattggttctagcacagagaacagagcccacccaagggactgtgaggrcctggcttggggtggcagggcctgaccccaaggatacatacaatctggaacatttatttgttcaacagccactctcccagaaccacactggggccatgcgatctacagacccttatgtgtgctgtgtgtgcagaggggactcacggtaaacagttcagccagtgtttgtgaatctgcagtgcgatgcaggaagacctgcctgatctgcggtggactggccaggaccagcctaggaaagccatttgggctgatctgtctgaaagagctgaattaaaagtgagagttttaataacagaaatgaagaaggaaaaaaatggccagcagcataggagtgctccccagtgttgctggggagtttcgctgctgctcagcccctgttcagggtcttctggaagctsccagcagcctcctgagacagacaggttggagcaccacagctgcctgcggctggcacacagagtcgtaatttttcttggtttyaaaaaccaatccagatcttggaattatccaccgttgtggtaaacttaaaattgtccaaagacaccggatgactctccttcaaatggtgtccctggcccatctctaggagagaactaaactttttttaaaaaaactcacatatcctgtggtttttcaattctcaaaaaaagcttttgtctctcctgtctgttctctccaaaagtagtcttcgttgtgggtttttttttttttttttttttttagagataaggtcaccgggcacagtggctcacgcctataatcccaggactttgggaggccaaggcagacagatcacaaggccaagagatcgagaccatcttggccaacatggtgaaactccatctctactaaaaatacaaaaaattagctgggcgcggtggtgcgcgcctgtagtcccagctactctggaggctgaggcaggagaatcgcttgaacccgggaggcagagcttgcagtgagtgagccaagatcgcaccgctgcactccagcccggcgacagagcaagactctgtctcaaaaaaaaaaaaagagatagggtctcaccctcttgcccagagtggagtacagtggtgtgatcatggctcactgcagccttaaactcctgggctcaagggctcctcctgcctcagctgcctgagtagtcaggactacaggtatgagctaccatgcccagctaaatttaatttaatttatttatttatgtaggtaggtgagtatagacaggatctcactttgttagccaggttggctcaaattcctgacttcaagtgatcctgccgccttggcctcccaaagtgctaggattacaggagtgaggcactgcatctagcccaaaaatagtcttttcttacattttcccctctaatgtcttacctgccataccactgtctgctgtccagctgaactataccaggagccatatgtgttgttttaaattttctagtagctgcatgttaaaaagtcaaaagaacctgatggaagtaattttaataatgtagttaacccagtgtatgtaacatgtcaattcagcatagcaagcaatgtaaaaaagcattcaggagatatttatattctttttttttttttcctagacagtctcgctgtgtctccaggctggagtgcagtggtgcaatctcagctcactgcaacttccgcctcccagattcgagcgattctcctgccttggtcccccgagtagctgggattacaggcgcacgccaccacgcctggctaatttttgtattttttagtagagacggggtttctccatattggccaggctggtctcgaactcctgacctcgtgaaccacccgcctcggcctcccaaagtgctgggattacagatgtgagccaccgtgcctggcctatattcttcttttattctgagcctttgacacatcagtaggttatttcacacagcacatctccattaggactagccacgtttcaagcatctgatggccacatgtggcccatgtttggcartcatgggtctagatagcttatcaggacaggagttacatttgccctatcagcttgcaaaacatgctgcaaaacagcttgcaaaacagctggggactggagatattggattataccatcttggtgttgcgccagtcaggagtaattgttgtaagttaggctttgacaaggaccttgtaatgatgctcacatagaagataatttataaatacctataacataacctgagaatggcgattaagtaacctggtcttaactccagggcccaccacagcaactttgagcttagatgccacttaaccttttgtaacttgtaacttcattggtggtgggggtacaggcaggtcagcttgttcacatgggctgcaaacatggctttaccccaccgtctcccgtggccttctcaacacactttagaatctgcaggagacctgcagccccccaccagacccccagaatcacactatgctggttggcctgggcatgcccctccccccaagcatttccgctgcacatcccagctcaagaaccaccctctgggtgccaaggtctcctccaggagcacaggttctcacctggggctgatctgccccctggggacatttggaaatgcctggagacatcctggattgtcccagcgtggtggggggctggggagcccctgctagctgtagagatccagtgacagtttgcatgagaggtttctccattgcataccagctgactctgaggagcagcttgacgcggtaggggccctagtgagaaaccttgccttcctggaccatttgggccacaagtcagcataagtgacttctcctaacatcagtaccctctgcaagggagaggctaaacaagaagacccccggggagcccctgctagcttgggaagtgtgtgattctctccactccctccccatagaatcaactgtaaaagctttagccatttctttgggacgactttggatcagcatataaagatactgggtgttctgtgcacactctgcactctgggaagttaatgagcagtttttatctggcatggcacaggctgttcttaatttttacaagcttaagctcagcaatttcaagttcattctaaacattgaaagagtccatttgctcttacgagataatagtctccataaaacctaacatctacatacagtaggtatttctgaaccacactcaaccaaaataaatgtgtaaaaatgttacgaaacatttattgaattagacaatgaccaaaaatttcttcagtgcaaagcacactcagatttggtttttatttccatttcctgttttcttttacttaaaagtctatagaattaacataaaggttgagttctcagtgaaagaaaccaggctgggcatggtggctcatgcctgtaattccagcaatttgagaggctgaagcatgcgcatcagttgagctcatgagttcaagaccagcctggaccgcatggcaaaaccccatctctacaaaaaatacagaaattagccaggcatggttgcacgcgtgtagtcctagctactcaggaggctgaggtggaagggtggtttgagcccgagaggtggaggttgcagtgagccaagatmactccactgcactccagcttagacgatagagmcagaccttctctcaaaaagaaaaaagcgagacacaaaagatctataagtgattgattcggtttacatggcgtctcagaaaaggccagtctgtagagatagaaggagaagcggttgcgtcggtgtggaaaggaaaatttcaggtgggcatgaggaatctttcaggggtggcagaaacgttctaaaccagattctggtgatggttgcgcgctgggttttttttactagaaatcactgaagtgtatccctaaaaacaggtagattttatgatatgtaaattataccttaatacagctgttggggaaaaaagaagacttggtactgcccatccccacccccaagggctcccagtttattaagaaaactaaggaaaacataagacagatgaatgggggatgaagccgcaaagggtccccgctgctgcccccttggacwtcgtaatagtgaactgtgttctggccttgggtgaggatsaaggaagctgggcccagatctttttccttggttttcaaagccttccaggtaaatatgggacctgccagggtctttcagcactggaaatagccgacatgcccctcagtggcctccaggggaagccccccaggagctttgaggagctgctttctcctccgctgctttgaggagcttatagccccttcaagctcttcccaaacctcacaggcctttctgcgtccctgacagaggtctcaagaggagcctttgacaaacagcagtgagagctgattgctgcccagtgtcatcaasatgccgccattgattctagctttggaatctgtggccaaataggtgactcaatctgaaatttatttggagaaggcagacaaacattcagaggaagcagcagaagttccattagagcaaacctccgcagggagtgagagcaggggccatgctgcagaggaggccggggcagcgtgggtcacccaggcggaggcggtgccgccccctcacatggaccaggggtctgggggcagctctgctcctcaccaaggcccaagacccgtgctgtcataacagtcctccttcagagacacccctcaatcagatctaggaattgaaagtcagattggtttcacaagagaatattgtggagttttttaaagtcttgaggcggggcgccgtggctcatgcctgtaatcccagcactttgagaggccaaagtgggtggatcacttgaggtcaggagttcgagaccagcctggccaacatggtgaacccccatctactacaaatacaaaaattagccaggcatggtggcatgagcccataatcccagctacttgggaggctgaggcagaattgcttgaaccctggaggcagaggttacagtgagtcgagaccacaccattgtactccagcctgggtgacagagtgagactccatctcaaaaaaaaataaagtcttgagaatgttcacttcctgacggctttgcacatggcccataacaagctgtcctgaccttctcagtgtgtgacccaggacaccgtggaatctgggaaagccatgatttccacagtatactcctagaaattttaatctcagagaatgatgatagatgtttctggaaaatgagttgtgtttgagaactggattaaacaaaattacagaggcttctttgtggcacttaataatttcccaaaccactaaagagggaagccccagcgctatgagcatacctggcaacagaccacttcctagagaaatgcctccagtgagccagggctacattttgggaagtgactgtatcctacagagtagaaaaatagtcccagcacagggtctcatgcctgtaatcccagcactttgggaggccaaggtgggcagattgcttgagcctaggagttcaagaccagccagggcaacatggcaaaaccctgtcactacagaaaatacccaaaaaaaaaaagccaggcatggtggtgcatgtctgtgtcccagctactccagaggctgaggcgggaggatcgcttgagtctgggaggaggaggttgcagtaagctatgattgtgcccctgcactccagcctgggcaacatagtgagaccctgtctcaaagaaaaaaagagtagaaaaaaaaaaaaaaaaatatatatatatatatattcatattccaacccccgagagataatcagttaatgtttgacatattacatgtagtcttcctctgcaacatttgtgaaaagaaacagtgctttaaagaatttaagagccttttttgggctaaaactatatcatgaacatcttctcatgtccttatgtatgtctctttttttttttttttgagacagtttcgctctgttgcccaggctggagtgcagtggcgcgatctcagctcactgcaacctccgcctcccatgttcaagtgattgtcctgcctcagcctcccgagtagctgggattacaggtgcgtgccaccacggccagctaatttttgtatttttagtagagacggggtttcatcatattggtcaggcttgtctcaaattcctaacctcaggtgatccacccaccttggcctcccaaagtgctgggattacaggcatgagccaccacccccagccatgtatgtcttttaaagcgttatttttagtggtgtcacaataatccgtccatggttgagccgtcattacatagtcatcccccttggacatgggtttgcaatgaaatattgaaataccgctgggttgagcacatttgtgaatacagcttatggggcttatgattaattcatttctaaggatgagtttctagaaggagccaaatgaggtcaaaggctgtggactttttcaggtattgatccaacatcactgtgctgctctccagaagggtggtgccctctgtgtacatctgttctttctcaccttgcgtctcccctgggtcactgccagcctcacagcgatagggctctgcttcaattgggtctttgctctgctcacagccatgctgtatccatcagggttctccagagaaacaaccaatttgtgtgtgtgtgtgtgtgtgtgtgtgtgtgtgtgtgtgaatctgaagtgtgtagggcaggccagctggtgtgtgtgtgcatgtgtgtaatctgaagtgtgtagggcaggccagccgggggtgtgtgtgtgtgtgtgtgtatatgtatgtgtgtgtgtcacatctgaagtgtgtagtgcaggccggcgttctggaaactcgggcagaagttaatgctgcatgcttgatgtaggatttcatcatcacgaaacctgttttttgctctttgggctctcacctgatgggatgaggcccacctgctttctcaaggataattgcctttgtttggagtccatggactataagtgacatctacaaaaggccttcacagcaatgcataggttgtgtgtgatgaaatcactggccgccgtggcctggccaggttgacatgtgaaactgatcatgagtcatcctgctatgactttaattgcctggagaattccttcccagcaaaagccgcacgctgcttctcccagaggggtggggtgcattttattgggcacttttgcctttgaaaacgtaatctccctagataagtattaccactgaaccacctgctgagcagcgtgctagcatttcttgactccagatgggtttcacacacgtctgtcccctacctggctcctgtggctgggtgctagatgggaccatgggacccaagtccaccctctggccccttctccctgtaggattcctaagcttgagccagactggtcgttctgccaggttggttgcccaccctcctacccctgcagcggccccatcccacgtggttaagtgggtggccacacccactgcctttcctttctcacttccagctctgttcttcattccagcagaaggtccagcctcacacagtgacccagtgggcttgaacagtgaggttccagtcccgtccctttagcctcatccctcatgggggaagatacctgatgccggggctggggtgtaggaggtggttgaaacagcctgatctacacccctgcctggtgggttagggctccgatgccacaccaggcctggcatctagacagagagttccacagagtcccctctgcctgctatgtgccaggcactgtactagcaccacacctgccctcaggaaactcacagcatgaaggagagagagacaccaaaaattgcttgatactgtgacccatgctggccaggcacggtggcttacacctgtaatcccagcactttgggaggccaagcgggagagtttcttgaggccaggagttcgagaccagcctaggcagcatagtgagactctgtctctacaaaaaaagaaaatttaaaaaaaaaaaaaaaaaaacaggcatggtggcatgtgcctgtggtcccagctactcagaaggctgagttgggaggatcgcttgagcccaggaatttaaggctgcagtgagctgtgatcgtgccactgcattccagcctgggtgacagagacctcgtctcaaaaaaaaaaaattatatatatatacacacacacacacacatacatacacacacacatatacatatacatacatacatatrtatatagtgatccatgcaaaatctgcagcaggrktaggcagacaggaggaagtgggttgcagggtcaaggcaagcctcagagaaaaaaacctgagactgagtggccctgacaggcagttggtgggacagggaagggggtggtacagacggagggaaccmccatgcaaaggtataaaagaggaccccccartatgctaacatgtattccactgttgctgaagactaacactcaaggcactggttaccagggaatgagaacttgtgttgagtttgagattttacttacctggcaagttggccttccagtttcacggagctggtctaagatatgagacwtcagggtcagagacaaagaaaaatccgttattcacagcaatagcagtagccagagtattagcatttgggtcatttcccaggtcccagtgcccatagctgtgatgtagtcagggccccatggcatccgcacacatcaagggctgcattgcaggagaggaaccctaagcttaggaaccaaatcttctacagtgggcacaaagcacatttgccctgtgctctggagggagatgctatctccatcatccaaggctgtttcctgtgcatgttcttggaaagatagttgggaaaaaaggcaggcagagcctctgctggmaagacacagggaaaggagagagaagaattgttacccggcaaagatcagactgcctcctccaccaagtctctggtctagattctgtgagtccagaaacctccatctcagtctaggagggacagctaggaggaaataaggacgtcagtttgcaaccagacaagtttagaggcctgtggaattcccaggccaagggaagagttgttacggagactctatggccaagagggacagatcacactagacatcaagctcaatggatgccaccaagggcagccacctgctgtatcttgtacacgtttcatccatccagcttttagcctctcaatccttctcttcctaatagggtaggtataagattcccattgctgctgtaacaaattaccacccacttagtggtttaaagtaacacggaagtattccattacagttctggaggtcagaagtccaagctgggtctgcatggtttcattccttctagaggctgtgagagagtccatgcccctgtctgttccagcttctagaagctgctactcatcttggtggccttgcatcccctctgacctgtttctgtcctcacatcttctgactctgattctcctatttatatgaccctcttataaggacccttgtatattgggcccacctggataatccaagatactctcccctctcaagggccttgtcttaaccgtatctgcagttaggttgccatgtaaggtcacatagtcacaggtcctggggattaggacgttgacatctttgggagccatttcccttctaccacattattctgacctctgtagatactgtggcccatgtcatcaaacccccatgacagtcacagccctgcctrtttctttccatccagacaggtggtgcctgtgggtacatctcagcgtagggtgcagacagagttgtctgttggaaggaaaaccacatcgaatcgggaagggagggtcctggctagagtaaggacagtgggcaggaggccggggtcctgtcctgccacaacactgaccacctagaacctcaactttcttctttaaaaataaaaagagagtaactacacttgccatactgaccccccaggttgtatggaagctcagtggagaaaatggccggggtgcgtgtctgaaccgcgctgcatttggacrgacactttgtgtgtcacatgttagtagctgcagtgtgtcctccaccygactgagagtctgtgtatcaagataggggtaaatcctttctgaccacttgcagacagaagtcacgcctcgtggtccaaagccaccaagtcattacttttcaaagcttttccagtagagacacatgactccttccttaaaacaacttacagtgaaaatatgtggatggttgaaaaagtaatgtttccagtctgctgaaagttctgtgggttttttttttttttttgcagggcaattatctgtataaaatactttttttcttttaagtagaatcctattgctaatgaaaccatattttgaacatgaaaattgttacaaagaagaaaaaatgtcattatccagaaaagctgcaatagctcatgcatttgatggtctaaatagaacatttttcttctcagggggatgaaagcggtcccctcctattagcctatgaaattattttagaattgggttttaatccctggaacgagaaagggggatggaaccctaacataggttccatgcatgggaagtcaaacctgaaatttagagacaggaaatatagcacgcctagtcactaatccaaaaggaatgtgaaaaaagagttgttttaatgttggaaaaaggcagcatgaaaggtaaggcttccttcctgccgtttcctctggtgcccttttctttcccccgatcacatttgctagatgtccatttctgtaagttttccctctagaacaaacctatcatttttcaccacrggatatttacagcttcaatcagtgccaaattcaattggcttctgatctcatcgctggaagttatagatgcagatattatttgcactgcggttaattatggagcaatcaaaccttggcttttccactgtaatttcctctgccagctaatttaattaatcacccccagctcagctcttccagctgcgaccagcagggtcattaattaggcatgtggtgggagctcacccaccaggtcctgctacggggccgctgcccatttgatctctcagggagggagagcttttcctaagcatcgatcccctccagaaaggaagatggttcccaaaaggcctatcaggggcaaacagctcacctgcagtggtgattggtttacaaaattcacctagttaaagaaaagagggccaggtgcaacggctcacgcctgtaatcccaacactttgggaggccaagacgggtggatcacctgaggccaggagtttgagaccagcctggccaacatggcgaaaccctgtctctactaaaaatacaaaaattagcctggcgcggtggcaggcacctatgatcccagctacttgggaggctgaggcaggagaattgcttgaaacctggaggtggaggttgcagtgagccgagattgcacccattgcactccagcctggaggacaagagcaaaactccatcagccgggcacaatggctcacgcctgtaatcccagcactctgggaggccgaggtggccggatcacctgaggtcaggaattcaagaccagcctgaccaacatggagaaaccctgtctctactaaaaatacaaaattaggcaggcgtggtggtgcacgcctgtaatcccagctacttaggaggctgaggcaggagaatcacttgaacctgggaggcataggttgcagtgagccgagatcgcgccattgcactccagcctaggcaacgagcgaaattccatctcaaaaaaaaagaaaaagaaaagaggcctcgccttccatttagactggctcatgaacttgccaaagaaagggctgttgtcagtcgccgaggcttcggtctcaggtttttcaggtcagtgtgtgcctaataatgcagatgtcatgtgatgagctcggtttgttgcaaggaagcgtcgtcctcctcacgggctctttacgttgacattgtggctttggaggctgatattttctctaaaggaaagattaaaggattgttttcattttattataaggaagagacatttttggtataagcccatcaaagttggtgcctaaatgctgcaactgattcttctattattttgaagagcctgtttattttccagcagttaccagcttaactaagacattgtcactggaattccgtataaatgtgtgcatgctcacacccatgcctacattagaaagagaagtaccccaaatttgggaggctttcttatgatcattcttaaatagtttattgtcttataataatgtgggcttttttgttttacttaatatataggaagatttttttttaatrccttaaaaatactgcacattaagtctgtttttttacagaaggataaatggatgaacaggtgttttaggagccacaataaaccatcgcagagcaaggagtgcctcttctgagatcccattcgatgctctgccctcaattaaatgaatccgagataaatgggmatgtgcgtgtgtatgcacacacacgtgcacacatacacacacaggcacacatatgcacacaccaaggttctagatgagaaggaacagagggatccagctcagtaattaaaggaataataaggactcattgtgtggcaggtggaagaaaaggtgcaggaggaagactcacaaagtctggaggattggcgctctctgttcagccgggcaggaaggcaggaagcacccctgtcataaaacccctacagcctgtaaacaccaaagttccctcctgtcttggagtggggctgggaggccccggtggggaacagctgtaatgatggttcgctttagttgtgccttcctgaagggcgggggggggtctctgcggccaccttaaacttaaacaagtgtattcagtcttgacggccagccccgtgacctgccagcatattaacatttaaatgcacagtacattcattcatttcatgctgtaaggatcattctggaacgaatgataagtagtggtttttccctgacattcrtactctacttttggaagtgtgggagattgttgagcatttttaaatagccataatgcaaggggcttctgtgtatttctagttcttaaagaaaatgcaggatgcaaacaaaaaattaattttcagacattttctttcaggaaaacctctgtttggatataaatcattgaaaccttgaaacaaatctgtcattctattcacaactcaaatatcaattttaagaatttttgccgggcacggtagctcatgcctgtaatcccaggactttgggaggctgaagcaggcagatcatttgaggtcaggagttcaaaaccagcctggccaacatggtgaaaccacgtctctgctaataatacaaaaaattagccaggcatggtggtgggcgcctgtagtcccagctattcgggaggctgaggtgggagaatcacttgaacccgggaggcagaggttgcgttgagccaagatcatgccattgcactgtaatctgggcaaaagagcgagactccatctcaaaaaaataaaataaaataagattttttaggccgggcacggtggctcacgcctgtaatcccagcactttgggaggccaaggtggatggatcacaagctcaggagttcaagaccagcctggccaacatagtgaaaccctgtctctactaaaaatacacaaaaaattagccgggtgtggtggtgtgcgcctgtaatcccagctactcaggaggctgaggcaggagaatcacgtgaacccgggagrcggaggtcgcagtgagccaagattgtgccactgcactccagcctgggcgacagaacgagactccgtctcaaaaaaaaaaaaaaaaaaaaaaaaatttttatttacccaattctgtgactgcctgaactggccaggacaaatagagaaggggtggtaggggggcagtgttagattctttctggagcactagggtgcaaatcagaagygtcctttgttgctgcagctctccccagccgcctggaggatctgtttgggaggggagcactctctaaggctagttttgttcttgctcagatgatcaaatctctaatgcatctctagtaccaacctcacttcccagcctgagtttccatttgtccccagtttccccacacaaagagcaacaaacactgttccagctggtaggaccagcccatggatcccagaggcccagcatgctcagggctccttcttttttctcatttctctcctccccatctccagacagcctttacygttcataaaaagaaatgcaggcctaaagaggactgggggctggaagagggttaggctgagtcccattgcccagggcatgaccagggaccatgtggtggcccccaggggcatcatgtggttttccaggccaaggagctgcctggctccatgggccgcctcaggatgtggcccagccggcttcctttgtgaaggcaagccccacacaaggagcaggactcctggaggggacaatggctgtccatcagtgatagcaaattccagcgtccaggccgtgggttcatctggctgccaggctgggctgatggcagcaacgctgaccacactcgtcatttctctgctgttatcacagcctgggagcgggacaggatctgttccattgactgcatttttaaagctgccctgatcttcctttttgccctaatcttccttttcctactgcccttttcccccctcctcctgcttagagataccagctctgacagtccgaatgtaagaaataattggattctaaattctaattcatctgtaaagtattcggtgattaaattagcctaatagatattatttcttacatgactgcgtaattttatcctgattggatctcagtggtactaacgtgccccccaatttactattgacttgaaattctcagaaggcgagacataactctctgtcttcttcagtctgttttcccaggttaaaagttaaactgatttatgctaaaggaagatcaccttactgctcaagtgtagttgcacastgtatattgttctttaagaagagcagtacaaggaaaatattattttatgtaattttaaatcctctttttcctctttttctattcagaaactaaaagaaatactgcccatttaaagtctttggacagcaatttgattgcaggtaacatagtttctcttttaaatagctgraagtctcatccaaacaaaactaaccgtcactcagcatagagctgataagtgttgtggatacattccaaaaaattttcaacattcttaggataaaattttagctgggcgtctttagccatttttaatagagcygcttaaattcttggtcaggaatgagatagaaagggaacgaagtcatggaccccagagatacacaggagggcactggccagcacttattcatcggccttatttctttctttctttgcataaatttaatttcttcaagtatgtgcctctcccctcccccacccccctgccctacctccctccctccaaaaatctgcaaataaaattccccgctccctccctggttgagtagctggaagcagctggtgggttttgtgtggctactgaacagtgggggaaaaaagttttggcaaacactcgggaaacccaggacagaggaggtaggtaaactcaggaaactgttttcatgagtaaatgaaggaaacaaaggcctcgcagcaggagcagaagggacacacactccctctgaatagctccctaaaaacagagctgaaaaggaagaaggcccatttgcttctgggaatccaataaattgtttcaggaagtgaaagtctgtccaggctaatggagctgtgattgacaggccttctcattatggagcccatcaggggacagggcattccagtgttatttaggggkcgaggtgggaatgagaggaagccagagcccggggtgggggcgggagcgggggctagctgtgggtgttcattgaaagagtccaggtccccgacagccctgctccaaggacagacaacctcgtcttgcaggatcatttaccttttatattatgacctagccacttctcatggctctaccacaccatcttcccgagagagcctgtgccygccccacagtcccggctgaaatggcaaatgcggtgtaggactgtggtgcacactgcccatgacgggctacttggacrgctcatgcccacctctgactagtttgatgttctgaatcaggccccttggttaagcgtgataacatgatcacctggtgttttaaagcttttctctgtttccatgtggtgccgtgaatagtctcataagccatgtaagtggccttattggttaagtgacaaccggggacatacccattttctttgtccatgaagcaccaaataagaagttggcgtccattaaactagattgattatttaatatcacaaggcttttgaatgggctatggggaggaatagaccagaggtctttgccaggaggagacgttacagcaggtcctctctggttgggacctgcttaaagatgtgtaaagaccttgaacatcagcatctggcacagccaggggagggacagggaggacgagagacctgcttggtatccttggccccggggtccaggttattcagtttgttgatggctatctggcaggactccctcctgagcaagaaagaccctcagtctccacgatggttatttccagaaaagtggggaccttcaccaatgtgcctttcattgtgaaccttacccagctgggctccaggacacctaggcacatccccgtctctgggtccccagccttatcatgtgtctgagtgtcctcagacagtggaatccttccttcaccttactgagagaggccagcgctgttttcattttggaattggcaaaaggcaagttttctcctacaatgctttgaaagggtttaatgcacactgaagaaacagccagatagctccagctctgctggaaagggcaaagacccattaagcatctggagtttgggtcctgggttgtcacactctgtaatgaccatcttggagggtaagacacttggcagtgggcatgtgaattggctggcatttccagagtcatccttactgttgggctattgggtgatagctagtgggtgatagctattacatgaagaagatgcctctgtgaacttaaatgttggttcagtgactcacaggctccaggcagattcatagatgctttcatgtttactgatgcattttgtattcttaagcttcaggaagtagtgttaattatttatctgggtttaactacactttaatttttgtaaactaagtccagagcggtctacatagtaaaaccatagattctcttttgtttgatttctgtgaattgcagcagtttatgccacaattgtagccctgtccccattgtcacgaatctatgtatccttctgcttctattcactgtgttccagaacctatcacggtgcactgcaatacctcattcctcacgagtgctcagttggtatttcttgaaagaatagttgcttaacagggcattcgatcatgatggtgatcgtcataaagacacacggggctgaaatcaaattcaaagaactcacttctaccaaaagagaaagaactggtttgtataatatgtttcaaagtacagaaggtagaaggtacatcaccaccrtccatcacgtgaaggagtagaaaaagtgggatgccacagttgcggcagagaatatccaaaaggaaagggtccaagtcagaccgctcacgtgggtggcagcgtccaagtccagtttgtacatttctgcatggatgaggtcttttcaaagcacatacagttgtgtgatttttatttccccaagaaaaaataaaaagttaaagtcagtctagtcaattgctttaacacaaagagcaaactgacacacagtttccctgggcattgctacrtattccttgctcttccgtaaaggacacatgtgtctctgtgcctctcagtctcccagttgcaaagatgccatcccaggtcaagctgaggtccttgcaaatgaactgcatgctggagataaagcgcctactaggctgccgggtactggcagaagagagtgagcgtagcaactgggaggtggcctgatggcctgcgcctgttgccgttgatgagacccaaagtctggaacgaatctggttccatrtagagttcatgctcaccccgaagtccttctttggcactggagaacaaagaagagtttgcacagaagaaaagggaggttgtttaaccagaaaggccctctgcaaatttctgattcctgtacagtcagcattaatatgctgcttttcagacatccaaatgggggattgaactgtgagagtgcaggcaataaagagtgcatttgtggaatgataacctgactggcatccctgcctcttgaatggctgacgaggtctaattggcatgtaacgccctataaatttattagcatgcctcatttctcattggtggactttctactgttaaccaccaagaaatgaccaattttcaggagttagtcactcaagtcgtacttataactaggttggaaaaaaaaaaactcacactgctcctattataaatcaaccttatgcctgtacagcagctccctggctgcaaatgaatccatcggatacagaagttttgaggtgagtggagttgcagggaggagcacgtgtttaccaggaaacccactgctctcctcaccttgccctgcgcgcctgagcccttcacagagaccggccgtgtcctcacccctctgtcaccattgtgggctccagctgcacaggctggggatgggctgggtagaaatggcagttttgtggtcgttcgcacccaggactttgatgttcctactgatatattcaaccctcaggcgtaccatgcaaagaggacatagccaccctcttatttcaagagcatgatagaaatattcagaagcagacataattatttcaattacttctctctggtttttgagacgcacactcaagagtcacaaattagaaaataatattcacatrtttcttctaattggtaacagattagaggcattttatctttttaaataatttccaaatgtgccccaaagagactgtgaagggagggaacagaggcatggaaaagcaaacgggctttgccaagcgagtgagaggcgggggtcggagggaggccttcctcctgcagcgtgtttccagttgttcggatttttgtgttattttcatcacttttggatattgaaagctagcagggagggggtcttcctggttatacggcccagcttgcaaacataatccttccttgtttttcttttgttggtggtggttgtgtttgttttgttttttgttttgttttgtttttttgagacagagtttggttcttgttgcccagcctggagtgcagtggcacgatcttggctcactgcaacccccgcctcccaggttcaagcgattctcatgcctcagcctcctgagtagctgggattacaggcatgcgccaccatacccggctaattttgcatttttagtagggatgaggtttcaccatgttggccaggctggtgtcgacctcctgacctcaggtgatctgcccacctcggcctcccgaagtgctgggttgacaggcgtgtgccaccgcaccggccgtaatcgttcctggtaagcacatttctgaacacatcaatccgctgcctgcatgccctgtccttggccacgtgttttctacacacgtgcatgcgtgtttgcatatctgcacgcatttttatgtccagtgtacttccaaaaacagatttgagtcatctatgcctgtctctctgtgcagcaactttggaggggtgaagacggaggtcgctgctagtccaggtcgcctggggccctgccctctgacacagggtatttcaagttcctctaaatcctgagggtctcaactgttcctttttcataatggaatttggttttatcaaatactgtttttaacatttagttgcctctgctctggaaaacagttttacagtttcttataaaactaaacgtgcaccttccttatgacccagcaggtgcactattaggcacttatcctagagaaagaaaaacctaggccgggcgcggtggctcactcctgtaatcccagcactttgggaggctgaggcaggcagatagcttgagccacgagagttcaagacctgcctgggcaacatagcaagattccgtctctacaaaaaaatacaaaaattagccgagtgtggtggcgtgcaccttagtcccagctactcaggagactgaggcaggaggatggcttgagcctgggaggcagaggttacagtaagctgggatcatgccactgaactccagcctgggcaacagagcaaggctctgcataaataagtaaataataaaacttaggtttacacaaaaacctgtatgtgaatgttcttagtggcgttgttcgtaagagcccaaaaccagaaacaacccagatgcccttcagtgggtgaaaaagtaaacaagctgtagaccatccacactgtggaaaactacttggcagtgaaaaggaatgaattcttaatacacaacaacaacttaggcgaatctacagggaattacattgagtgaaaaaaagcctgtcccaaaagattacgtgctgtaggattccatttatgtatcactgttgatattacagaattacggagctagagaacaggttagtggttgtccagggttagggatggagagggtgggtgaggttttagaaaggcaacaagagagacccttgactggtgctagatacaggaacgtacatgtgaccaaattgcattgaaccaattccatggacacataaatacaaatgaccacaaggaaaatcggaaatgtggacaagccaggtgggttgtatccatatcctatggtgataacatactacagtttttcaagatactgcctttgaggggaaaccaggtaaggggtacatgagatctctctgtattatttctttttcttttttgtttgttttgttttgtttgtgacagagtctcgctctgtcacccaggctggagtgtagtggtgcagtctcgtctcactgcaacctccgcctcccgggttcaagcaattctcctgcctcagcctcccgagtaagctgggattacaggtgtccgccaccgtgcccagctaatttttgtatttttattagagacggggtttcaccgtgttagccaggatggtctcgatctcctgacctcatgatccacccgccttggcctcccaaagtgctgggattacaggcgtgagccaccgcgcccggccgtattatttctttaaactccatgtgaatacacaattatttcaaaaaagcttactaaaaagtttaaaacaatcaagcaaaataaaaggtggcttcccttaaaagaatcagggctccttggagaaatggctcattccagatctggttgagaagtagggaatggccctggagcatcctgctgtgccagaaagaaagcacagagctaccagggaccagggcagatgccgcagacagaaacaggagcggctccaggcctcccactggccaaatctggaacaattgaagcatctaaaagaatagtgttggtggcagtttatgtgacacatttaatttttaaacatgggtccacgacgatactccagaaaggcagtgggggagaagctcttctttataaaaaatgccaaccagtaaacagagaggatgagggaactggaaaatctctatcccgcaaccaaaaacgtgatattttaattggttcagtcaaggatcatcaactgaagctgcacccctgggggagaggaacaaaatattccgcctcaaggtgtcagcccagggaaactgaagctgcacccctgggaggggaggaacaagatattccacctcaaggtgtcagcccagggatcacttggtcattgtaaagggggaagggacctggacagagacctggtggctcctgctttagccacagactcagacagactcggtagtggaacaactcacagtctgtgcctcctgctggtgatgcaagggagacgtggcacctctgtagtaatattttgacccaaatggaatcggacaaacacaattgggggcattttccaatagaaatagcttgaaatcctcaaaataccaatgtaaagaaagaccaaaaagaagagtagggtttggaagggactctcacatgggaggaggtataagaggatgaccaaaggcaacatatatcctggattgggagagaaattcagccctagaacgtatttttggataatttggtgaaaactgaatatggaccacatatcagtggctgcctgccagtcataatcatgaaaaacacaatcccaaacaccataatcccaagtattgaaatctctcaagtctgaaatccccaaaatcacaatcccaaaaaatcaaaatcccaaaaatataatcctggaaaagatcatttgaaaaattacttaaaaggtattttttgacatttttaaagggggtttctctgagaaacatataaaaacacaacagaacactttttagagcacttttcacaaataggcaatgataacctatatttttgcaagcataaaccccaggtgtactaacaacagtcatatggctgtaacaggtacaagcagactgtattcataggtcagaaatatataaatgcatgtcmctgtggttgctaattatgggcactcagctgtataacacctgaaatacagtgacgaacaacttcagtcttttgacaagactgatcaaaagctgtgatggagccagtgtgtggcacacaaccatagtcccagctactcagaaggccacgtcaggaggattgctcgagcccaggatttccaggtcagcctgggcaacataatgagactctatatctttaaaaaaaaaaaaaaattgcaaatacgatgggtcaccatggcctatgaagttgccaaaagagctgagaattttttttttttttttagacagggtctctgtggctcaggctggagtgcatggctcaatcacggcccactgcaacctccacctcccgggatcaagcgatcctcccacttcagcctcctgagtagctgcaaatacaggcacagactaccacgaccatctagtttttgtattttttgtagagaccaggcttcaccgtgttgttcaggctggtcttgatctcctggattcaagcgatcctcccatcttgacctcccaaagcgctggaattacaggcatgagcactgcgcccagtgagagctggagaaattttatctttcacaaacgcagatgttcatttattgaagaaatttcatgaaatttgtggactgtatgtaagtgcatacagaatgaatttccacatacccaaaacaatgaaaaagcctggcacagaagatgggaaaattgatctgggcaacagtggctcatgcctgtaatcctaaaactttcagaggccaaggcaggtggatcacttgagtccaggagttcgagaccagcctaggcatcacagcaagagaccccatctctacaaaaaaaaaaaaaaaaaaaaaaaaaattagcctggtgcagcggcgcatgcctgtggtcccagctactcttgaggatgagatgggaggatcacttgagcccgggaggtccaggctgcagtgagccctgatcaagccattgtactttagccttggtgagagtgagacactgtctcaaaaaagttgtgggggcagggcaggcgtggtggttgacgcctgtaattccaacacttcgggaggccaaggcgggtggattgcttgagctcaggagttcgagaccagcctgggaactgtggtgaaaccccgtctctacaaaaaagttaaaaattagccaggcgtggttgcatgcacctgtggtcccagctactcgggaggctgaggtgggaggatcactggagcccaggaagtcaaggctgcagtgagccatgatcatgccactgcattccagcctggttgacagagttagaccttgtcttggctgggcacagtggctcacgtgtgtaatcccagcacttttggaggctgaggctggaggatcacttgagcacaggagtttgagaccagcgtgggcaacatagtgagatgccatctctataaaataaaaaaagattaaaaaataggaaaaaaagactctctaaaaaaatacaagaaaaagggaaaatctaacaggaaattctcatgttggtagatattgacataggcagtgcttacagtgttgtggtaatgtactttgatggagtcaagtttgcaaaaaatgcataaaactaattagaataatgctgacaatgtaaaattgtgggaaaaaacttttaaaaattttgacatatgaagaagtatattagttcagggctagattatggatagttgcacagagatagtccctaagagctggccaacttccacgatcattatatttttgagttttgcatcatggcgcatagctgcttttttccttttaggatgtgcctctccatagagaagaagttcacattccttttctgtgtgacgctgctcttttagaaattcttccgtgattcagggttcgccaacatgagttatttcccattaaatttccccagcttctgtgccatgcttctttattgttttgggtacttggaaatccattctgcattcgctcaggtacagacctcagatttggtggaagcaatactgatgatggaaccgcagtactatgtatcttaccctaccatgtgcatagctgtttttcatccagtaggtaacttcactggcttcttcacacaaatgtggctcttctcattaaaagctcctggaatgtcagccaggcacagtggctcacgcctgtaatcccagcacttcgggaggccaaggcgggggaatccctgaggttagaagttcgagaccagcctggccaacatagtgaaacacccatctctactaaaaatacaaaaattagctgggcatggtggtgtgcacccataatcccaactacttgggaagctgaggcaagagaatcccttgaacctgagaggcagaggttgcagtgagccaagatcgcaccactgcactccagccttggggacagagtgagcctccatctcaaaaaaaaaaaagcttctggaatgtcatcagttagatggaatgccagtgcagacaaatgatgcagttttattttttatttattttttatttttttgggacagagtctcgctcttgtcacccaggctggagtgcagtggcatgatctcatctcactgcaacctctgcctccccggttcaagtgattcttctgcctcggcctcctgagtagctgggattacaggtgcccaccaccacacccagctaattttttgtattttattttagtagaaatggagtttcaccgtgttggccaggctggtctcgagctcccaacctcaagtgattcaccccggcctcccaaagtgctgggattacaggcgtgagccaccctgccgggccaaatgatgcacttttaaactgaagtttcatccttgccgtatcacgtggccaatccattcatctgacttttttaccaaatgcattgagctgaatggaaaaaacaaactttattggtaatatcctgaaattcactttcagaagccttgatggcaccaattccaaatctgtccttatggtttgggattcaagtgaaacctatttcctcctgcaaagtccatcaaatcttaaataagtttttatagtaaagtgctttacttttttcagcatttgggattatggtgtttggaattgtgtctttcaggattatgatccaaacccatgataggtaaaaatgtattaattttaagttctttggctataataatgtgggtcttcaaaatgtgggcttgcaacttgagagactcacacagtggcgtctgtctgagggagcaaaggagcaccagattctggattttttaactgtcatgaaatatacataatataaaatttgtcatcctaatctttttttttttttttttttttttttttttttgagatggagtcttgctctgtcgccaggctggagtgcagtggcgcgaccttggctcactgcaacctttgcctcctgggttcaagtgattcccctacctcagcctactgagtagctggaactacaggcatgtgccaccacacccagctaagtttttgtattttagtagagatggggtttcaccatgttggccaggctggtctcagccaggcgcagtgtctcacgcctgtaatgctggcactttgggaggccaaggtgggtggatcacgtggtcaggacatcttagccaattttaagtgggctgttcagtggtgctcagtacattgacattgctgcgcaaccatcacgaccatccatctccagaacttttccattaccccaaactgaaactttttacctattaaatacaaactcccacttcccctggcccccaccattctactctccttctctatgaaatgacgactcccgactcccggcacctcatgtgagtggaatcttatagtatgtgtcttttgtgcctgacttacttcactagcagagtgtcctcaaggctcatcatgtcgtagcagatattagaatttctgtccctgaatattagaatatgcagcctttaagaaggctgagtactattccatcgtgtggatagagcacattttgcttatctaaacttttgtcaatgaacacttctgtttcttccacattttagctattgtgaataatgctgctgtgaacgtggacatacaaatgtctatttcagtccctgctttcgattcttttgggtatatacctagaagtgggattgctggactatacactaattccacgctgaaccgtcataccggtttttcagattctgaacgttttattcatttaaaatattgttgggccaggtgcaggggctcacacctgtaatcccagcactttgggaggctgacagggaacacatgaggtcagttcaagaccagcctgagcaacatgatgaaacttcatctttgctaaaaataaaaaatcagccgggcatggtggtgcacgcctgtaatcccagctaccagggaggcagagacacgagaatcacttcaacccaggaggcagaggtcccagtgagccaagattgcaccactgcaatccagcctgggtgacacagcaacactctatagcaaaaataaattaaattaaaatgttggctgacttgatgaaatctttttttccttttttttttttttttttagagaaacagggtcttgctctgttgcccaggctggagtgcagtgccacaaacataggtcactgccgcttcccgctgctgggctcaagcgatccccctgcgtcagcctccccagtagctgggactacaggcgtgcaccaccatacccagctaattttttttaatttttatagaaacagggtctcatattgaccaggctgatttcaaactcttggcttcgagtgatcttgccgtcttagcctccccaagtgctgggatgacaggtgtgagcccacctggccctaaaagccctttctaaaggcctccaaacatcctagtgcgtaaggactagatccttacttcctagwgatgtaaggactagaggaaggaggctagtcctaggagcagactagccccacctccccagcgggggagccagcaggtaggctgctgggcaaggacttcactgcaaggagggacagggtgggscggggggacttcccagttatgtcaggtttcaaaatatatttggggaataaaaatagggtgcttggggccaggtgcggtggctcacgcctgtaatcccagcactttgggaggccgagggaggcggatcatgaggtcaggagattgagactatcctgactaacagggtgaaaccccatctctactaaaaaaatacaaaaaaattagctgggcgtggtggcgagcgcctgtagtcccagctgctcgggaggctgaggcaggagaatggcatgaacccaggaggaggaggttgcggtgagccgagatcacaccactgcactccagcctgggcgacagagcgagactccgcctcaaaaaaaaaaagaaaagaaatatggtgcttggttcttaattttgcagcattcaggacattaaataagtcatttgctgtcaccatcctttcaaaaaaaggacattttatcatagggaggccgtaacatcagaattgccctacagattcaaaactggctttctgagaacctcactatatggttttttattgtttctcagaggatttggtgatatctttgccaccaagtgacacttgaaagcagctgggctctccaggatcagctagagaatttgaggcccatttcaatttttatcaagaatttgaggctgggcgcagtggctcacacctgtaagcccagcactgtgggaggctgagacaggtggatcacctgaggtcaggagttcgagaccagcttaaccaatatggtgaaaccccgtctctactaaaaatacaaaaattacccaagcatggtggcatgtgcctgtaatcccagctacccaggaggctaagacaggagaattggttgaacccgggaggcagaggttccagtgagccgagatcaggccactgcactccagcctgagcaatagagcaagactccatctcaaaaaacaataaaaaagaatctcaagatggtaagagcagaaccgagcatgggccccttctgagcactgggcctttgcaaccgtagagatccacacccatgcagccagcgttggactaggagacccctgaggccccctccgtgcccctcttctaaggttcctttctcaccaagaagctcagcagagagttttgattttgcattatcaaagtcagtgacattgagcaagttaaactctgtgtcgatggtagaaaataaaacatctgaccagtttctgcctcctgatcccattagtgataggtttggtgattttaatgaaagaatttcacttagcttgttaaataataatgctttccttactctggagaattaatttatgtattcatgatgaatcattctcatcagcttcccagctacacagccaaacttaggggggaaaaacacctagtgggtgtatagatttgactctgatatttttattgtttttcaggttaagattagttgaggccggatgcagtggctcacacctgcaatcccagcactttgggtggccgaggtgggcagatcagttgagatcaggagttcaagatcagcctgcccaacatggtgaaacctcgtctctactaaaaatacaaaaaagattagccagacgtggtgtggtgcacacccattgtcccaactacttgggaggctgaggcaggagaatcgcttaagcccaggaagcggaggctgcagtgagccgagatcgtgtcactgcactccaccctgggcaacacagtaagattccctctcaagaaaaaaaaaaaaaaaaattagttgagaaagaaaacccaactgttgtgcatttgttggattttctctggaaacgccatccagtctgtaataaaatttcagttgtcattaccctggatggaattcatcttggctggagtgagtggcttcatgcagggcaaccccactgcaaagaatgtgagcatcagctaggctgacacaggggtccgcagacccaggcccctcattccatcagtttctttcagcatgtttccatgttttcatattttgaaaaaagtcaaaatccaaattgattttcaatgtgtttccctttggttattccccactcccatgcctgtcctctcttaaaatctctgttgttggtactgtttgtttttggctgttggaactgytgtgatcccccaccacaagcagattaaaaggtataccacattaagaagactccttattgttccaaagcaatggtcctatgtctttaaacaataatattaccacaggccgcagttcttaaagccacttggcagtttttattggaagcctacttggagttctctgcagctttttctgaatgtgtcgccgtgtcatagcctgcgaccttctctttctcaggtttgacagccacttagccagcaaatccctgagaagccaccggcctgaactgggccctctgcagtcactccggcctgtccccgcctcttccgtgtgagaagagccttggctgttcctctccctggtgtttaaagggcgtcggtgcacgtacagcgagggcttacatccactttacgggatccggagcggaggaaaagggccatttctcttcccttatctgtttatgatgcgatatgttccaaagccgatcacatcagccgctgttatggtgaacggaattcactgtgatggcggctgcaccagcagagccgccgtgggcttcatgccacgttacgcggagtctaggacggcctcaccccgctggctcgggctccctctcactgggtacacatttatcgggatttatgctttaaaacagtagttcacattttttctaatggtgaagtacagaaacttccattctgtgtgtgactagcatggcttagctatgtttctgtgcaaacatactcacacacagtttccaaatgaaktcacaaacttcccttataaaacttcctttgaggctgggcccggtggctcatgcctataatcccagcaatttgggaggctgaggcaggcagatctcttgaggccaggatttcgtgacyagcctggccaacatggtgaaaccccgtctctactaaaaatacaaaaattaggccgggcrcggtggctcacgcctgtaatcccagcactttgggaggccaaggcgggcggatcacaaggtcaggagatcgagaccatcctggctaacacggtgaaaccctgtttctactaaaaatacaaaaaattagccgggcgtggtggcgggcgcctgtggtccgagccactcaggaggcagaggcaaggagaatggcgtgaacccgggaggcagagcttgcattgaggcgagatcatgccactgcactccagcctgggcgacagagcgagactccatctcaaaaaaaaaaaaaaaaaaaagttagctgggtgtggtggctcatgcctgtaatcccagctactcaggagactgaggcaggagaatcacttgaacccgggatgcagaggttgcagtgagctgagatcgcgtcattgcactccagcctgggcgacagagtgagagactgttaaaaaaaaaaaaaaaagaaagaaagaaagaaaacttcctttgagcagaataataaaggtgcctgtgttaaatgccgagtgggtaaaacacgtctgcaagtggagaatggcaggaaggggctcagagacacaatgagactttgtgagttaagggggtgtcactggcgatttttcctgtaaacgtcccgtgttttgttgtgttgttttacaacagattagaaaatggtggggaaatactaaaaataaaaatatgtccggctgcttctggaacattctggatgttttgcctttcgctaatagtgtaacttttttttcaaaagtcattgtcttaaaagacttcaaaattgctttctgttctcccaccgcaagcccccgccccacctcttggctctgcctatcccctcccctccggggtttctgcccaccccccacccccaggcctggcctcctgggtgccacatctccagggcccgacccattaatggcctgcattctgaccgtgactcccagaagactcagccccctgcacagcgcctcctccctgctccagacagcacatgtgtcgtggaggggtctccctcaccaaaaccagcacctctgtcccgttccatcctccggcctcacctccgcccactgcctcccagaaaaaggaaaaatctctacaccgaggtcactggtcagtcaccccgggtgccaagctctgctgtttctaaaggcatggtcccacccattggtcacaagccctgagcacccagtttggggcatgttagcccccaagggggcagctgggctggctggtcctcattttgttcacagcctgtgcagtctgaccctgctgggccactccccgccccccacctcagcacaggctccatctttttctcctgggccccttgtttgtttgtctttcttttttcttttcttttcttttcttttttttctttcttttctctttttcctttctttcctttctttctttcttttcttcttttttttccccctgagacagagtcttgctgtgttgtccagagccggagtgcaatggcgtggtctcggctcacagtaacctccacctcctgggttcaagcagttctcctgcctcagcctcccaagtagctgggattataggcacccaccaccacacctggctaaatttttgtatttagtagagttggggtttcaccatgttggtcaggctggtctcgaactcctgacctcgtggtctgccaacctcggcctcccaaagtgctgagattacaggcgtgagcgacatgcccagcctctcctgggccccttctaggcaccccgccatcctgtctggctcctgtccccaccctgccctgtgcgtttaccaagggctgacccaggcattgagccacatgcacaaccgccttacgtccttactatgtccctgagatgtggagggttttatcccctttttgcgggtagggaaattgaatattcaaacccaggcctgcagcaatgtgaaaccttaggtacttcccacttgcatttaggtggggggccttgggcagtgggtctgccccaggagccccgcaaggcgggaggcctgtgtaaaggcctgcaggaagaggctgagggcccgctccagcagccggggcgctggtagggccaggcctgttggctgctgtgagagatacgccaccaggccaggctgacatgggcagttccagtttcccaaggcagtccagcctccagcactccatcctgttccatccccagtgccctctgactgcacggggctgagaagtcccccagcggtgctcctagacaggtggagacctcaatcctgcagcctcatcaaatgactccccaacaggggtggatcctgcccctcgaccagcacctgtgctgtctgcccctcacaaaatccttgtcccttctcagattccttgggggcacagggctgtgagggtcaggaccaccatcagaatcccttacaaagccacagccctctggcctcttagagaatccaacttgggttacaaagacaagcgtgcacaggccaggcgcggtggctcatgcctgtaatgccagcactttgggaggccaaggtgggtggatcacaagggcaggaggtcaagtctagcctggccaacatggtgaaaccccgtctctaccaaaaatacaaaaattagctgggcatggtgatgcgtgcctgtaatcccagctactcgggaggctgaggcaggcaggagaatcgcttgaaccgggacccgggaggcggaggtagcagtgagcccaagttcatgccactgcactgcagcctgggctacagagcgagactctgtctcaaggaaaaaaaaaaggactagcgtgcacagagccctcgaggtaccagagcagagctgtggatgcccgtctaagcctgtgcccatagctctgactggatttcaccaactccactctggcaggttagcatcaggagagacactgtcctggctgctgggtgggaagataaagctgagttccttctgtctgtctcggtgagagaaggcacggccctcacccagggcagcagagatcagggctgactttccaagccagcaagacatgcattcaggctacctacaaggaaaagcagttagattcgagcaaagtggtgaattggtctgaatggaaaaatccaaaacatcccactttaagaaccctgcatgcacacagtcttgcgtcaacttcagttttaacacgatagccaggtaagggggaaagatgggcggagcgggggaccaaggacagagaggaagacaaaggctctgtgagctgtgcctgctgtaacaaaatacacaacagaaagtattcctcacacttctgaggaatgggaagtccaaggtcaaggtgttggctgattcatttctggtgaggggcctcttcctggcttatagacagatgcctcttgcagtgtcctcatgtggaggagagaggagaggggcatctctcgtgtctttttttttttttttttttttttgagacacagtctcgctctgtcacccaggctgcagtgcagtggcgtgaactcggctcactgcaacctccgcctcccgggttcacaccattctcccgcgttcacgccattctcccgcgttcacgccattctcccacctcagcctcccgagtagctgggactacaggcgcccgccaccatgcccggctgattttgtttttgtatttttagtagagacggggtttcaccatgttagccagggtggtctcgatctcctgacctcatgatccaccctcctcggcctcccaaagtgctgggattacaggcgtgagccatcgtgcccggcccctcttgtgcctcttcttataagagtgagaatcccattcatgggagtctactctcctgacctaatcacctcccagaggtcctgtcaccaaacaccatcacacagggggttagggcttcagcgactgactttccggagcacacacacaccagtgctcctgttgcccctcccagggacaccttgcattgcagcaaatcactgttttctggctgcccttggctggctggctggcagcctttggggccctaggcatcaggatgtctgctctgtttgtttgccaatttcaaagcacataccggaatcagtgtggctggagctggagaggaccttggttttagaactttgattgaagcctaaggaccgttggtccatctgcagagcagcagtgaccaagcctctcttggcctttcctagcatgtcatccaagcctgagtgggaagcggatgtccatatgcagctcaccagagccggcctaaggagggttgatgtgcaggcactgcggcagcgcacagggctcaggacccctgggcgggcacctgtgtgccacccgggctgtcgtgtgcgtgactcggctagcccctgccctctgtgtgatgggcaccacacttcttccagccttgtggcatcccaagtaggcagtgaaaagcttcgagaagggtgggctctgggggccatgctgggattccaggaacccgagaattcacgtaagccaattctttcattctgggctcccatgaatgcatttggagaaggtggctggagtcacgcacagccagctggtgggcagggctctctkcaggccatgggctcattttcccacctgcgtaagtcacggtgctggtggtagcaggatggggtctgcaggtctcgcaggagtaggtcaagaggaccaggcaaggtctggcttcctgatggggacccaggagagagaagccaagaacccctgctgcctccttacccaactgcatatcacagagtgtgctgggccccgtggaggtggctgcagtctacaagggggtggctgccctggcctatggtgcattttacagatgtgtcaacgtgggaagctgggccaaggccatcctgtgcggaggctcaatgagagagcaccctgggtagggtctggacctgctgtgtgggcctcttgctggcaggcagctctctgttcccgaggttgcagcagctgctttctgtcctctctttacccgttcccccccgccccacccccgccagcggattctcctgcggaacctcaaacttcagaggcagcaggccttgaatcattgagcctccagagggaaaactgaagcctgggagagggtggctgyccagggccccacagccaaccatgtccttgcccagagaggcctgggtccctcctcctctgtgctgggtgcttcctgagtgcttggcacatctagacaccaaacagacccttgggtctgagctgactgggttcactagctagcctcacgcatcctccctgccgggctgctgtgggctgctgtcctggtcccacatctcctttttgcgcgctttcatgattcytcagacagtctccataggttgcctcaagactctggaagaatgaggttgcatatgcactgtgacttgtatccaggaatattatcctactcaggctggtcaggtactcaacaggcagggagcgctagtggcagcaaagccacgagtgccccaagtctcaacccgaacctcaggcgaaggtttggggacaagactaagctcagctcccagtaactggccctccccttgcctcaatcccttctggaacaacacaggctgtgccagcctgmacagggcagtgcagaatcaggaaaacctggctggggccagagtacccgggcacatcctcgctctcctgggccgcctggggcctgcacctgccgggggatctgccagcccccatacctgcggcygggcacatttaactgtgacttgcagaagtaataagcctaatatggttgactttatttaattaataatgatcctcttctgttcctctgcgctcataaaacaccctgcaggttggcaaaaacactcataatattgatcagaagtcaggcgggatatttattttgtctttgccccactagcataaatycttgtccactgcctcctsctccccgcatgcgggatttacagtggccagcttcttaaaagcattcagtaattaaggaataaatatccattggcctttgtgggctgtgctccgtccctccgcctgaccccctagcaacgcagctcagggagaaggcatgcatgcaagggggaggcagctgtcagcgcccgctcgcagtgggccggggtcttcccctaccgagaaaggaagcccctctctcttcctcacgtattgttccagccccctcttccatgcctcccctcccagttcctgttttgcttgaggcaggaagcactctggaaattccttgctgctagccctcttttctctccttcctctgcccttcctctcctccttgtcagtttcaacaccaggcgggcgggtcccctccagtgtctgctcctcaccctgagggtgttcctccacgccagcccgctctgctacagaatctccttgaaaatcactgccaaactcctctcccacctgttggcgggggcagggcagctgtttccaaaggaaagactgtgacaagtggcgggcacacagacgcaaattcttcttttggccttttcgcactggaagagagagggggttccaataaaaatgagcacattagacttgacctggagtgcactttcggraagrggtgttgctcagtgttttgtagacgtgctcagaaagccacatttgtgagatttgaaggctgaggatgaaaccaccaagagactgctttacagccccccagagcgccccagccctgccacacacagcggcccctgtgaggactgaggtggacrtctggctgcccgctctcttgtctgtgtcccrttcatctcccagaccccgccacaagacagtgctgaaaggcagtcagaagctttgtggttatttgcttaaaactttcttttctgggaatccaacccattaaccttattaccccttgacaatgtgctgacccttccctgccaggaccaaaacacagctgatggtggctgtgtgagacctcatctttgcagctctcaaatgcatgaggaacagagaatggggcattgcaggaagacagcatttctctctgaaggtagttgtgtgtaggtgtgactctccccgcgctctccaggtgtccccagaggtcttggtctatgctttgctcatcactgacaaggatttgccagtgcatagatgacagtgccaccagcagtgaccaagctcacctctgggactcagctgcctggtcagcctgaccccgccctgccgagcacctcattcccgggcagcacttctgttttgggtactggtatctatatgacttgccttttccttttagtgatctcctttctcttcattctaaaattccatgaattattattcatctttgtaattattataaatatttataataataaattatagatagttttgatagggaagaagaggaggaaggaaaaactgagatgatctagatccgtgcatcctctgtaatggcagaagtgttctcgatcagcagccttggaaatgtcctagtcagcggcagcgtcggtgctctggaccggcagccatgggaatgtcctagtcggcagcagtgtcggtgttctagaccggcagccgtgggaacgtcctagtcggcggcagcgtcggtgctctggaccggcagccgtggaaacgttctggatccgagcatcccagggtagcagctgccaaccacatacttatgtaaagcactggaaatgtgtctaaaggaactgtgtttttaatgttattttgtttcaattcacgtcaacacccacgggcagcttacagctgccccattggggggcacacctctagattcttyctctgaagcaaaccctacctaacccttcgtcagagaccagaaccaagtgttaagatggccaaagggagagcatgagaaaatgatgctgtggatccacctagactctcaaagcccagagagtctggttgtacagatgggaagatgtttcctaatttgggaggcatcagatccctgagcaagaggtcagacagtgccagggcagccagtctgtcgggtgtcccagctggggaccctgggcagtgttctgtatcactgaccttctcctctaagatgggggtaagaataggaccttcctcactaggtgttgttagaattaaaccaggtaattgtgtaaaaggttcagcctgggctgggtgcagtgactcacacctgtaatcccagcactttgggaggccaaggtgggaggattgcttgaggccaggagttcaagaccaacctgggcaaactggtgaasccactgcactccaacctgggcaacagagaaagaccctgtctctaaaagaaaagaaaaagacccccttctctacaaaaaaaaaaaaattgaaaattagctgggcgtggtgatgtgcacctgtagttccacctacttgggaggctgaggcaggaggatgacttgagcccgggagttccagactgcagtgagctatgattgcgccactgcactctagtctgggtgataaagccagaccctgtctcaaaaaataaaaaagcctcaagtcagtggttggcacattgcaaatacttgrtaagcattggctgtgaacattactgatacttttcctagtctgcataacagagtttgtctaatagtgactctacatttatataaatatatgtccatgatcaatcacctaaaacccaccatttggctcatgtagcattgtaaataaagatggagaaattatgcagaaaggcctttgtttattattgtcttagtcctctggggctgctataacaaaataccttaaatggggtaatttataaacaaaagaagtgtcttgctcacggttctggaggctggaaagtccaagatagaggcaccggcagattcggtgtctggttagggttcggtctctgcttcatggagaatacctcattgctacgtcctcacgtgatagaagaggcaaaccagccccctcgggcctcttttataagagcactaaatcccatttatgagggcagggccatcatcacctagtcacctcccaaaggctctacctcttaataacatcaccttggggagttaggatttcagcaaatggatttggggtgacacaaacacacagcagtgataaaagagcagactttgttgataaatccgtgcagggaaggcaccctcactgcagtgtttccagtcactgggatgagaaagggccgatcccagctgagcgtggtagtgcatgcctataggcccagctactcaggaggctgaggtgggaggattgcttgaatcccaacctggacaatatggcaagacccctatctctacaaaaaaaaaaattatgcaggcatggtggcacacgcctgtagttgcaactgctcaaggggctgaggtaggaggatcacttgagcccaaagcaatccagcctgctcaaacccagcctgggcagtatagcaagaccctgtcttaaaaaaaaaaagagagagaagaagactgggcactgtgtctcaacacttgtaatcccagcacaaagcaggtggatcacttgagtccaggagtttgagaccagcctgggcaacatggtgcaaccccgtctctacaaaaagtacaaaaaattagccaagcatggtggtatacacctgtattccaagctacttgggaggctgagttgagaggactgcttgagcccaggagttcgaggctgcagtgagccctggtcaagccactgcgctccagcctaggcaacagtgcgactctatctcaaaaaaaaaaaaaaaagaaagggtccatcccggtatcaggcaatgtgaagtgctgggaacacacagacctgcccatggcatcccccagtcacttgaggacagataaaccatcacagttggttgttgccttttgattggagtcatcggcagtgttgtcacgcgactggtcttgctcaggtgcattctccagtgggcactgcagtgacggctcccacgtggtcttccctcgggcttttaccccaggacctgtaacaccaagacagagcccggtgcagcctgcatgtgatgattcgcccccaccctgggtccttgccacagagattgaaataaaagctctctggaggccaggcgtggtggctcacacctgtaatcccagcactttgggaggccgaggaggacagatcacctgaggtccatagtttgagaccagcctggccaacatggcaaaagcccatctctactaaaaatacaaaaattagccggacrtggtggcacgtgcctgtaatcccagctattcaggaggctgaggcaggagaatcgcttgaacccaggaagtggaggttgcagtgagccaagattgtgccactgcactccaccctgggtggcacagcgacattccatctcraaaaaaaaaaaggaaaacgaaagaaaagctctctctccccacaaccctgacttgcacattttcttctgtaaacataaatgcttctctccatcccccgttccctccctcctgatctgttcttcactctgccttggttctgtcgtcgctgggttggctgtcttgctgtctgtgcagcacctgctttctgttcacaggtgctgggagttgtatgacgctgggcaaactgggagcagcgtgggcatcccggcccaagctcaggggctcaggaggcaggaggcggcactcrcattcacacgcacacgcacagaacgctctccckctctctcagtctggtccctgggcaggttgaaggcagctcagcatccatctttttccagagaagagaactttggccctgctaggttgctggccggccaccttatggccccaggcctgtcctgaaggcgggggccagattgggagcccccctgcttccgctctgcagccctgtctggctgaatggtgtaaaattccctaagtctttccttccttcttgctgtgtttcaaagaaggaaaagccgggtctgtcagttctaggctctccactgtttttccccttttgaaacttgcaataaaatctacctgtctcttctttcctgcagcctttcttttttcccacgatttcccaaaatacggccaccactctgccgtcacgtgtgcatcttgttccacattagatatggagtttgttttgtttgtttttgagacggagtctcgctcttttgcccaggctggagtgcagtggtgcaatctcaactcactgcaacctccgcctcccgggttcaagcaattctctgcctcagcccccccgagtagctgggattacaggcatccgccaccatgcccggctaatttttgtatttttagtagagatggggttttaccatgttggccaggctggtgtcgaactcctgacctcgtgatccacccacttcggcctcccaaagtgctgggattacagtcatgagccaccatgcccggctggagtttgttttttaaaatgtgtacatgcttgagggtgttaccaggaatgatcaataaagtcagttactgtcatccttamscccacactaagtgctccggttacatggagattacaccttgccagctgagtcatgcagtggatttggcatggcaggcactaagtatgcgggtagcaggtggggagtgtccaagagaattgtctttgggatggacacagggaagccaccttggccaagtcaccacccctcaaggtcaggtgcggcaaagcccgtcaggcagcaatgctagagtgtctgtctccgagctggcagaccccgaaaaatccagagggttcacggctcctgcaacctacccagtgattcctatgtcctgtgctcagtgcctggctgtccctgtggatggcttcctgtcatggcccagagagaggtaaagagccacctttacctcttcttttaggcaggaagagaagcaaatataaaatacgatggcgcctgaaatgtaccttttctttttattttggggattgggtcagtgcctttcttctgatgagtcgcccattccctcattttccctcactctcctgcggctgatttatttaaaggtgtgtcagcaccacatcaaatgaggaactgggccccctcctttctgctgacggccggccgcgccaataattcattttttagctcattagctaacggaggctgtgarcggtgatcctcccggggattggaatgaggggaggtgatctactgccggctgcctgctcttgaactggccttccttggggaaaatgaaaggctcagccaagacaagccagggatcccagaagtagaattgcggcctccgagtgaccatttgagtctgtgtgctttgacatcatggcttcttagggcaaatgcctctagacggaatagtctcatcgagaakaagccattgtcagcgtgtcccttggtcatatgtgacttgcgtatggagacgctagtgagaaagatgaaggatgctatccagagtatgtgtcagctcasgctgccaaaataaagtattacacktgggtggcttaagtgcrggacattcacgtctcacagttctggaggctggaagtctggagtcagggtgcccgcagggttggttctggtgagacctctctccctggctgacagatggtgccttctccctgtgtcctgcctttcctccgggtgygctcagagggagagagacatcaccagtgtctcgtcctcttatacgggcacctggcttattgaattagggctctatctttatagcatcatttaaccttaattctcttcctgaagaccccatctccacatacagcaacattgagggttaaagcttcagcatgtgaattttatgggatacgactcagcctctaacatccaagaagcccttaaacatctcaaggctatgggcaggagccaaccagatgttgctcctgcaactctgacagctatgaggtcatttaaaccagccagactccttcttaccccagagtctcaggatcctctgcaccctcgggggagctcacaagatgccagcaggcttggcaagacctctggccaagagcatcccccctaccatgctgagcatgaggagttgcgtgaagctcgtatgtacacacagccgtgatttagaagcctcccgtgcccagcaggccttcggtacccgcggccccgtgccaccagcacttcccccacacgtgccgcttccacgggtgagctcctgtgtgctcacataacattgaattatcagagaggttgttttcttcagtcgtgacagccgctgtttgcaggggaaccactgtggccatggtgtcatccaaatgcgtgatcccaaatcccaaaacagccctgccttgtgtagatgtcactgtcctcatttgacagatgaggaaaagagggtccaagaagttattagaaaggcgaacgtctacaccactaagtcgagaaaaggcacataagccacagtctctctaatgcttaagagtgcagcctgtgagcttagtgttggtggggagattggcttttccctgcctttgggcattgcagaaagtacagggagctaagctttccccctggtatctggatgggagcatccacaggaggtggccttcaagtcacagcaggtggctgacatgcattagtttgctgaagtagcaccaaaaaacccagtgcccttgtctgagtcctgttttcrtactagtgaaatttcagctgctaacaagaatcacgtctgatgcagacacaaagcccagtggctgcccyaactccctggccacctcctactgtccragaaaacactgaaatatagcagtcccaaaggactcagaagtcagcattgaaagcttctgtttttgttttgttttgtttagacagagtctcgctctgtcacccaggctggagtgcagtggcgcaatcttggctcactgcaacctctgcctgctggatccaagcgattctcctgcctcagcctcctgagtagctaggactacaggtgtgtgccaccatgccaggctgatttttgtatttttagtagagacgggttttcactatgttggccaggctggtctcaaactccagacctcaggtggcccgcccagcctcggcctcccggagtgtgaggattacaggcatgagccactgcacctggctgcaaacttttgtttttttgtttgtgaaatggagtttcactcttgttacccaggctggagtgcaatggygcaatcttggctcactgcatcctccaccctccacaaggttcaagcaattctcctatctcagcctcccttttgtgggtttcgggcccacaaaacctggacctaccttttattacatagtttaaacaatgctgattttttttccataagttattggggtacaggtggtatttggttaattaagttcttttttttttgagagagagttttgctctgtcgcccacgctggagtgcagtgacgcagtcttggctcactgcaacctctgcctcctggattcaagcaattctcctgcatcagcctcctgagtagctgggattacaggcacctgccaccacaccggctaatttttgtatttttagtagagacagggtttcaccatgttggccaggctggtctcaaactcctgacctcaagagaaccacccaccacggcctcccaaagtgctgagattacaggcataagccaccacggccagccatgagtaaattctttagtggtgatttgtgagatcttggtgcacccatcacccgagcactatatactgcaccctatttgtagtcttttatccctcgcccccctcccactcttccccccaagtccccaaagtccgttgtatcattcttacaccttttatgtccccatagcttagctcccacgtatcagtgagaacatgcgatgtttggctttccattcttgagttactttccttagaataatagtctccagtctcattggaggtccctgcaaatgctgttaacccattcctttttatggctgtgttgtattccgtcgtatatgtatatacaccacagtttctttatccacttgttgattgatggccattggggtaggttccacaattttgcagttgtgaattgtgctgctataaacgtgtgtgtaagtatctttttcaaataatgacttcttttcctctgagtgggtacagtagtgtgattgctggatcaaatggcagttctactttcagttctttaaggaatctccacactgttttccatagcggctgtactagtttacattcccaccagcagcgtagaagtgttccctgtacaccacatccacgccaacatctaccgtttttagattttttgattatggccattcttgaaggatgaaggtggtatcaacaatgctgatttttaaaagtaaagaacagctcattcaaatgtgtatcagcttgtcagttcggatgaggttgcctatgaggtgagatgtgaggacagagaatcactccagcagttcccggggagaacatactgacacagygaagggttcaggagccgcaggttcgtactcattctttggctggggtgtgggaatattaaaaagaaattgaatacttgcagttagcactgtagctactagttcagttatgtggtttatccctgggtgatttggcaatgactattaaagtcaatcggagcggaatcaaatagtygtgggattttaatgtctaccaaaaaatgagagttagcaaattggaactggaaaatctggacgcatccttcaccgtcatcccttttcatttaattgacgttttgctccttctcttttgtgatttatgaaatgcatcaacaaacgtttaatacattttaaataaggcctttaaaatagtatcagaactgcttctttttgtctgtctcctgaacccgtatttcccagacattgtcagtgcttttgtgcttgtgtttttgcccgagtggggtgcaggggctgcctccgctgcatttgtsggggccggtgtcagttctcagctgtagccaagtgtttgtcctggaaatctccaaatgaaaagagtcgggggtcactctggggtcactcacatgtaccaggaagtgaagcaaaactaatccagatttactcctggaagaatttgtttgccttagtatttaaaaacagattagggctaacccgacactagatcactaggtgcaatgtaaacacgggtaaaaggtgtaaacaaggcctttcctctgtacttcggaagcagaaatgtcatgggtaatgagttttctttctagactttcgcggaagccctgagtgatttctccgtgtcatttgtaactgtgtactctgattattcccctggagaaacctgaattttggagagggcgattgtgaatcagtgcgttattaaagtctctatgggtaactgcagtcccttcttacatgtagggcttttctttcttttctttttctttttttttttttttttttcgagatggagtctcattctgttacccaggctggagtgcagtggcgcaatctcagctcactgcaacctctgcctcccgggttcaagccattctcctacctcggcttcccgagtagctgggattacaggcgcctgccaccacaccggctaatttttgtatttttagtagagacagggtttcaccatgttggccaagctggtctcgaactcctgacctcaggtgatccacccacctcggcctcccaaagtgctgggattacaggcatgagccactgcgcccagcctcttttctttgtcatcctcatcaaaaaggcaggcagggagcacttccctggctgggcttggctcctgggatccttgtaaaatttcaagagctacttgtaaaatctcacactgttctttgtaaatttcttgtcccccaccaccctacctttttttttcccctctagcggtgctgcagagtcttgagttttcagtatctgtcacgctcttttttgagaaaccagaaaccatcatcagtagccacaaagtacaggagctgctcrcctggggtccttcctttgggtcaacataaacatgccttactgttggtttcctcttctatttgttaagcttctcatctcatcctgtcctctccttcttagccctccccacagatgtgtagcagggtccccatcctctgtagaccccccaggaggagaccatgtattacactggccaggtcgggcagccccatctcagccaggttgtgatgctggggccggggcgggcaggcatcagcatcatccrctctccacacctccgaccccatccaccccctccccagctttgtcctctcctctgcctctgggctcagctctggcttctgggagctacctgcctgtttcccaggccctggaacagtttcccccaaaaaactcagccattcctgacattctgtcctttccacttaagccttccccaagtatctggagattccaaaagctgcatctccctgctaaacctcctcattggagtctccaccctctcctgcgtgagtctgttgccrtgttttcctcagctgaaagggtttggagaccctggggagtccacacacaccccctatttcggagtttgargctaaaagcacatggtcacccccaggtgtggggagcgcacyggctgtcccttccccccacccccggcccagctccagccaagtgtcctatagccctcacttacagtcctgcttacagtaaagcaactctcggccccagagaccatgcttccatcgtgcggtccgtgctctcggccccggagaccgtgcttccatcgtgctggtcccaggcagtagggtggtttcccctgtgcatcggtgtgtgagagccactgatccaaggccatggccttgagccctcacttggtagttttctttccaaggacagcttctacactaaaagtgacagaagcagcaccaaggcagtgtatgagcctgagatcagcggctctcacaccttgggcctattggaatcccctgcagggcttcttaaaacaccccgagaggtttggattcagggggtctggggcgtgacctgagaatctgcatttctgggctgatgctgctggtgaggatactgttttgtgaaggtggataaacgtttcccccagggggctttgtgccgagtgaagacctttgctttctgttatttcacttccctctcggcttctcccgaccacactgggcaggggctggcagcctgtgttctcgggcctgatcgtgactgcacctgtctggtggctctttgcagggaagagaaggaacggtggatccgtgccaagtacgagcagaagctcttcctggccccgctgccctgcacggagctgtccctgggccagcacctgctgcgggccaccgccgacgaggacctgcggacggccatcctgctgctggcacacggctcccgggaygaggtgaacgagacctgcggggagggagacggccgcacggcgctgcatctggcctgccgcaaggggaatgtggtcctggcgcagctcctgatctgggtaggtggtcggyacgcctggcagaggacggggccacaggaggcactctctgctttgttctgcttccgtggrcatctttctggcagaaggctgttgttctcgatctgcaagtggaaacagttcctaatgggaaactctgattgaagagcagagggccttacggagagacagccggtcctccttgtacagtacttgctagagtttctgaaaattgcaactttgtgattgccccttatcaagcagggttggtgctatccctcttttttcatttccatcatcttctggagagaaggcggtgtattaacgggatggcttgtagggtttccccatttccaaacctttggtgtttttattcacttaacacagaaatactggaccctaaactttgaggtctgatgtggcaggagtttgtcaaaggacttctttcgaaccattctgattaatttctactggggaaaagtattatttacattcctattgaagcatgtgtcacaatgcttgaaggagtgaaagagaaggataaagtggttgtgcagagaggccctgcctgtgccacccaggagctaygtctgagaagccacgcccacttaggggctgcctgtggacccctggggcttctgctgaggcaggttcccaccagaggcaggcagaaagctgccggcagggaggctccccagatagggaaggcaagtgtgtgcccagaagtggagacagcacccagaggtgggacacccagctggaggctcttctgtctccacccgcaaggcaggatgggtcagtccagcacagcagcacgttctacagcagcatgggtagagtgcagcaggtttctgcatgtttttgatctgacttttttgttttttgtttttttgagacagagtctcgctctgtcacccaggctggagtgcagtggtgcgatctcagctcactgcaacctccgcctcccaggttcaagcaattctcctgcctcagcctcccaggaagctgggattacaggtgcgcaccaccacgcccagctaatttttgtatttttagtagagacggggcttcaccatgttggtcagtctggtctcgagctcctgacctcgtgatccacccgcctcggcctcccaaagtgctgggagtacaggcatgacccaccacgcccagccttgatctgacttttttgatgggtgcagttggtgaatgagtgagatatagacactacaccaaaatcacacagatactcccttttgctcatgagtcatacatgtgatgtaatgcacattaaataagagttgtgtgtagtgtgctagggctgccataacaaaataccacagacaggggtgcttcaacaacagacatttattttttcacagttctggaggctggaagtacaagatcaaagggccagcrggaatggttcctggcgaggcctctctcacggctggtagacggccgccctctccctatgttctcacagggcctttcctctgcactcgctcctggtagctctctcctttccccccacccccttctttttgggacaaagtcttgctctgtcgtccaggctggagtgcagtggcacaatcatagcccactgtaacctcraactcctgggctcaagcaatccccccaccctagcctcccaagtaattgggaccacaggcatgccacccccatgaatggcagtttttaaaaaattttgtagasttacgttcttaccatattgcccatgggttttgaactcctgcctttaagcagtcctctcacctcggcctcccaaggtgttgagattacaggtatcagcctcccagcccagccttttcctcttctcatatagatactaaccctattgtgacctcatttaagctaatacaccaccataaaggctctgtctccaaatacagtcacattctaaagtactgggtgtcaggacttaaacatgtgaattgttggtgggagcgggggacacagttataaattacaggccatctttgcttctccaattgagcaaaaattcctttgatggcgctggttccatgctgttgagtggcctcagactcccacacattgtgagttggcagaagtggaagtgaattcactctttttcatgagcaaaaagcttaaaaacgttgtgtactttaacctcatattttcccccttctgatcatcactctaataatcaatcacagatcctaagaaagattctatgtgaggacatacatccgggcactgtttcttccagtgacaattttttttttttttttttttgagacagagtctcactctgtctcccgggctggagtgcagtggcacgatctcggctcactgcaacctctgcctcccgggttcaagcaattctcctgcctcagcctcctgacactagctgggattacaagcgtacaccaccatgcccagataatttctgtatttttagtagagacgaggtttcaccatgttggtcagtctggtctcaaactcctgaccttgtgatccgccctcctcggcctcccaaagtgctgggattccaggcatgagccaccgtgtccggctccagtgacaatttttacaaagtgtgcacagttgaggggagagttctgaattctgttcatgtggtggaatactgtatgacttgcatatgtcatgctttttgaggggtggggagacagggtctcactctgttgcccaggctggagtgcagtggtgtgatgtcggcccacggcagcctctgcctcctaggctcaagcgatcctcccacctcagcctcctgcatagctgggaccacaggcatatgccacrtgcccagctaatttttttaaaatgtgtttttttctagagacagggtctcccagtattgctcaggctagtcttgaactcctgggctgaagtgaaccaccgcacccagcttgtgttgtgcttctgagtaatttttaatgatgtaagaaaatgatcacagtatagtaatcaataaaaaatgaaaaaaatacaaattatttgtacagtcttatctcaattatgtacatatacatgtagattcaaagaaaactcattgaaaggaaatacactaattcacaaaggttatctctaagtagtaagattatgggtgattttttttcttcttgagctgttatgtgttatttrtgtatttcctayaatgaaaattctgagatcaaaacaatgattttctttgtgcaattggaaagtcaaaatagaaacagcaaaactaaagttatctttgattccttaatgttgcacaaaggaggggctttcagttgaaaaaaaaagacatgttctttccttaaaagaatccgctggccacgggtgcaggctgtgccaccagcactggatggtcctggcaccccagccagttgtgtagctggccccgctgtccaagcacaagccacatgcaagggctgagagaaagcttccctgccccctccctccatcacrtcccccatgatactaatgtgggctcccttacctccgcagtacggagtggacgtcacggcccgagatgcccacgggaacacagckctggcctacgcccggcaggcctccagccaggagtgcatcgacgtgctgctgcagtacggctgccccgacgagcgcttcgtgctcatggccaccccyaacctgtccaggagaaacaataaccggaacaacagcagtgggagggtgcccaccatcatctgaggaacagccgtgcccgcctgctcgccgcacctgggacgcggcagcctcgccgcattctcgctcagaagtcrcagcacgtgagtcccgtcgcatcccctccctcttcctggtggccacctccctcccgcccacccactctcaccccaaacaaaatcacaaaacctggacatcctcaaggggcgaagaggcggccgggagactgcagaagtggctccttttcataaactcccctaaaccacacacaggagagagcgacgggcctcggccctttgatgatagcacatggcgcaggacccttgtcctggkggctcaagggatggggacgcgagggggaggggaggcgaggaacaaggagaaggggcaactttccttaactggcagttgagcacatagtacatttcccctctaccaaacggaacacttggattccatctcttctctgaggagctcgacggcataaatcagaagcaagcacagagtttgtcaggtttgaagcccctatgatggtgtgtgtcaaatcagttgtagctaatctgtccagggagaatactggcttcattacacttgtacagccgagttcttcccgcattactgctgtttaatagaacgtgattagtcatcgccgagaagaaagcatattagccgaggaggtagtcacgcggcacgcgccggtgattgccacgatgtgattgcaatactcttagaagcaccatattatcccagacatgttctttcaagcccttggagccctctctaaattcactgtcatcatttagtatctgtttaatttttcagtccaaagagaggaaatcagtcgctgagtattatttgactccggtctccttggtgcaaaaacaaaatgggaaaaataaataagaataactcagaaactcaaaaggaaaccacaaattcagctaataatagcatttcgagtatatttcgtaaactaaggaaatacacaaaaggctgttttttccgactgtaagagatatttgatgtccttttgccgaggtggatgtgttagtctcaggccctcctggaccacgttgcccaagtcacacaggcttctgtgttatgtatttagataagatgtgtgaaaatatatttgaataaaagaagttcataaatatgcattgatttttgtacagacaaatggcacctctcttaatttataaattgaactggatgtgaactaataatgtgcaactagttgagataagagggttacagatcattgtacatggaaaatattcccagcagtaaacacttccattaatgtgatctacggcttttraaaaggagcatctcagaataagatggtggtacaatttgcttattaaaattgagaaagaaaaaaaaagacacactggagtatattagaaaggaaaaagaaggaatgtggtctctcatgattgaaagcatgatttagatcggatacggcttttgctaaccaaggaccaagggactctggcaagatggggtggttttccgaatgccagaccgaggtgccttacgaaggcagctgccaatggttctgtggcacagactggctcctgagaacccagacgaccttgacctggcagcccggccctccacgctagtacctcgcctgattttccatcgttgcggtatccagccgcttcagacgtccgccgccttcagtggtggtagtcaaatgtagtcaaccaaaccacagcatcccttaggttaaaagcaaacggggcagctttgcctagagctcattgacagtgtgatggggggagaagggttgtcacaatggaagatgaggacactagactcatgtagcacagaaacatgaagccacacgcaccggcagcctccggggtgttcctcgctctctcgtatgttaaaccttatattttataagagtttttcctcttatttcactttttaaaaaaaattaaagtaggtggggaaaaaaataaagctttacacagaatttatatgtgggtaagtgtttcatggaaatttctaatcttaacgaagctaagtggagctcactcgtatccaaaagtataacaggtgcagaagccacaagtctgagaaccttgacgacagttccatcgtcctgccatttgatttttcagtctgcgtttcatcactgtgtagctattgtaaatgtgaatagaaaaaaacaggtcattgcctatttttgaagaacgcgttggtgttcgagtccactagacacactcgctccacacagccttcaccgtagactctgtagtggacacagatatagcataaatgaaattgttaaattatttcattgtagttaattcccactataggaatgctttatcatagtgaagtttcttttgagaagaaacggaactccttgaggcttctctttgggatgtatatgagcgtgtacatattattctatgtgtttataatataatattttcccaaatgacttcttgtttcactttgccttccacaacctgaatgccagattggttttttcccttcctggcccccagcacaagctgccatgactccccctcagaaaacacagcccctcctctaccattctcagtgatgtccatctgctccactccgcagccactttctagggcccaagttttggtagcagaaggaaaggcagtttttgagggtctttcgaaaaaaagaagacggggcagctttgcccagagctcgttggcagtctgtttgtatttcagtgtctaaccagaagtcctttctttgcggaccgcactctcgttcccactttcaagctaattaccaccaaggctgggagaggcaaggactgggggcggagctaggaataactcgtttgagaagggggtggagttttcgttgttcatttccatgttcagttctgtgacgtgacgatgacagatcaccactgcaggatccccctcacctttcctgttcagaattaaaactctcccttgatgagaaacagccagctgagggaggcccacgagcggcctgtgtaaccccatgggtgatctggacacatctgcacccccgcgttcagcttcgcggagactgaacttggcggggagtggaggggtgtggtgcagacctggctgcagcagaaacaccccgcagggacagtactctgtgattctgacctcaggtgctgggacgggcagatggtttgccccgcccagcaccccagtcctggtccctggtccctctctctgtttcatcccaggaaatgagcagctcgagggtgagcaagtgacaagttcctgagtcactggccccaaaaccaggtgcagtgtcctgtctcccaagtgtgtgcacaatgtatatatgcactggaaaggagggagaaggcagcgggtcactcgccaatcgcagggttctcagacacaggagagagcgggatcttaatgaattgcatttcctgcagagcctctagtgcacaggccagttctcggcagtggcttttcagcacaagggccttgcattgaagctccctcttctgagatttcacccagcctgatgaggcctgcatggttccggcctcgtcatccagtgtagataccagtcttcctatttttgtgacatctgcacatttggggtcattccctatatctgcataggagctattgctaaccttgttagggagaaacatggtctaatgagaaagacagacccctaggctcagctggccctgccatccttccagaggattcctctgcaactctaggcaagcacccagcttcctgggctctttttcctcatctgtgaaacttgcagggtgcagtgaggtttcaaaccagtgtgataagtgttggcctcacacctggcccaggggatgctgggagaacaggagcacttgttaataacagaaacactgatgggaccgaagccagtgcacacaccaggaaacctgcccgtggctgacactgtcctccagcctgcattctggggaggctgtgatgggcacgtttgccaaccccccccccccagtagagcccaggaccctcctctctcagcttgccagtgccctgccctccacatggcggggaacagcatcaatgaggtccttgctccctgagagcctctctggaacctgcccacttttctcaacatgtatattctgctttgtagtctgaggttgattttctagaggcgaggaaggggctgagttctgccctcgtgctgttcgctggtgctgatcagggccaagacgacccttccctctcccccacagcctgttgaggtgccgttgacgtggacagcgcccctcccttaagatgcccccttgccgttgccatgagccgctgtgactcacgcgtgcactgggccttgcttggtgctcccctcctcctcctgtctgagatcggagcttgctggagagcaccccaggtcgccgtgcttggctgcaggcccgtccctctctccccatcctcgggttcccagcgtgttttgtgcttgaacttggtggactcatcttaccccacaagagtggcctgctcaacctgcagcctccaatgtgccgtaggcgctccaggtccccgtggcgcccaggacaccaactctccctccctgcacttaggatgttctggaaatgaggggaaatccacattcctgccccaggaggtgggaagcctggcaacgatgtagcttcccctgagatgcggtatgatcaggcctcagcaactactcaggaggcaaaggtgtttggaaagcaaaccccaaacctcccggcacggcatgtgctctgcttccgtccctcaccgcctgcacaaggtcgttgagacttttctagaactccccggggttgtatttatggccttcaagcaaacaaattgaaaagcagtcaaggaggagttcagatagaaaagtgctggagatacacatctttccttcaaaggaaatgtaatttatttccaaccgctgcctcagacgggggtttcacatgttgtgaagtcacatcttgaatgactgtcaccctcatccttccccaaaaagctaaataagggcctttggcatcaatgcgtgcattctccacctttccgcggcttgcgcttggatttctgagtggctttcttcagggagcccttgtggtcatgtgtctttaatgctgctccccatgcccccaggccaggccagcacgctcaggtgatagcgagtggggccaggagacccccctgccctgcccagtggacagatctgccccagccctgctgtggggacgggccctctatcatttaaccacatacattaggttgcttttcagcaaaatgtcagctttcctcccattatgcaggagagagaaggggcgcaggtgtatctccttagagtacaccttggagctggatcactaagaaacagtcctcagactggtccttccgacacaggcagagagtgaactggatcgctggcccctgggatgctgcgctgtctgtgattagagagaagtggccagtgtcccgtctgtgattagacagaaacccctgtggcagactcctcccctctccatgaagaaagaaatatttacttagatattactgtttcaaaacacaaactttattccccttagagaagaaatactgcccttaaatagactgttgaaatattaatggcccccccatttaatcagtgtgtctgcggctttcttcgcgtcacatgtccgcattggcaggtgattctggaaagggattctgggaaaccaacaagtcttttttaaatctttgagttgtatgagaaagtatttaagttcaccagtgtagtaaacacccaccccagagcagcggtaagcaaacctaaatctgaaaacccattcttactgtctttcaccatgagatgctggttttggtgtaaaatgacagcacttggtttggggttttgcacctgttgggtagaactgttcttgtctgaggtcctcaccctctacagatgggcctcagggcctggaggtgggcagatggggccagagtggccagcagagacttgcatgggctctgaaagccccagagctcaggcctaaggctgctaggtgagaccagcaggcagctgtggcatccgaccttgggacgcccaagctgggcagccgctccatgtgccccaaacaggatatcctcatgaatgtgaggagaggctggctcagggcttggttttcattttggcctggcacagggtacctgtagggagcactcccccaacctgaggatggtgaaaccatatgatagagactccttgtcgaagtccacatcggactgatctagaatgccccgtggggggattgcatggcctttgccttgagatgcaggtgaaagaaaggaaccaaacaaggcatgagtgtgttggggaatcttcccagtggagcaaacccccttaacacaccagctgttgggaacagctgcccctaaatccaattaaaccctcatctccctggtgctgaacagtctacactggcccaggaagctaacgtctgagccgcttggagagctttggtaaacagaagacactggaagcccactcggtcagcagctgggcatgaggatgtcaggggcctttggacttgaggaaggacagtccaggtgcatggaatcctaatgggcctcatgcagacactggaagcagcccagccccctgcccaataccacagccctggggtgtcccctgacattcctggaggtccctgggcaaatgcatttcctgcctgggttctcagggtaggagaacagagaaggctccaagggtgttgggagtgagccaggggctggtctggggagtgggtctcacgcactgctcaggttggcacgagggacctcccccatcccaacccagccccaagggtcccagcagggctctcagcatggctgttttgagggtacacaggtggctggagaggggtggggcagttgcatggtgggtggcaaagtgtgcatttagaagctgcttcgtggcgttaagaacggggggagagggaccagcactgtaacgttagaaataattccttcttgcagacttgaaaagcatcagtttccctcccacggctgggtttttgtgtctgaaatacatctaattctccagactgcagcccctctcagccccgagcacctgagcgctggggaggcccttattgagctcagcctggagaggggagggtcgcacgggtcccgggggcaggtctcctgcactggctcttcccttctgccagcttggaatttggttctcatcttgccacaggggtgcgtttcctaaagggcagccggagcagctcaaaggtgacaactgagatgcatttctaggca

SEQ ID NO: 12231 - DNA, 96239 bp, Homo sapiens
  misc_feature (1)...(96239): n = A,T,C or G, or insertion/deletion polymorphism (see Tables 1-2)
cctaaggtacgaaacgcaaaagatgcaaaagggtgtacaataaatattcacctccatcatctctgtcctcaagccaacaacttttcttgcctagaggatatttctacatatataagcatatgggaattttctttctcctatttttacataaatgatgaaataataatcatggttttttattttgcttttttcactcatcagtgtgttttatgagtacatattgctctgtctcattcttttttaatgactgcatagtaattcattgtttttctgcatgtacttttttttattttgagacagagttttgctcttgctgcccaggctggggtgcaatggcgtgacctcagctcactgcaacctttacctcccaggttcaagcaattctcctgcctcagcctcccaagtagctgggattacaggcatatgccaccacgcccagctaattttgtatttttactagagatggggtttctccatgttggtcaggatagtctcgaactcccaacatcaggtgagtcgcctgcctcggactcccaaagtgctgggattacaggcgtgagccaccacacccggcctgcatgtacattatttaattagtttctttaatcagtttgctatttccaacaatgctataataaatttccttaatcatatatcatttcaaacatctttgggtatatctgtaggtgaattccaagaaattcttttgctaggtcaaagagtttgtggatttgcaattttgataaatattgtaaaagtactatgcagaatggttgtgccaatttttacttgcaacagtaaagtgtgataatattcccacacccctcactaattacagtgtgctaaactttatgttatctgctaatatgataggtgaagtatggtgtattattattgtatttctcttatttggtgtgagattaagtatgttttatatttgcttactttttctattctgtgaattcctcatattctttgaccattttctctttcattacagatcttttttcttatcggtttatagttctttatatattaaggaaagtagcccttcatctgtgataagagttgcaaaattattccgtctgctgtttgactttctctatgtgtatgttttgctgtgcagattttaaaactttttcatgtagttgaagctatccttccttttttttccattatagcttctgagtattgtgttatacttagagaagctttctctggctgggcacagtggctcatgcctgtaatcccagcactttcggaggccaaggcgggtagatcagtttaggtcaggagttcgagacagcttggccaacatggtgaaactgagaggtgacagcgtgctggcagtcctcacagccctcgctcgctctcggcgcctcttctgcctgggctcccagtttggcggcacttgaggagcccttcagcccaccgctgcactgtgggagcccctttctaggctggccaaggccggagctggctccctcagcttgcagggaggtgtggagggagaggtgcgagcgggaaccggggctgcgcgcggcgcttgcgggccagctggagttccgggtgggcgtaggcttggtgggcctcgcactcggagcagccggccggccctgccggcccggggcaatgaggggcttagcacccgggccagcggctgcggagggtgtactgggtcccccagcagtgccggcccaccggcgctgcgctggatttctcgccgggccttggctgcctccccgcggggcagggctcgggacctgcagcccgccatgcctgagcctccccccgctccgtgggctcttgtgcggcccgagccttcccgatgagcgccgccccctgctccacagcgcccagtcccatcgaccacccaagggctgaggagtgcgggcgcacggcgcgggactggcaggcagctccacctgcagccccagtgccggacccactgggtgaagccacctggactcctgagtctggtggggacgtggagaacctttacgtctagctcagggattgtaaatacaccaaggtttgtaaacacaccaatcagcaccctgtgtctagctcagggtttgtgaatgcaccaattgacactctgtatctagctgctctggtgggggcttggagaacctttgtgtggatactccgtatctagctaatctaggctaatctccacgtctccaggctggggacgtggagaacctttgtgtctagctcagggattgtaaacgcaccaatcagtgccctgtcaaaacagaccactgggctctaccaatcagcaggatgtgggtggggccagataagagaataaaagcaggctgcccagagcgagtagtgccaacccgctcgggtctgcttccacactgtggaagctttgttctttcgctctttgcaataaatcctgcggctgctcactctttgggtccacattgcctttatgagctgtaacactgcaaaggtctgcagcttcactcctgcctgagctagtgagaccaggaacccaccagaaggaaaaaactccgaacacatccaaacatcagaaggaacaaactccagacgcgccaccttaagagctgtaacactcaccgggaggatctgcgaaatcattcttgaagtcagtgagaccaagaacccaccaattccagacacaaaacctcgtctctactaaaaatacaaaaaatgagctaggtgcagtagtggatgcctgtaattctagctattcgggaggctgagccatgagaatcatttgaacttgggaggtggaggttgcagtgagccgagatcatgccattgcactctagcctgggcaacagagagagacttcgtctcaaaaaaaaaaaaaaaaaaaaaaaaaaaaaaaaaaaaaaaaaaaatttttttggtttaaaaaccccccaagggggttttaaaannnnnnnnnnnnnnnnnnnncagggatccagcttttttttccgagggctaatcactggtcccaatcacttcttgaattactgagttttaaaatctagaatgaacgtcagattttgtcaatgacctattaagcctctgtgaatataagtttttctcttttaaactcttaatattcattttattaattgatttcttaatagtgaatcatccttatacttctggaataaaccttgcttatttacagtgtgttattcttttcacatgctacaggatacttcagttattttttttgcttcttttttggagacattctctcactctgttacccaggctggagtatagtggcatgataagagctcattgcagcttcaaactcctgggctcaagtgatcctgcctcagtctcccgagtagctgggactacaagtgtgcatcattacgcccagtttttttaaaaaaatgtttgtgcagatgcgggtctcactatattgcccaggctggtctcaaactcctaggcttaagcagtttgggaggcccacctcggcctcccaaagtgatggcgtgtccgaaattggtgggttcttggtctcactgacttcaagaatgaagctgcacaccctcgcggtgagtgttacagctcttaaggcggcgcgtctggagtctgtcccttctgatgttcagatgtgttcggagtttcttccttctggtgggttcgtggtctcactggctcaggagtgaagctgcagaccttcgcggtgagtgttacagctcttaaggcagcgtgtccggagttgttcgttcctcccggtgggctcgtggtctcgctgggctcaggagtgaagctgcagatcttcgtgataagtgttacagctcataaaagcagcgtggacccaaagagtgagcagtagcaagatttattgcaaagagcgaaagaacaaagcttccacagcgtggaatgggacccgagcaggttgccaatgctggtttgggcagcctgcttttattctcttatctggccccacccacatcctgctgattggtagagcccagtggcctgttttgtcagggtgctgattggtgcgtttacaatccctgagctagatacaaaggttctccacgtccccatcagattagttagatacagagtttcgacacacaggttctccaaggccccaccagagcagctagatacagagtgtcgattggtgcattcacaaaccttgagctaaacacagggtgctgactggtgtatttacaatccctgagctagatataaagactctccacgtccccaccagactcaggagcccagctggcttcacctagtggatcccgcaccggggctgcaggtggagctgcctgccagtcctgcgccgccgtgcgctcgcattcctcagctcttgggcggtcgatgggactgggcgccgtggagcagggggtggcgctcatcggggaggcttgggccgcacaggagcccatggagtgggtgggaggttcaggcatggcgggctgcaggtcccgagccctgccccgtgggaaggcagccaaggcccggcgagaaatcgagcgcagcgccggtgggccagcactgctgggggactcagtacaccctccgcagccactggcccgggtgctaagtcccccattgcccggggtcagcagggctggctggctgttctgagtgcggggcccaccaagcccacgcccacccggaactccagctggcccgcaagtgccgcacacagccccagttcccgctcgtgtctctccctccacacctccctgcaagctgagggagtgggctccggccttggccagcccagaaaggggctcccacagtgcagtgggggactgaagggctcctcaaatgccaccaaagtgggagcccaggcaggggaggtgccgagagcaagcgagggttctgaggactgccagcacgctgtcacatctcaatggggggttacaagacatgagccacagcacccagcgtagttaatattttatttagaatttttccactgatacttacatgtgaaattggtctgtcgtgtgtgtgtgcgtgatatctttgttgattttggtatcaaagttatgtttactttttaaaaagagtttggaagacttccatcttttttgtgctctgggacagaattaatagcatttgagtcaattactcatttgtgtggaattttcttgcaagacatggagggcttttgtaacttttaggggtgaaggtgaaggtgaaagtgggccatggtggtagcaaggatagttctttgataaacttctctattttttctgtggtaacggtttgcttaaattttgtctcttccaggatctattttgataaattgtattttcttgtaacatcatccatttcatccagagttttaagttcacttgaagttaagcaaaattagcatcttacaaatctataatttgtttcctgtgtctgtgattttcccctgcttgttttttaaatcatgtcaaatgtgcatttttctctatttctgattagataactattttattttttgtgaacctgtgggtttattagtcctttgacactggtttcctgaattcatttatttattcctttatcttccctaatttctccctcctgctttcctcatgaagcatctacatgtagtgtttacagtttctttattctctagatgttcctcagtttgctctttgacttcctctttttcccaatagtcagttagaatacctgttttaagctcaggtggtttaaagattttcactttagcttatttattttttcatccctgagagcactagagaattgtgtatcctgctgtccatccgcatttggcttcttccccagggttcttctcccagaaggtgacgagagcgaagaaaccccacgggatgcaggaagaaacagtgacaggcaaccaagagggggaggatggagaaaacccttgccttagtcagagcaggccccaggggacgcagaaacaaaggccacacccccacgagcacgtggccagactgcccaatcgtcgctactgaagccgggctctggtctttgattggtgttcgtggagacgccctcacattcttggatcagcccaaaggtaggctcaggctccgacggtggccsgcgggggtcacgaggcttcgtagtggaggaacgggtttggcgtgtgrgacgcagctgcctctgtactggggagtmacggagtggccgggctccagggacatggcggcggcctctgcggtgtcggtgctgctggtggcggcggagaggaaccggtggcatcgtctcccgagcctgctcctgccgccgaggtgggtggaggggccatggctcagtgggcagaggcgggagcraggggtgcacggacccgcgtgagcggtgggaggtgcggcrgaacccagggtcggtgtggggaggacggtaggaaaaccccaggcactttcggaggggttctgccggcagtcacggcgtcgggaggaagacatccccaccagcccttccctttctccccgcttccgcacatccacgcttcagcgcgcctttggcttctgtttttccatttctgaggactgggcccgccatcctccaggctcccctcgccgtcgctgcagctcgtagccgtttacatcgggctttcgcagcaccccttaggtgggagcgttgttataatccggttccggggaagcccaaagggatcaacgacttcctcaacgaaacacagctagtaagaaatggggccgggatgccctcaaagccatttttcagttcagctgtgccccatcaggtgtccagttcagagaaagactcctggagttccttctcattgttagaagagtgaagttgtcaagaagagcaaatgtaccttccacagagctgggaaattattttgtcaaaaactcttgtacccaagtttgaacaacgctatcagatgactcagtctagctcacctgactccagctctgtttcaaattttgagctctaagctttggtggcaataactctggyagtgaaaaaaccctcaggcttgtagatagctttgcttctttgtcttcttttgcttcatcgttatcatccttcatcattctggaaagattgacagtttagtgttcaagggcacagactctgcagtcaaggctgaggtcttagttagctactcactaggtgtgtgactttgggtaagttacttaatatttcttctttaatttcctcaccttggagatgatacgagtaccttgggttgtgaaaactaaatgaattaattcatggaatgaggtttaagcacaatctggtacataagatcagtctataaatgcaaactcaaccatttatatgaacgtttgcttgcttttattttccagaaatattgtagatgccctttttagttacttaattgtaggagtgccccagagaaacataagaaagttgttggaagttggcggggcgcggtagctcacgcctgtaatcgcagcactttgggacgccgaggcgggcagatcacgaggtcaggagatcgagaccaacytggataacacggtgaaaccccgtctgtactaaaaaatacaaaaaatttagccgggcgtggtgacacgcgcctatagtcccgcctgttagtcccagctactcgggaggctgaggcaggagaatggtgtgaacccaggaggcggagcttgcagtgagctaagatcacgccactgcactccagcctgggcgacagagtaagactccgtctcaaataaaaaataaaaaaataaaaaaaaaagttggtgtaagtaatgttaatgttcttcttgttcttctggtttttcttttcttaggcctccagggctcttcaggatagtaccatagacccatttcctgtcttccctttcaaagcttagctattgtctaaagaactrtcctcaagtatgtcactctggagagtgttagagttgttaatggcttatagaagtaaaactctttgccaggagacttggttcatgcctgtattttcagcagtttctcagcactgtgggatccaaggtgggaggattgcttgagttcaagagttcaagaccagcctgggcaacacagtgaggcttcatctctacaaaacattaaaaaattagccaggcgtagtggcacacacttgtagtcacagctacttgggaggatgaggagggcgaggacggcctgagtccaggggttccaggccgtagtgagccatgatcacaccactgtactccatcctgggtgacatcccatctcaaataaaacaaaaacaaaaaaatcttaacagcacagatagtttacattatttttatgttatgaatctttagtagctcacagaaaataatctctggtggcagaattatagacatgacmataagctggtatagagctaccttgaatcagggaagcagcttctttttttttttttgagacggagtctcgctctgtcgcccaggccggactgcggactgcagtggcgcaatctcggctcactgcaagctccggggaagcagcttcttaatcttgtttaagccattgcttttaagttgcagcttagataattgtgaaaaatggaatagatgatcagaacattgttgggatagtggattacagttaagtgggatctctgtctctttctscctctttttccctctctcccttcttctgtcttcactagaagattgcaaaagaaagctttaggtcaacagtagccttgaaaccgaatcagtcttaagctagctttaccaacaagcaaccatttaatagatacatctgcccagaataggccttgaaacttatcagaagcctatctgaagaatgtaaagggaagacgatgctatgagctagaaaatacctcataaagatcaggaaagatgatccccctccttcaggatcaagaaggtaacatcagctgaaatggaaaggtgtgggaaagcagcagcctcgtgaggaagctagctcacggaactctcctgccaaagctgtgggtcttcccagcagctcctcatggatggcagcatctgagtgtgcattgtagggcaatgagtgtatagacgcatatagatgtgtagatgtctactgcatctccgctccagtgaaatactagtcctgctcaactacatagtcatatacataatatgtatatactactgcctagttacatagtttctaatgcacacgctgtgcttttatcttgtgctttgtgaataatctaaaatggttagttagtcctttataaccacatcttccaggtatagacaaaaagataggtggaattgcttctgtaatttgtttgtttccctgcatatgctttttatttatttatttatttwtttttttgagatggagtctcactctgtcacccaggctggaatgtagtggcacgatcttggctcactgcaacctccacctcccaagttcaagtgatactcctgcctcagcctcccaagtagctgagattacaggtgcgcaccaccacacctggctaatttttgtattgttagtagagatggggtttcaccatgttggccaggctggtctcgaactcctgacctcaggtaatccccccacctcagcctctcaaattgctaggattacaggcgtgagccacygcacccagcccacttatcctctttagctgaaacttaatagacgttatacttttttgttcctaaagtgaatctggcctgttttctgtcagctcttggttactttattttatacacaggtatcacgaaacttaaaaattgttgagacttctacctcattaaaatacctcaagtcattttgtctccccatttctccatttttttaaatacaaggacttggaatagaattgtatagtacttttaaatctgagaggtaccttcaagatcacctcttatagtctcatctcgtgtgtgagaacactgaagcccaagctattaaatcttgcatcctcaactgggatgataccaccgctaaagggtggaaattgattcttaggagagccaggaaatcttagattttgtcatggtttacggctttccaaagctcaaccttaccccacccttcctacaaggaataaaatcttttaaaagttttctcattaggagagtaataatgaaaaaaaagttggagaaacactgatgtaaagtgactcgaccctgggcaagctggtcattggagggactcggatgagaatgcagcttttctggtcccacagccaacattctttctgttgcccctgtttaacttccgtttatttctctggtcttactttttaaacatgtctcatgtttaaacttgattggtatttttcaaactgtagattgaccagcatattttaataaaataggatacaactgaaagaaccaaaagagttttgttctttttgtttttgtttttttttttgagacggagtctcgctctgtcacccaggctggagtgcagtggcccagtctcggctcactgcaagctctgcctcctgggttcacgccattctcctgcctcagcctcccgagtagctgggactacaggtgcccgccatgacgcccggctaattttttgtgttttcagtagagacagggtttcaccgtgttagccaggatggcctcaatctcctgacctcatgatctgcttgcctcggcttcccaaagtgctgggattacaggtgtgagccaccgtgcctggccagggcagaatgagtcatttttaacaaaacatctgttttcattaagtgtgtgtcctgggtagtttgtattgtgagttgtagccaaaaaggtttcaaaaaagctaaactagatgatgttggtataccttggttgtttaatcatctctgactgtggtcttatgccagcctcaggaacaagcaggctaggtgactcattcaaggacaggtagtacgagggaaaacagccagaactctaactcttgagttctagattagttttctacccactaagaaagtcttactaaagcactgttagttggcttaaggtttcatgttttaagaaactgaaattcttttgaaagaacaattgtgttgcctattctgtttaattgtaattccttttggatttatgttataggacatgggtgtggaggcaaagaaccatgaagtacacaacagccacaggtactgacagactttgttgttctatttgattttgcttcagactggaagtgtttaagaaagggaaatgtttaatcccttaatatatgcataatagaattagttatcataaattttggattttcacgataattttctaggaagtgttaagtcatggttttcacctcttttgtatcaaatctctcttgctgttaagtctaaaatacagagggcagccgggcgcagtggctcatgcctgtatcccagcactttgggaggctgaggtgggtggatcacctgaggtcaggagttcgagaccagcctggacaacatggcaaaaccctgtgtctactaaaaaatacaaaaattagctgggcgtggtggcgggtgcctgtaatcccagatgcttgggaggctgaggcaggagaattgcttgaacccaggaggcgcaggttgcaatgagccaagatctcgccactgcactccagcctgggcgacagagcaagacttcgtctcaaaaaaaaaaaaaaaaaagtaaaaataaataaataaaatacagagggcaataatggagaacattttatattcgtttgttctttctgtccatttgaccctcttagtgtattggattggaaaatcataactacgatggtctaaagcagttctttgaaaaagctattttaagtagcaaaacctttttttccaaataaaatttaacatggaattcccaactatgaaacatataaaagtgtaataaagtataacttctagctgattggatatagccctctacctactgtgctctccttcccctgcccacactcatacatatgtcatccatcagcccctgtgacaactcttgggctccatagagccccatcgaaaaacacttttaaattaggtgcaacctttttttttttaaaaggagaaataactttattatgttgagcctatggattctattgaagaaataactttattatgaactgtcaaagaacatttatttcacgtgtgatattagaagtacattttatatatgcagtagcttgtcattatggtgccatgccagtagactggtacaagagtcacttgtgttgcaagagaaccacacacacctatgtacatagggatagaggcagaggagcagagtgactgaaagcttaaattctggagtgacgcagatctaggttgaagtcccagattgtttctttagctgtgtaattttgggaaaataatagctctttcagcattagtttcttcatctttaaaattgagataacaatgatagtatctatttcattaggattattgtgaaaatttaagtcgatgttgagtctttagcacaggacctgaggcacagaaagtgcttattaaagattagttagtattggccgggtgtggtggctcacacctgtaatcccagcacttcgggaggccaaggcaggtggatcacctgaggtcaggagttcgagaccagcctggccaatgtggtgaaaccccgtctctactaaaaatacaaaaattagccaggcgtggtggcaggcacctgtaatttcagctactcaggaggctgaagcagtagaattgcttgaccctgggaggtagaggttgtagtgagccgagatcacaccattgcactccaacctgggggacgagagcaaaacactgtctcaaaaataaataaataagtaaataaataaatacataaaagagtagttattaatgatgataatttaacactattataatttgatccttggcataacaaagcatcttttaattttattttatgttgctttgtattttaagtttaaaaagctgagtaatttatgttaatgagtaccttgaatttaagagaaaagaagtgcactgtctaatattagttaaagtggtcattttgggctcagttatgctagttttaccaaaaaccttgaacttatcagtcgagtccttatcagccagttaagatcgtattctcattctcattctttgctctccagtaacatttctgtgtgattttcatggtgttttaaacaggaagaaacattaccaaggtcctcattgcaaacagaggagaaattgcctgcagggtgatgcgcacagccaaaaaactgggtgtacagactgtggcggtttatagtgaggctgacagaaattccatgcatgtagatatggtatgtgttaaaaattggaagccacgtcttacgtttattcgtttactgtgtcmgtattttcgttctttatgatgacagttgatatttgctagtgttatcagggttgaagtaggtaagttcaaactgctcactgctaattcttgggaacatttttcagatataacatcagttgaactaagcggtgtgcttagtagaacagttgatttacaggcaaggtctttatctccttgaggattggttaaaacggttcacagaatgttgcggatccactgactacactttgagtagctcatgtccagattccgtatatacaaggagaaagatccaggctctattctttttttttcttttttttttgagattgagtctcgctctgttgcccaggctggagagcagtggcacaatcccgactcactgcaagctccgcctctcaggttcaagcgattctcctgcctcgattctcctgcctcgacgtctagagtagctggaactataggtgccctccaccacgaccggctaattttttgtatttttagtagagacaggttttcaccgtgttagccaggatggtctcaatctgctgacctcgtgatccgcccacctyggcctcccaaagtgccaaacaggcgtgagccaccgtgcctagccaatccaggctctattcttagcacctgctacttactggctgagtgatcttagccaagtcacttcatgtttctgagccttgcttcatctgtaaaattataactaataagacccaactccctgaagtttgtgaatgttacgggtgagttattactagttttttttgttttgttttgttttgttttgtttttgtttttgacaagagtctcactctgttgcccaggctggagtgtagtggcgtgttcttggctcactgcaacctccaccttccaggttcaagtgattctcatgcctcagcctcctgagtagctggattacagacacacaccaccacgcctggctacttttttgtatttttagtagagacaggatttcaccatgttggccaaaatggtctcgaactcctggcctcaagtgatccacccaccttggcctcccaaagtgctgggattacaggcgtgagccactgcgcccagcctatcactagcttttatccaccagaaataactccaagcataggtgactcccactgttggacttcattatgcctgcagtaagactccaagcactagcatcaattcatgatgagcagcctcacctgggcttttatcactgtacagcaggcccttgtggctctctagccactgtttttctcactctgtgcaatgagtatttcaaacttgtttcgcttcattccaacctccaattctccctctacccacctttttgcagcaggatgatcttgatttcacagagaaaataaaattgaggttcctgccacagaatctgctgacttagttatgtctgcatccatctttcccatcgaaggtcagtgctctggatcccttctcttcttgtctttttaagaattttcccggctgggcgcagtggctcacacctgtaattccagcactttgggaagccgaggcagatgaatcacctgaggtcagggttcgagaccagcctgaccaacatggagaaatcccgtctctattaaaaatacaaaattagctgggcgtggtgtcacatgcctgtaatcccagctactcgggaggctgaggcaggagaatcgcttgaacccgggaggcggaggttgcagtgagctgagatcgtgccattgcactccagcctgggcaacaagagcgaaactctgtctcaaagaaaaaaaaaaaaagaattttcccaaaataagagagtaaattttaaatgtcttaccatgaaaaaatattaggtaagtgagatgatgcctaggttaattggcttgattcaatcattccacattgtgtgcatgtggcaaaacatcacattgtaccccataaatgcatacaattatgatttgtcagttaacagtattaataaaacataaagcaaaatgagacattcctgtgtcaaaaagaaaaggatcttctatttttcaatgatgggtcttcaaccactctctactagactgatactatccatgtccctaaatccagtggagtctccagggctgagctgacttgacccctcagcagcatttagcatcctagtacactgctcccttcttttagaaataaattcttctcatggcattctcagcctcttgccttcttgtcttctctcagtgtcctttatctggaccctacccatctaccagaccctacccatctaccagacccttatgttgaagtttcttgggacttggtccttggccctcttttctcagtgtgcactctcattctggatcattttatatactcctatagctttgagaaaaactcccaaatttctatttttagtccagactttcttttgagcatgatacatatatatccaactgcccattcaacatctccacttcaatattgtcacaggtaccaaactagtgtgactgaaattgaactcatgacctttcacctatactgaacctgcatttcttacagaattccctaaccccgtagagtacaacaccattgctaataaaaacaataatgtcagagatctagaagtctttgagcatttttctctcttctttcctactctagatccttcccccctcatctagtaaatgaccaagtactgttaattgtatttcccaaacatttctttccacttctttccaccccctcccacctataacttaactcaaagccacagtcacctttttttttgagccagggtctcactctgtcagctaggctggagtgcagtggcacagtcacagctcactgcagcctcaaccccccaggctcaagcaatcctcctacctcagcctcctgagtagctgggactacaggcacttgctaccatagccggctaatttttaaaattttttgtagagatgatgtctcactatgttgtcccaaagcgctgggattatagggattataggcataagccaccatgcccagccccactatcacctcttgcttgaccaaatgctgcagcctcctaagtagcctctccacctccactcttaactgtcccccacccccagccaacaatctattttctgcttttcagccagactgagagtataaaataaaaatgtacttaagttactcctcttcttaaatgctttaaacctttatagggtgcaccagcttatcagtaatgtaaaaggtggataatattcagtgttgatgagggtggttagaaactggtatgttgatggaaatatatattggtaaaaccatttcaaggctgattaaccaggagctattaaactatgcatatccttcaacccaaccctacaaacattcctgtaggtttctgtcccacagacgtgctcacatatattgtgctaagagaagcgtgtacaggaatgtctgctttagccttgcctgcatccagttttttgccgttataacctaagtgcgcattaagagatacatgattaaatgaactatgatactgccatactatggaatagtttgcaaatgttatacaaaatgaggtatagacatgtgtactagcaagaaaaagagttcccaagacataccgttaatggaaaaagcagttgcagaagataattatatagtatgatcctatttatgtaaaaacaagaactaaaactgcatgtgtttatataaacatatatgactagttaggaatatggatatggaacaatatgtcccaggtttattatagtggatgttctatctggaaggagactgcaatgggggggagtaccaaagggctactttgcgtttgtattataattcactttctttagaatgagaatagatttgtgttttgtggagttaaaagtaaaaaacaggctgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagctaatttttttttgtatttttagtagaaatggggtttcactgtgttagccaggacggtctcaatctcctgacctcatgatccgcccgccttggccttgctgggattacaggcgtgagccaccatgcccggccagtcttgatcatccttgaggagcctcccctgacttcccttctaggcatttcctgatcaccttcagaccagatcaggccttcctcctacagcatttatgcccttggtttttcctccatgacgttcatcacagttgtcattaagtgtgtgaatgtatttttaatgtctgtctctccccctagacagggacatttgtcttgttcactatggtacaggcagctcccacctcaaagtgtggcacgtagtaggccttcagtaagtcttggaatgaatgaatgatgtgctctaaatggtctacttcaagggatgctatgattttgtgtaagttttaaggaataatataaaataattcacaaatgtatgaaagcattatcatactctgataattatataaactttaatcaactttgtaagcttttttctttgtgtacatctgtcacatattttgtttctattatcaaatataaatttttggccttgaatacatttaaggttattattgttttagtaataatatcatgactaatgtctgttgctttttatcctgagacactttagtttcacaccagtgtgtggcttatgcatgaaaaccaagttttgttaccctcttcatgcaaaagattctaagactggcttatttttatagtgtagacatacattggtacttcagtttttcaattcttgcactgttcttgagggagtggcatttttatttacaataataaaatgaccctgaagcagttctgtatagtgtatgagtatgtactagccacaaagtcttttaagcatgtgatgtttcttaaacaggcagatgaagcatattccatcggccccgctccctcccagcagagctacctatctatggagaaaatcattcaagtggccaagacctctgctgcacaggtgagggttgtgaagagatttgcagtgcaaaaggaatacgttttgtgcaactgatgcaaagttacttatagaaattttctatttttagcctttccyaagatctttacatttgattattggattatcattgtaaactaggcatgtcccatctcatttctcagccagtctgcctttttactggatcctgtgtactttagatcctttgggaaataggtggaaagagggtctaaattacaagttaaaattaggagagaattcagctcttctatcctcaaaactacaagctcaaatcctttgggagaaataggtaggtagggctctgaattacaaggtaaaatataagcaagaaagaaatatatttccaccccaacttcccagtctcattctagggccacgtagggaacttaaggaagacgattcaggcaaatggaattgccaagactctgagatgaaaacaagcttggtgttcaagggagaagaatgttcagtgtggttggagtgaaggcagtaaggggctgtgtcattcaggtatagtcagtaaaaccaaaattccatttgacgtttcagcagaaggaacttagtttaggaattagttccaccagtgttagagagctgaaggcagggtggggatgttgaaattaccctttaataataacagaaattgaaaaccaccctttgggctgaaggagagactgggggagggactttctgcagctgttctcagatctgtggaggggccctgcctggctgccgagggcttaatgaggctggttcttggagttccaaaagaacctgaagactggaaccaatggccgcttcccggcggtgaggagaaggaaagcttccttgttcaagtttccctacagtgacccctactggtgaaacctaacaggaagcccactggcaaacaggcagagccccttcacaaggcaccacgtagaaggctggatttgcagctgggagaaccatcttacaggaagaaagtggtaggagacgatggagcagagagaggtaggggtagcatcatttagaacattcttttttttttttttttttttttttaaagacagggtctttgctctgttgcccaggctgcagtgcagtggcacaatcatggctcgctgcagcttccaacacccaggctcaagtgatcctcccacttcagcctcccaggtagctgggaccacaggcgcatgccatcacacctggctaattttttattttttgtagggatgggctttctccatgttgcccaggctggtgttgaactcctaggctcaagcgatctgcctgcctcagttcccaaagtgagaacattataggtcttgataaggagtttgtatttcattctgagtagccattgggaggttttttaaagctggggagtaaagccatctgctttactttttaataaaatcgctgtggcttctgggtggggaaatggatgattgaagtgggggcaaaggtagggacaacaacattgaaagaaggcaaaacaattaaaagtaaattgccgtagtgttgcccatcaccctcacctgaattccttctccttagaaattcttcgttgtctcctctagcacattgatcattccgcatttgatttcttgttctagtcatatttatacttaattagtgctttgtttaacgagtttaatgtagatgttggctcctccataattcctttgtgctttcctaagggaagaactcatatctgacacctttttatttttttaagcatacctyctagcaacccagtgagcttgtacatagtcctcaatttgtttttatttttgttttttgagacaggggttcacttatcatccaggctggagtgcagcagtgagggttcaagcaatcctcccacctcagcctcccaagtagctagagctacaggcttgcatcaccatgcccagctgattttttaaatttttgtagagatggagcctccctgtgttgcccaggctggtctcaaactcctggcctcaagtgatcttcccacctcagcctcccaaagtgttgggattaaaagtgtaatccactgcgcccagccaagtccttaactaaattagtgaatatgtatagttgttttgtattgatgtatctcttctttagaatagtgttcttaaactgaataggtattaatttatacaaatgcatatttaaaatatgcttgtttatgaagcttttttggttacagcttgaagtaaaaggtccttaggagggtaaggagatgataatagtacgtggagatatacatatgtatctcacatgtccttaggagttcaggccctttaacataaatatcagtttgtgcatttatcatgtatttaagcataaatgccatggtagtattaccttcatcttatgggcataacatctaatgcacagaaggttgcatgatgttattccaaagcatctaaatcttgctactcaaagtgtggtccatggacagcaggtttgacattatgagctcgttagaaattcagacttttaagctggacacagtggctcacatgtgtaatcccagctactcagaaggctgaggcaggaggattgcttgaacccaggccagcctgtagaagatagcaagaccccatctctgaataaaaaacaataacagcctttaagtcctaccctaaacccactgtaatttgcatttatgcaaaatttgcatttttatcaagatcccccagtgatctgaaatcaaaacttgtctaatcattgaaagagaaaggattaaacaagagtattctgactcccagccccattccctattcattggaccagactgagcagtagaactttcttgccctgcattttggaaaaagggaaggtgttgtttaattagaaatttttattaattaaaaattacttcttgtaggccaatgagcttcctttttgttttattattgctttcttttctaagctgcctcctgaagaattgaaaatccactttctttttaatgaccatttttctgagaccattttttagtttaaataagaaccttctagcaaatgtatgatatgctaattccagggactttatcaagcttgtacctatttagaatagtatcatgttagttgctgtaacacaatgagaaaggaataatacttattttgaagtatatttcaaagaatgtttgaaaagaataaaatactttcagacagtatttttaaaagaataaaatattttcaaaaaataatcattttgcctggatattgaagatttggggtggcttgcaaaaattagtggtgaaaataaaggataaaagagcaaaagccaagtaacatgagtgaatgaacattggaattaaatcagaaaatttagcctaagtaaagctgtttagctctttggggcagacctgatcagaaaggaaatttggtgggttataatttacaaagttctcctctaataaaaagatacttgccgattaggagagcaaaccttcctttaatgttgactttaaagaagaaacttattggccmtctagtaaaggacattgaataacacttgtatagtgatttgaaagaagttttctaaaagtctagaattgttcttaatgtggccattttgacatacttttatagaaattaaagtaaaatttacaagtgagctaaatttctggtgatgtctggtgatatggctatattgagaaactcaagaagatgtaaatattttttaggctagccttttttttttaagacgttgtctcactctgtctcccaggctggagtgcagtggtatgatcatggctcactgcagccttgaactcatggactcaagtgatcctgccacctcagcctcccaagtagctgtgatgggactgtaggcacacgtcactatgcccagctaattttttgtttgtttgtttgtttttgaaacaaagtctcactgtgtttccyaggctggtctcaaactcctgggctcaagtgatccttctctcttggcctgcctaygtgttggcgttaccgacgtgagccaccgccctggccacactcgttctctcgattgccagttgtcttcagtcttctctggttgggaaagaggttgtagttaaccctgtctgcagattagaaccacctgagcttttaaagagactgttgtactgccttgcggaagaggcctaactgtaaggaagcataaagcagtctctggaatgcttgtgatgttttgattcttgagttgagcactggctgcacaggtgtattcagtttaagtaaacaatggacttaagagctgtacacttagggcaaatgtgcttttctatatgtgtattatacttcagtcccctcagttatctgaagttgctcctgagcatgaatgttttataaaagtgctccatttttttttcatgtgctaccaagagttaggaactttattacaggtacttgaaaatcactgacaagtaacttaaatgcatatagcaagtcatttactgaatacagctactctgtggttgaccaaaaggaaacccatatgttttaagtatcacagacgaaggtaggaaattcttggtgtccggtcccagggtctgtccagcccatgctgatgtctgaggagagtgtgtggatgagcagaaagaacacttggggggccgtaggcaggtgaatatggttttcttcagcagcagctcttattagcagcttagttagactaggtctctcatactgttcacctttatcttagctgtctgctctggctctgtggttcctgccactcccatgcccgcagctgcacagctggctctcccttgccttcagggtcagcagcttaactctttctctctctgggcatgagcaagccaagctgtgtcctggctcccacctgtccggctgcaagatggacaactttggcactctctctgggtgccagtgctcccaccatgtcaagccatgttgagccgagttgagccccaagagcccctgaacagcattagcagggcaattataccttttacagacaatagtggcatatgagcttacacaaacaggttatataacaagtgcagtatgtgcctgtgccctaaatttgctgagtcatgcaggtctggatgtccacctcagcctattccttgaccaaagcacatctatgtaccttacacttggtaataagaatttaaagaccatgacttgtccgcttcaccatggaaaggacacttctcatttttgcttgaaggcagagccagttttttgtcaaactctgcttgagggtagaaccaacaactttgcttgtgtgtgtcttcttgaacaagttacagagcaaagtaaatacaaactaaaaggttggaataaattattttggcagagatttaaggaggacaagagatactagttttctgtgtttactaataaaggcatgttagtaccgtgcaatgaacaatctcaacaggtttgcaatcctatgacccaccagggtgaagtggcagctcaatacatgcctgaagcaagggaattagcccgctggtaatagtagtggtgctgttgttttcccttttaatccattcaaatgctcaagaacatcatggtttggttatattaaattgttcttcctaagagaaattagttaaacttcttaaggctgttcccagagtgtacgactgaattttattttcacaaggagatggctccttttgtttttagttattgatatggtttcgctgtgtccatacccacatcttatcttgaattgcaactcctacaattcccacgtattatgggaggaacccggtaggaggtgattaaattatggggatgggtctttactgtgctgttctcatgatagtgaatgagtctcatgaggtctgatagttttaagaaacaggagtttccctgctcaagctctctctttgcctgccgccatccatgtaagttgtgacttgctcctccttgcctttccaccatgattgtgaggcctatccagccactaaacctctttcttttgtaaattgcccagtgtcaggtaatgtctttatcagcagcatgaaaacagactaatacagaaaattggttccagtagagtagggtgctgtgaaaagatacttaaaaatgtggaagtgactttggaactcggtaacaggcagaggttggaacagtttggagggctcagaagaagacaggaaaatgtgggaaagtttggaacttcctagagacttgctgaatggctttgcccaaaatgctgatagtaatgtggacagtgaagtccaggctgaggtggtctcagatggagatgagaaacttgttgggaactggagcaaaggtgactcttgttatgttttagcaaagactggcagcattttattcctgctgtagagatttgtggaccttcaaacttgagagagatgatttagggtatctggcagaagaaatttctaagcagaaaagcattcaagagacgacttgggtgctattaaagggattcagttttataaggraagcagagcataaaagttcagaaaatgtgcagcctgacaatgtggtagaaaagaaaatcccattttctgaggagaaattcaagctggctgcagaaatttacataagtaacaaggagcccaacgttaatccccaagacaatggggaaaatgtctccagggcatgtcagaggtcttcatggcagcccctcccatcacaggcccggaggcccaggagggaaaaaatggttttgtgggccaggccagactgctgtgtacagtctagggatttggtcccctcagtcccagctgctccagctgtgattaaaaggggccaaggtactacttgggctgttgcttcagagggtggaagccccaagccttggcagcttccatgtggtgtgaagcctctgggagcacaaaagtcaaaaactgaggtttgggaacctccgcctagatttcagaggatgtatggaaactcctggatgccaggcagaagtttgctgcaggggtggaaccctcatggagaacctctgctagggcagtgcagaagggaaatgtggggtcagagcccccacacagagtccctattggggtactgcctagtggagctgtgagaagaggtccactgtcttccagaccccagaatggtagatccaccaacagcttgcaccatgtacctggaaaagccacagacactcaacaccagcctgtgaaagctgccaggagaggggctataccctgcaaagccacaaggttggtgctgcccaagaccatgggaacccacctcttgcatccatgtgatccagatgcgagacatggagtcaaaggagatcattttggagctttaagatttgactgccctgctggatttcagacttgcatggagcctgtagcccttttattttggccaatatcttccatttggaggctgtatttaaccaatgcctatacccccattgtatccaggaagtaactagcttgcttttgattttacaggcttataggcggaagggacttgccttgtctcagacgagatgttggactgtggacttttgagttaatgctaaaataagttaagactttgagggactgttgggaaggcatgattggtttcaaaatgtgaggacatgagatttaggagggatgaggagcggaatgatatggtttggttctgtgtccccacccaaatctcatcttcaattgtaactctcacaattctcatgtatcgtgggaggaacccagtgggaggtgattgaattatgggggcaggtctttcctgcgctgttctcatggtcatgaatgagtctcatgagagctgatggttttaaaaatgagtgtttccctgcacaagctctctctttgcctgccaccatccatgtaagacatgaattcctcctccctgccttccgccatgattgcgaggcctccccagccatgtggaactgtgagtccaataaacttctttcttttgtaaattgcccagtctgggatatgtctttatcagcagtgtgaaaacagactaatacagttatgaaagaagagcatttatctagtacaccaaaaagttccatcaaattcagaatctgttaaaggagactagtaacaaacactccggaaatgaaattaaggaaacagttacattcacaatagcaatcaaatagttaggaataaagttagcaaaagcagttcaagacatatttactgaaaactataaaacattgctgagagatactaaagaagttctaaataaacagatatttcatcagaacactcaatattattaaggtggcattatatatttaatgcagtctttataaaaatcccagcaggctttaaaaaaaatagaaattgataagctaatcctaaaatagccaaaaagcctaatatatacctaaaacaatttttgaaaagcttatgtaactattttgtaggatttagactctgtttcaaaactcattatgccaggtgcagtggctcacacctgtaatccccagcattttgggagaccaaggtgggcagatcacttgaggtcaggagttcaagaccagcctggccaacatggtgaaaccctgtctctactaaaaatacaaaaattagccaggcatggtgacaggtgcctgtaatcctagctgctcaggaggctgaggcaggagaatcrctggaacccaggaggtggaggttgcagtgagccaagatcatgccattgcactccagcctgggagacactgcgaggctctgtctcaaaatatatatataaagctacaataaccaaaacagcgtggtattggtataaggataaaaacaggtcagtagaacaggatagaaaatccaaaaataaactcacatatgtagtcaattgatttttgaataaaggtgctaaagtaattcaatagaggaaaggagagtttttcaacaaatagtgctggagtaatttgacatctctttgtaaaaagatgaacccgaagtctagatcctagactcttgcctcacaccttaaacaaaaaaaattaacttacaatatatcacagacctaaatgtaagagctaaaactataaaacttctagaagaaaacataggagaaaatctttgagaccttggattaggcaaagatttcttagacataatactataagaaaggttcacgaaaaaaaatgataaaattgacttcaaagcttgaaactgttgctaggaaacctaattttttaaaaaaatgagcaaaatatttgaatagatccttcaccaaagaagttatacaaatgaccagaaagcccattaaaagatgttcaacatattagctgttagggaaatacaaatcaaaaccttggtgagataccacttcatactcactaggatgctataatcaaaaagagatgataacaagtattggtgaggacttagagaaattggaacccttctatgttactgatgggaatgtaaactggagcagccactttggaaaacagttttgcagtttctcaaaacgttaaacatagagttactttatgaactagtaactctacttcttcagtatatacccaaaagaaatgaaaacacatccgcacagaaatttatacctgaatgttcatagcagcattatttatagtagccaaaaaagtaggaacaatgcaaatgtctatcaactgatgagtggatagataaaatgcagtatagccatacaatggagtattattttgccatcaaaaaggaatgaagtactgatttgtgttaaacaaaaaatggatgaaccttgaaaatattacrttcagtgacagagccagtcacaaaagactgcatgtattatatgattccatttatatgaaatgttcatataggtaaatctatagagacagtagattcacagttgcctagggctgggggtttatggggagtgaggaatggctaagaggcacaggatttctttttgcagtgttaaaaacttacattattagatcttagtattttagattatagtgataattgtgcgactttgagtatactaaaaatcattgggttggccgagtttatggtatatgaattatatctcaacaactatgtttaaaaagtgcagtaacactatgcacccactagattggccaaaatcagaaagactgatagtacaacatgtgggcagggatatggatacacactttaaagcatcataaattgctggtagaaatgcaaaataaaatcatcgctttagaaaagttaaatgtattcttaccatattaggaccaaacaattgcactcctgggtatttacccaagagaaatgaaaaatatgttcacacagacttgtctgtgaatgtttataacaccgttattcataataaccacaaactggaaaataattcaaatgaatgggtaaacaaaatgtggtatatccrtataacagaatccatattataaaaagaaatgagctactgacacactccacaacatgaataaaccttgaaaaattatgtgaagttaaagaagccagacacataatactatgtactgtatgattctgtttatatgaatttttttaaaggcaaaactatagagacaacaagtcagttgttgcttgggtattgggaacagattgcacatgggcacatgggaactttttcaagtgatgcaggtgttctcaaactggattgtagtgatccaattgtagttgcacaattgtatagatttactaaattcaccaaactataaatgcatgaatattatgtattataaatcatatctcaaaagaaaacccaaaccagggaggactaggacatagacctgtttcatttgcctagtatagatgtttgaccattttatataaaatactcaaattgtgggagaaaatatttgcaaagtttgcatctgacaaaagtctaatatctagcatctataaggaacttaaacagatgtgcaagagaaaaacaaccccattaaaaagtgggcaaaggacagccgggcacagtggctcacgtctgtaattccaacactttgggaggccgaggcgggcagatcacacggtcaggagatgagaccatcctggctaacatggtgaaaccctgtctctactaaaaatacaaaaagattagcagggcgtggtggcaggcacctgtagtcccagctacttgggaggctgaggcaggagaatggcgtgaacctgggaagcagaggttgcaatgagatgagatcatgccactgcactctagcctgggtgacagagcaagactgtctcaaaaaaaaaaaaagtgggcaaaggacatgaacaggcacttctcaaaagaagacatacatgtgaccaacaaacatgaaaaaaagctcaatatcactgatcattagagaaacgcaaatcaaaaccacaatgagacaccatctcacaccagtcagaatggctattactaagaagtcaaaaaaataacagatgtcaggaggttgtggagaaaagggaacgcttatacactgttggtaggagtgtaaattagttcaaccattgtggaaagcagcagggtgattcctcaaagagctaaaagcaaaactgccattcaacccagcaatcccattactggttgatacccagaggaatataaattattctaccataaagacacatgtgcatgtatgttcattgcatcattcacaatagcaaagtcattgaatcagcctaaatgcccatcagtgacagattggatgaagaaaaggtggtacatatacaccacggaatactatgcagccataataaagcataagatcacatcttttgcgggaacatggatggagctggaagctattatccttagcaaactcccacaggaacagaaaaccaaatactgcatgttctcacttagaagtgggagctgaatgataagaacttaagaacacaaagaaggaaacaaaagacactggggtctacctgagtggggaaggtgggagggagaggagcagaaaagataactattgaatactgggcttaatacctgggtgacgaactctgtacaacaaacccctgtgacatgtattcacctgtgtaatcttcacatgcaccccaaacctaaaataaaagttaataaaataaaattgaactttkgtttaaaagatataaaactctaaactggctgcaacatatgagtatccagcattttatctgtatctggcattgcattgtttcctgtcactaggatgtgggtttttctattcgtatgagtttcccagatatgtgaagcttacccctttaattttgaaatgttctttgagtgtaactattttgaaacaggattggctgaacctttgtgtttttacattgttttggtcataattataatactcgctcacattttagaagaacaaatcccctcagggctactgatgttggagagggtgtggcttcatyactcattaaatcatccaagtcttctctgccttttgcctccttctgtttcttccctttttgctgtcagcgtgtttacttttagaaatcttgctgtccttcagttactgaatttcctcttctgtgggctaaaatcccagtaagtatgtttgttaaaattctgagtacactggaagtaactaggctgaagtctgagggatgcccttttcactgaaagtacacgtacagttgtcccctttatccacggttttgctttgagtggtttcagttacctgcagtctactatggtgtgaaaatattaaatggaaaattccagaaatcaacaattgataagtttcaaattgcacgcyattctgagtcacacagtgagatcttgcacagtctgctttgtccctcccaggatgtgaatcgtccctttgtccagtgtctccacgctgtctccactccccatctgttagtcactcaggagccatctaggttatcaaatygactgtcatggtaccaccatgcttgtgttcaagtcacccttattttatttaaatcatggccccaaaatgcaagagcaatgatggtggcaattcacttatgctaaagagaagccatgaaatgcttcttttaagtgaaaaggtgaaaattctcaaggaaagaaaaaaatatgtatgttgaggtttcttggttcttggtaaggaccaagtttctatctgtgaaattgtgaagaaggaaaaacaaattcatgtcattttcctgttgcacctcaaactgcaaaacttatggccacagggcatggcaagtacttagttaagatgggaaaggcattacatttgtgattggaagacatgaacagaagcgtggtcaaattggtatcagtccagttctgtagtattcatagtttcaggcatccactagggatcttggataaggggacactcctgtagactttaatacatgactttcatttgcttcttagctttttttctggaaagatgacattgatgacctgaagataagtgaggtatttattgagctagtgttctgtttggggcttttggatgccatgatttcaattctaggccagttttacacagagacagaatagacaaattccccttaccactctgaagccctttacttcttgacattctaccctaattgcaatattattttaaatttaagtatatagaaacttctgtaccatatgatccagcaattccacttttggtatacagctagaagaatttaaagcagggactcaaaacagatacttgtataccaatacttgttgttcacagcagcagtattcacaatgtgtagaaataacacaatgtccatcaagagattaatggataaacaaaatgtgtacaaactggatattattcaaccttaaaaacaaatggaattttgatacatgttacatgaatgaaccttgaaaacattatgctaggtgaaataagccaaactcagacaaattattatacgcttccacttacatgaggtactttggctagagaaattcataaacagaaagtaaaatsctggttactagggactaaggaamrggagggaatggagaattatgtttggagattaaaacatcctgaggatggatggtgatgacagttgcccaacattgtgagtgtacttaatgccactgaattacatacttgcaagtaactaaaatggtcagtgttttgctatgtatatattatcacaataaaaagaaatatagattcatctggtttaggtaagccttcagagctttcatatgaatatttcagatatttctttggaaacagagtttaatagagaccatactattaccagtgtagggagaggcctcccagaggaagacagcttcacctgcattaaggtgttgccagttgagcactgatgagtaaattttttattttatttctcatttctaggctatccatccaggatgcggttttctttcagaaaacatggaatttgctgaactttgtaagcaagaaggaattatttttataggccctcctccatctgcaattagagacatgggtataaagaggtatgagtttatatcttttaaaatataactgtatgaaggtcagttgaaatagtttgggccaggcatgtggctatgcctgtaataccagtgttttgggagactgaggcaggaggatagcttgaggccaggaattcaagaccagcctgggcaacttagtgagaccttgtctctcaaaattcttttttttaaatcagccaggcctgggcacagtggctcacacctgtaatcccagcactttgggaggccaaggtgggaggatcacttgagcccagaagtttaagaccagcctgggcaacacagggagaccctgtctctacaaaattttttaaaaattccaggcatggtggcacgtgcctgtgggtccagcatcttgggaggctgaggtgggaggattgcttgagcccaggagatcaaggctgcagtgagctgtgatcacaccatcatacttcagtctgggtgacagagtaagaccccatctcaaaaaaaaaaaaaaaaaattcagctgggtatggtgacacacacctgtagtcccagctgcttaggaggctgaggcagaaggatcacttgagctcagaagtttaaggctgtagtgaggtataattgcaccactgcactctggcatgggcaacattgtgagaccctgtctctttaaaaaaaaaaaaagaaatagtttgttttacctataatattttaattctacccttctgttgtcataggcataagttatttatctgtgacatagagaaattctattgagttacagaaaatacttaatgtttctaatcaatatgttagtattttgggattaaaaaatagggtgagatgagctaccacatgaaatgagggaaactaactaatagacatattaaatttgtattattttgtcrtctcagactcgatgttttctttaaagagttccattgtaatttatagactgggctatatttatgtttgtcttgaatgaaataatttgtagaatttggggcatgttgttttctttcccactctaaagcacatccaaatccataatggctgctgctggagtacctgttgtggagggttatcatggtgaggaccaatcagaccagtgcctgaaggaacacgccaggagaattggctatcctgtcatgattaaagccgtccggggtggaggaggaaaagtaagattgtgcatgcttgtgtttgccaattcaggcttgtcttctttgttttatttatgttgtagtcataatcatcttttctctcttagggaatgaggattgttagatcagaacaagaatttcaagaacagttagagtcagcacggagagaagctaagaagtctttcaatgatgaygctatgctgatcgagaagtttgtagacacaccgaggtgggttggccttatttttctgactcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaaaaattaaattataaaaataatgcatgcacattctataaaatataaaactgtagtagtatataagtatattattacaagtttcccagttctgtcctgtgatgtaaccactgattgtaggatggtatgcattcttccagccattttctatgtgaatagaaacctatatacatatacatacagcaaacaaaatacatacctaagaacagtgaatagaattttttttttttttggacggagtctctcattcagttgcccaggctggagtgcagtggcacgatctcggctcattgcaacctctgcctcccgagttcaagcgattgtcctgcctcagcctcctaagtagctggaattacaggtatgccccaccatgcctggctaatttttgtgtttttagtagagatggggttttcccatgttggtcaggcaggtctcaaactcctgacctcgtgatccacctgcctcagcctcccaaagtgctgggattacaggcgtgagccactgtgcccggccagtgaatagaatcttatacactaatattatatcacagacatctttccatgtcagtaattgtagatcagcctcattctttttgttggtgacctagcggttctatgatcttgatataccattaattcattcagtatgtttcttgttgatgaaatttagggttttttttcaatattagcaaattattgtaataaattcagctatatttatagaactctcagttgagatgctcaggaaatggaagtaattttctaaattgaattacaagtgatatgctgttaataggagctaacacttacattgcacttaccatgtgccagattttaaatattttacacatgctaaataatcttgctgtccttctaattctaatataattcttacaacaacctcattaggtaagtactgttttcattttacaggtgaggacactaagcaacagaatggttgtgttgtgttacttttctgaggtcactcagctgttaagtagtaaagctgagatttgaacccaggcactttgactccagagttcatatctaagccactgcactaagctacttctctgggtaccactatagcaaatgcagtgtgaatccctatttttttttctggaattttattttcatgtttgttgtttaagatgctgattataaagtttctcatttcatagatttttatgacaattgttaaattwtatatatatatgtgtgtgacctgtaagtcaagtgaaaagaataatttatttgggaaccatgactggaaagagatttaccttsaaggtaacagacttgaaacttcaggcccttctttgacattaatctcttccaagaccctgacctaattttgtatttgcagttttgtattcttctccttaragaagacccccaaattgttttttgtttcaggccctataaaacaactgtcctgagcatggcatagtaaatgaaattcaattaaggcaaaaaaaaaggggggggcatttctaaggtacattgaaggcttcctttcaagaaagaataggctagccatccaaatcagcatgctcttaagttagaattgtggagacatcaatagcttatttcagtaacttatttcagagacatcaatagcttatttgagttattatgtaactccatgcctgcagcattttttgaatatgtaagttctttacttatgaaatgttagccatacattgcrtcacattataatttattcccccaatagctggaaagcccctgggaatcaaagacctggtagtatatacatttttattttttgtatatattgcctggcatactactttccttgtaataggcatcagtaatattttttgaactatagaagtaatatgaatacattacaaatttttggaaaatgcagaagatggaaaacaacccataattgtattctcctaattattattaatattcttatatacagtcatgtgttgcttaatgacagagatacattctgagaaatgcattgttaggcaatttcattgttgtgcacacatcatagagtgtccttacacaaactgagatagtatagtcaactacacacctaagctatggtatagcctattgctcctgagctacaaacctgtacaaacrttactgtattgaatactgtaggcatttgtaacacaatggtaagtatttgtgtatctaaacatctcaaaacataggaaaggtaatgtattgtgctattatgtcactaaatgataggaatttttcagctctatcataatcttatgaaatcaccatcctatatgcagtctggcattgatggaatgtcattgtgtggcacattgtgtgactctatttctattctgtatttctagtaataacttctttttaattgaaagcaagtttattaagaaagtaaaggaataaagaatggctactccatagacagagcagccccaagggctgctggttgccatttttatggttatttcttgatgatatgctaaacaaggggtggagtattcttgcctcccctttttagaccatatagggtaacttcctgacgttgccatggcatttgcaaactgtcatggtgctggtgggagtgtagcagtgaagacgaccagaggtcactgttgttaccatcttggttttagtgggatttagccaacgtctttactgcaacctgttttatctgcaaggtccgtatgacctgtatcttttgctgaccttctatctcttcttgtgattaaaaatgccttaacttgctactgggaatgcagcccagcaggtcttagccttattttacccagctcctattcaagatgggagttgctctggttcaaatgcctctgacatttcccttttcccttttgtaagagcacgcttaatcctaagggttgcagagggacaaagatccatcttctgtaacttcttcaggctgaatggggtgatgatattcctgcctaactattaggatctcttgtgttcagtatagagagaggagcttagttagaaagcatcggtatgttgagggccactcataactcatgagttccgacaaaaggtgatatctggaagattaatatgtgtttttaaaaaaaaatttggtaagcttatcctgcatttctacacaaagagtataacagtaatatattccacaacagtagagcaaagtaagcaagattatcccaagttaactaagttagaaggctttccactaactgggcaactgttggaaccaagccgatatgaggttgctaggtgattccaatacatgcccaggattagaatattgattcagatatttgcattaccagtccctcctgtttcttctgagcagcatccagggatcactggttggtccacaggaataagcagggttagtctaaattgtaggaaatctcaaaaacaactgatgagaccaaaatttaataacaaatgtgccatagttcttgaaacataatttttctctctccggtttcccatttttactaaagacaaatcatggtaagactgatttgctttattatacatggcctgattatttgtacaaagtgcagcaagaataattatttgccatacaggcttttaaaattggttttgatataactcttccataaggaatgtcagagaagaccttttttgtatttaagcccagcccagccatgggtttataccctcaaatacctatgagttgggtaaatttttctcctcttgaggtctcacgataacttggggctcctgagtctttcagaaagtgacattctttacttactacaggttaggaaccctatatagagactgtgtagacaaggaatgaggccagttttccccaggggcttttattggctttacaagtcaagtttgattccttaaaggaaagcatgccattccagtcaaagccttggtaaaataaccagtttctccagttgtgtcccattgcaaaagaaagcagattcttattgcatttatgcaaataactatattgccgtaagttaagatagtcacaaataatttccaaattctggagaaatcagatagagagaaacaaatatgctccaaattttgtttatgagtgtgcacattacttaattgtttaaaaagctgtcaatagcttaaaagaaaagtttcctttactctgaagaacaaaacagaggatcagcaatgttttaagcaaaaagtcaaaaaagattacttcagacttctgttagtttagtctgtacagttaactcctgttttgcttgatatacatgaacatttcaactttccatgagagtcctgaaagtttctttttcccttttctaatgtcacaatctccaaagttaaatgaaacctgcattcaagaacacctattagagttgtatagttgattataaatcaccttttggggcttggtggctcatgcctgtaatcccagcactttgggagactgatgcaagtggatcacttgacctggagtttgagaccagcctgaccaacatggtgaaaccctgtctgtaataaaaatacaaaaattagccaggcatggtggcatgcacctgtaatcccagctacttgggaggctgaggcacgagaatcacttgaacctgggaggcggaggttgcagtgaactgagattgtgccactgcactccagcttgggcgacagagtgagactcagtctcaaagtaataataataataataaatctccttttgaagaggatcaaaacaagacaattgtctgtggatggcaaaaagttttagggcagccacagttaaaaacacaattgacaaagaaatttggttacctctgttgcatacaatggttttatgtaacagttataattatactgataatgtacactaagtcatatcagaattataggagtttcccattattttggaacacatactaacaacatatttatataaatatagcccaaagaaagctaaacactatttcacatttgacactgcttcctgtatgactcttatgccaaataagccaaatttcacctttacataactgtactattaatgttaaacccaattttcaataaaaccttatagacatatctacccaattttaatgtttgaccataaggtgaggttctcataaaccttttataaccctttacaaatttttgttaaagagcagatcagtgccttaagaagaacctgttgtgcttttattccaatgttcaatttacagaaaaactgaatacccctttaactttagacaatatgttcacacacagaatttcttttacaagattaattttttacaaaccttccacaacttgcttaaaccttaagcattatcttatttaacttaaaacaatcctttaactttttaatctagacaaaaaaaaatccacattcctgtgccttcttataatcttttaccaaaaacgcatttcaaaaacaaaacaaaacaaaacaaaaaaaacrcatttcactttccttacacaccttacatgtagaattgtttcaatttctcaaagattacttaaatcacataaattaaaggcattatactttttacttttccgacaaaatatttgatataagcacttatttttaaaccagttaaccaaagctctttcatatcacacacacaacacatataaatacacagacaaacagaagaaaaggactcattccctaagccaggaactgaatcctgaacccggkataccattgtgaaaagacaaagctaggccacatggttacaaggtcaagctcccaaggacatacaagacaagaggggaaacctcatccagttttttttttttcagggacctgcagcaaagtttataactgactagtttgctgggccatcttaaacagtgggcttatggtgttctaagcctgtgttttatcctaaggtatccatctctatgacagaacaattcagaaagacatgcaaagcacaccagattcactacagcttaagactagcctcacaaatcctttttttattaatcaaaactttacagaggagataaacagtgatttttgccattcattcaaccagtttgcacagagagagaaagggaagggaagggagaaaagcattgctttgtggcaggatggggaaagcaaggtgctcagagagaccagagaaagacccgcccattgcaaccgacactaaataaaaagttcaggtggccacttgtcagttaagaagggatcttttgcccgccatggctctgaggcgcctcctgccggtgctgcacccctacattacccgcttcgccctgctgtccacggagccggctgcccgcgaacagcctgccgtgggcccagcagccatgccaggacgtgggtcggccgaggcagtgtggccgccggtgcccgcagtggacttcggcaacgcgcaggaggcgtaccgcagccggcgaaccggggagctggcgygcagcccgctggtgctgcacttgtgcgcctggcccgtgctggtggcgtgccatgagcaggcgcgcggggtgcaggcaggggcgcggggcttctgcccgtcccagaagcctttacggagcttcctgggtgcccaccaagcgtctcctggagcgagggaagccaggaagggaggcgtttcctgcagtccctctcggacctcgcaaattttcctacttgtcgatgtctaccaactaaaaacaatgatcattttaatatttacgatatataccacttgtgggaatacagagttatcacttggaattaaaaaaaaagggggatcttttctagcagtcccatcagctctcaagtttctccttttagggaggtaaaagctccccatgtcccaccatcctgtacatgcctaatcctatcaccgaccgccgtcagcaaagagtgcaaggcagattaattcaaacagaatagcagttaacatccatagtgccaaacccattcttagccgagagggattttactgagaggagcccctaaatcttaggaaggaatctaaccttcctaagttgggcttcaaacccaagttcagtcaagcatccttgccttttattgagaggggtctttaacccactctgtcttaggagagactttaactccaccaagttgggcctgtaacccaatcctatcctttgcccgggtgtatgcaccccgcttacccaaagttggccaatcagtgctgcagtctttgggttggagggtctccgcagtatcgtcccttccgtagttcatcagaaagacgttaccagaccccaccgctttgggtcgggatttccttagtattgtcccttctgtggtcaccagaaagatgttaccagacgggggtcctgatccagaccccaagagaggattcttggatctcacacaagaaagaattcagggcgagttcatacagtaaagtgaaagcaagtttattaagaaagtaaaggaataaagaatggctactccatagagagaacagcctctagtaataacatttaaatatcctgataatcatactgtgtattctttatgtcctgctaaataattacctgttgaactaatggagtgccagaagattgtcaaaatagtgctgataactgagaagagtcaatatcaagatattacacaaatcttatcaaaactatttagtgtatctgaaagactgggataagaaaccacctttaaagtatactattttggaagaaaaaacagaaatcagatttcttcctcagttcatatataatacatattctagatggattaaaaatgtaaatagggccaggcgcagtggctcacgcctgtaatcacagcactttgggaggctgaggtgggcagatcacgaggtcaggagatcaagaccatcctggctaacacagtgaaaccccgtctctactaaaaatacaaaaaattagccaggtgtggtggtggacgcctgtagtcccagctactcgggaggctgaggcaggagaatggcatgaacccaggaggcggagcttgtagtgagcctaggtcacaccactgcactacagcctgggtgacagagcaagactctgtcttaaaaaaaaaatgtaaataggaaaatggatatgttaggactcttagaaaatatcaaggcgctcatgataggactcagctgcatctgtctgtctctctggccgtactctggcagtggctgaattagggcagctgggatttgatgcacctcctggttctcagacacttatagacactatgctccagaaactctaagttagataaagctgcacagaaaagggtcaatcagaaaaaggtaaataagactgattgaatgactacagaaatcctaacagaacacagatcttcactgaacttcccttataagcagccaaaggaaaagtgtttccaacttctaagacctcagacaaggctgggcacagtggctcacgcctgtaatcccagcactttgggaggccatggcgggcagattgcctgagctcaggagttcgagaccagcctgggcaacacggtgaaaccctgtctctactgaaatacaaaaaattagccaggcatggtggtgtgtgcctgtagtcgcagctacttgggaggctgaggcaggagaatcgcttgaacctggaagatggaggttgcagtgagctgagattgcaccactacactccagcctgggcaacagagcaagactccatctcaaaaaaaaaaaaaaaaaaaactgaaaaaacaaaactcaggcaagaattgctctgtgctcttgatgtggcccccacacattcccttcataacctggaatccctgctgtagtgtttcctcttacctggagcacctaaaagatgagggagagtcagaagtggtatgtgttagtctgttctcatgctgtcaataaagacatacctgcaactggataattcataaaggaaagaggtttaatggactcacagttccacatggctggggaggcctcacaatcatggcaggaggtgaaggagaagcaaaggcgtgtcttacatgacagcaagcaggagagcctgtgcaggggaactgctctttataagaccatcagatctcgtgagactttactatcacaagaacagcacgggaaaaacctgcccccatgattcagttacctcccgccgggtccctcccaccacacatggggattatgggagctacaattcaagatgaaatttgcttgtggacacagccaaaccatatcgtggtagaactttacaattggaattagaaaaacaaacacttcagctccaacatgtaaagagcttgaaagttatcagtcatatccaaaaagcaagaaaaaggctaaacaaaatgaaagtcagtggttttagaaccatcagagaattgaggccatggggcaagccttcactctaaaatctggacaagcatgcaagtatagtgagtcacagccagatcagtttacctgctggagccctaacacttgcatgggaattytgaaaaatggctgaggctaagtgtgggccagtgtgcaagtgagaaactccttggggccctgtcttagagggacctcccactttcatgggttttgcctccaggaacctcaccaagttcccacagtaaaaatccaagaaaaaaaaatccctcatgttttacagcagtgggaggggaaaagtaaccaatttgaaagagatccagagcattctatyctccctaacagaagaaatcctaactccaagggagatgttgccagaaccttttttgttcagggggaaggtagttagccaaccacaaccccctttagtcttcccatttcacctaaggggagggggaaaaaaaacaacttagaaatacttcgcagcacaaacacaggaccactaaaagacttgagatttaatcacaagtttatagaatgctttccctcccccataccctaccaycatgttgcaatggtctaaatatttgtatccctccaaaatttacatgttgaaacctaacccgctatccccaagtattaagaggttggggcctttggcaggttattaggtcctgagtgctctgccctgatgaatggaattggcttcagtgagcgcaggcactttgtctctgctcacctctgtacacccagcactagttgggagcctcctacgtaatattaatagatgctcgcagccataaaaaaggatgagttcatgtcctttgtagggacatggataaagctggaaaccatcattctcagcaaactgtcgcaaggacaaaaaacggaacaccgcatgttctcactcataggtgggaattgaacaatgagaacacttggacacaggaaggggaacatcacacaccggggcctgtcgtggggttgggggagcggggaaggacagcattaggagatatacctaatgtaaatgacgagttaatgggtgcagcacaccaacatggcgcatgtatacatatgtaacaaacctgcacgttgtgcacatgtaccctagaaattaaagtataataaaaaaaaactataagtgtatttgcaaacatattggaaaacatggaaaaaacaatgaaaaggatttcagtcatatagcaaaatagctgatttgtgttatgtcaatagctttcttctcacgtttgttctgtctgcttcctatacttagcaataagaagatactgtaattatttcacttatctacccctctgttcttaagtatctctttttcctataattttgttatgtaaaaggtaaggtttagaatgtgccactcagacctcaactttccattgtggattatgcaaggccacaaagatttcgtacaactatgatgggacaaataaatacaaatttgtgaacaacaacaacaacaaaaatcagtgatcctgaacatagataaatagaactttcccaaacggaaatgcaaggagaaataaaaatgaaagaaaaaagagagaacagaatatccaagaactgtgggacaatttaaaaggatgtaacacgttatttgaataccacaagaattagaaagcagcaggagagatatttgaagtagtaatggccaagaattttccgaagttgttgacagatgcaaaactacagaaccaggaaactcagaggacaccaagaagaataaataccaaaatatatacatctatgcacatcatcttcaaatgcaggaaaagaaagacaaatagaaaatactgaaagaagccacaaggaaggaaaatactagaggaataaaaataagaaatcttatcagaaaccatgcaagaagagagtggagtgagatataaagtgttcagagaaaaactactaacctagtcttctgtatccagtgaaattatgcttcaagtatgaaggagaaataaagactttcttagacaaacagaaatgaagagactttgtcaccagtagacctgtcttgcaggtcatattagtagatgttctttagagtgaaataaaatgttttaggtcagaaacttggatctacataatagaaaagaattagagaaggaataggtagaagtaaaatattttcctatcctaacataggaatattttcctattttgaattgatttaacagataacagtttgtttaaaataatggcaataacgtatttggtgattatatagcttgtggataaagaggaaaagtcaacaaggcaagaaaactaaaaagaaaaaatcagctccaagaattttattaagagaatgtattggacaggttggaaaattcaaaatgggaacattcagaaaagatgatatatcaagaagataaattctttttatttttgagacggagtttcactctgtcacccaggctggagtgcagtggcacgatctcggcccactgcagcctccgcctcccaggttcaagtgattctcatgcctctcagcctcctgattagctgggattacaggtgtgtgccaccacacctggctaatttttgtatttttagtagagacaggatttcaccatgttgcccagctggtcttgaactcctggcctcaggtgatctgcctgccttggcttcccaaagtgctgggattacaggtgtgcaccaaccgtgcccagcaagaagacaaattctttgaagtggttaaataaaatacttcatgaagtaaacaagaatagaaatgaactattgtactgaagcaatacatttataagacttcctggcattttttgtctcttctatgtttgacagtttttattttaaaaaatcaacaggaaaacatatttgctgatcacttctgtattatggcgtattatggtggtraataggtgaagtgaactacagtgtgaccatatcacaaacctaccgagaagaatttcatgttcaccaaatagtccatattagccttatttccacaaaagttatgtgcattcactcttaatatgatttgtcataattttactattttataatcaacatgtaattacctttgttggttgttgttgttttttccttagagatggggtctgactttatcagccaggctggaatgcagtggcgcaatcgtagctcactgctcactgccaccttgaattcctgggcttgaggaatcctcccgcctgagcctcctgagtggctaggactacaggcatgtaccaccatgcctggctaatttataaaaaaaaattttttttagaaacagagtctcactatgttgcccaggctggtcttgaactcctgggttcaagcagtcctcctgccttggcctcccaaagtgctgggatttataagtgtgaggcactgtgcccggcccttttttgggttttattatgatttattgttcatgtatttctgagatactaatggtccatattaatttaatacatttaacttttctggatgagccattttaatttcagtcttctatattcataaaatctaactgtaagagttgcttaaaaacaaaaagtcataaaaaatttttcattggtcttttgacaatataggaagtgactataatttgtaattttgatgtagtcaaatttgtcagtcttttctttgacagtttgtactttttgttacgtatccctactttagtctctattttctgtcttttaaaaatatttatttattcattcattcattcattctcctttaggttggagaagtgtcttaattgccattttatgtagagagattttttctctttaatattcatcctacaaatggtaacattttcattgagttttacaagattatagtttctttgttttgacagggtctctcactctgtcacccaggttggaatgccgtggcacaatctcagctcactgcagccacaaccttctgggctcaggtgatcctcctacctcagcctcctgagtagctgggactacaagcatgtgctaccatgcctggctagtttttttgtagagattggggtttcaccatgttgcccaggctcatcttgaactcctgggctcaagcattctgcctgccttggcacccaaagtgctgggattacgggcatgagccatctcatttggcctgtggttctttttctaagtccataacctctaatttgaggtcaaaatatcagatcttacttaaaggaagtaaaaatggagaaatcctggtgattgtgcctaacagtttagcttaacgaatgtgatatttatcacccctaacaaatatattaacatacatgtttgcttttatataggcatgtagaagtccaggtgtttggtgatcaccatggcaatgctgtgtacttgtttgaaagagactgtagtgtgcagaggcgacatcagaagatcattgaggaggccccagcggtaaggaccttggaaagaaatttgtaagcttctccrtaatgtgaatcttactctgattttcacatcagaaatctgtgratctggtgtctctcacccctcaaactcctgctggacaactgttgcctaatagcagtgtagtgaaaagacctcctgtggtattggggatgaggaggagattgatgttctgggggtagacacaacagggtcatgttccttctggataaaatatgggaaaatctactctgattcacctatctgatttacagcgaaaagctgtctagtgaggtttcaacgcacattttaaattgtaatgaatggccaggcgcggtggctcacgcctgtagtcccagccctttgggaggccgaggtgggtggatcacctgaggttgggagttcaagaccagcctgacccacatggagaaacccccatctctactaaaaatacaaaattagccgggcttggtggcgcatgcctataatcccagctacttgggtaggctgaggcaggagaattgcttgaacctgggaggcggaggttgcagtgagccgagatcacgccattgcactccagcctgggcaacaagagcaaaactcttgtctcaaacaaaaaaacagaaaattataatgaactagaattaattactggaatggaatgatctgattaattgaatctattttttgtggaaaagccttttttaattaccatttcagatgttctcaaaatatgtgagagattttcctgccttactggttatattatagagaagagagagtctctcgtttggcagcgtttgctcatttaacatttgtttatatctctttgagccttactcttgattggtttaggtgattatctgggtcaaagcctactactaggactacctatttttggatttacatttctgtggaggttgctactgccatgggttcttgttcaacgttatatagattttttttcaataaatatttatttccaaaaagtcagggatcagaggtttctggttaatcaatacatttttcttataccatattcaaattttaatttatgttgcagaatatatttaacttatgttgtagaatatattataacattatatattataccagaatatgttatgccatgaatattgacatattaaatgtcaatagaaattgcagtaaagccttattttcaagtcgtgattacttaaatttatatctgtatagcactgtttttaaaaagttaaaaactttgtttacttctagacatacatttattttaatgtacctttcttattaacttggaatctcaaggtttcccattattttaagataatcattaggcacatcactcagattgcttatcatcctgaaacaaaataaggattgttgaaagttaccatattgatacgtatagttttgttttgtttttttgagacagggtctcgctttgtcatccaggctggagtgcagtggcatgatcataactcactgcagtctccaactcctgggctcaagcaatcctcacctcagcctccagagtatttgggactacaagtgcatgccaccatgcctggctaattttttttttaatgtattgtagagatggggtcttactgtgttgaccacgctggtctcaaacttctggcttcaagtgatcctttaacctcagcctcccaagcacttggattacaggcccgagccactgtgctcagcctgaaacatataattataagtggacatatagttatgaaagctgtcatgtagatacaagggacaaagatacgtaattatgctgagtaatatctgcaatgcatagaaattagtagcagaatcattaaactttggtatattgacagttaaactatcataggacagtttttgatgaagtatataatattagctttttatcctttttttttgagatggagtttcgctctgtcacccaggccggagtgcagtggcgcgatctcagctcactgcatcctccgcctcgcgggtttaagcagttctgtgcctcagcctcccaagtagctgggattaaggcacccaccaccacacccggctaattttttttttttttctattttttagtagagacggggtttcaccatcttggccaggctgatattgaactcctgacctcgtgatccacccgcctcagcctcccaaagtgctgggagtacaggcttgagccaccgcacccggccagctttttatcctttttaatgcagaatttggtacacagaaatataatacagtcatgcattgcttaacaataggaatacattctgagaaatgcgtccttagttgattttgtaattgtgttaacatcatagagtgtacttaaacctaaatagcaaagcctaccacacacctaggctgctggtagagcccattgctcctaggctacaaacctatatacagcatgttactgtactcaatactgtaggcagttgtaacacaatggtaagtatttgtgtatctaaacatatataaacgtagaaaaggtacagtaaaaatacagtataaaagattattaaaatgatacacctcctatgtggaatacttaccatgaatggagcctgcaagattttcagttgctctgggtgggacagtgagtgaatgtgaagacctagtacatcactgtacacttggtaaacactgtatacttacagccaattaaatttataaaaaatatttttatttaataaattagccttagcttgctataacttttttgctttataaacttttaaattttgttttcacttttgactctttttaataatacttagcttaaaacacaaacacattatgcagacatacaaaaatattttttctaggccgggcgcggtggctcacgcctgtaatcccagcgctttgggaggccgagacgggtgaatcacgaggtcaggagatcgagaccatcccggctaacacagtgaaaccccgtctctactaaaactacaaaaaaaaatagccgggcatggtggcaggcgcctgtagtcccagctactcaggaggctgaggcaggagaatggcctgaacccgggaggcggagcttgcagtgagccgagatcgcgccactgcactccagcctgggcgacagagcaagactctctcaaaaaaaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttttttttttgagacagagcctcactctgtagcctaggctggagtgcagtggtgcagtcttggctcactgcagcctctgcctcctgggttcacgccattctcctgcctcagcctccagagtagctgggactacaggcgcctgccaccacacccggctaatttttgtatttttagtagagacggggtttcactatgttggccaggctggtctcgaactcctgacttcatgatccgcccaccttggcctcccgaactgctgggattacaggcatgagccaccgtgcctggcccctatttttaaatttttaaattaaattaaaattttttgagatggggtcttgctgtatcacccaggctggagtgcagtggcacaaacatggttcactagacccctgacctcttgggctcaagtgatcctcccacctcagcctcctgagtggctggaactataggtgtgtgctatcatgcctggccaatttttttatttttgtagagacagggtctcgccatgttgctccatggtttgattcttgccaggctggtatcaatctcctgggctcaagtgcttcacccgtctcggcctcccaaagtgttgggattacaggggtgagccaccacacccggcctgttttaactttttaaccttttctgttaaaaatgaagacacaaacacacccattagactagacctaaacagaatcaggatcatcagtgtcactgtcttttctccacatcttgtcccaataaaagttttcagggtcaataacatctatggagctgtcatcttctatgataacaatgctttcttctgaaatatctcctgaaggaactgtctgaggctgttttacagttaactttttttttaagtaaaagggatacactttaaaataactataaaaattgtatagtatagtaaattaaaaaaacaatagcgtggttgtattatcaagtattatatacggcacatgattgggctgtatttttttttttttttttttttttgagacgaagtctcactctgtcacccaggctggagtacagtggcgtgatctcggctcactgcaagctccgcctcccagggtcacgccattcttctgcctcagcctcctgagtagctgggactacaggcgcccgccaccatgcctggctaattttctttgtatttttagtagagacagggtttcaccgtgttagccaggatggtctcaatctcctgaccttgtgatccgcccgcctcagcctcccaaagtgctgggattacaggcgtgagccaccgcacctggctgattgtgctatacttttgtataatggcagtgaagtcgttttgttgacaccagcctcaccacaaaacacatgagtaatgactgtgctgtgatgttatgacagctacagtgtcactaggtgatagggatttttcagctccattataatcttatgggacaactgttgtatatgtggtctgttgttgactaagaaacgtcattatgtggcacctgactgaattgaattttaatggaatttctagtaaggcaagctactaatggagatttatttacatatttttttcatagcctggtattaaatctgaagtaagaaaaaagctgggagaagctgcagtcagagctgctaaagctgtaaattatgttggagcaggtaggttaagatttgcttctaatggaagagacgtaacagtgtttaatttatgttttagaaggcaagagaaacacaacttttaaatcagttgctttcaagctgttttgaccatattcacagtaagaaatacattttatattgagacttagtatgtacacataaatgtttatttttacatacatatatatttgaaacaaatgtttcattaaacagtacttgtcttaattatatgagttttgatattttgtattctattttaaaatcactagattgatttttttacttctttatggttaataaactttctcttttagagcagttttaagcttacagcaaaattgagcaaaaggtacagagaattcccatataccccctgtcccccactcggataccccccaacacacaagctcccacagtatcaatattcctgcaccagagaggtacgtttgttacagtcagcgaccctacattgacacatcattatcacccaagtccatagtttacattagggctcactcttggtgttgtacattctgtgagttttgacaaatgtataatgatatgtatccaccattgtactatggtatagaatagtttcagtgccctaaatatcctctgtgctctgtctattcatcccttcatcccccctaaaccccggcagccactcatgtttttactgcccccatagttttgccttttcaagaatttcagatagctggaatcatacagtatgtagccttttccgattggcttctttataatatgcatttaagtttcctccatgtcttttcatggcttgatagctcatttcttttttatgctgaataatatttcgttgtctcgatgtctcagagtttattatctatttagctactgaaggacatcttggttgcttccaagttttggcagttatgaataaagctgctataaacaccctgaaaacaaacaggcttttgtatggacataattttttagtttatttgggtgaatactaaggagcgtgctactgggtcacatggtaaaagaatatttagttttggaagaaactgacaaactctattctaaagtgactgtactattttgcattcctgtcagcaacaaaagaggtttcctgttgctccaaatcctctccagcttttggtgatgtcagtgttttggattcaggccatttggtatctcattgttttaatttgcacttccctaatgacatacagtgttgaacatcttttcatatgcatacttgccatctttatatcttctttgatgaagtgtctgttcaggtctttcacccattttttaatcaggttgtttgttttcctattgttgagttttaagagtcctttgtatattttgaatgacagttctttatcagatgtgcctttgcaaacactgtcagtctgaggcttgtcttcacttctcaactttccctttctttttttttttttttttttttgagacagagtctcactctgtctcccaggctggaatgcaatggtgtgatctcggctcactgcaacctccgcctcccaggttcaaatgattctcctgtcccagccccctgagtagctgggattacaggcacgtgccatcacacacccagctacttttttgcatttttagtagaggcggggtttcaccactttagccaggctgatctcaaactcttgacctcaggtgatccgcccacctcagcctcccaaagtgctggaattacaggcttgagccaccgcrcccggccgactttccttttcacagagcagaagttttaagttttaatgaagtccagtatataaattatttgtagatcatgcctttggtgttgtatataaaaagtcatcaccatactcaagcttgtctaggttatattatactcagctggccttgtgctttctgttttggaaggttattaattattgacttaatctctttaataaatatagctattcagattctctttttttaatttaattttatagagacagggtctcatattgcccaggctggtcttagactcttggccccaagggatcctcctgccatggcctcccaaagtgctgggattacaggcgtgagccaccatacctggcctatgctcactgcaacctccacttcctggactcaagtgatcttcccacctcagcctcccaagtagctggaactacaggcatgtgccacaacactcagctaatttttaaattttttagtagagacagggtccccctgtattgccaaggctggtctcaaacccctgagctcaagcagtcttcccaccttggcctcccaaagtgttgggattacacacatgagccactgcacctggccctaggttctctctttcttgtaggagttttgacagattgtgtctttgaaggaattggttcatttcatctaggttatcaaatttgtgggcatagaattattcataatatttctttattatcattttaatgtccatgggacctgtagtaatagacctctttttgttccgttactagcaatttgtattttctctcttctttttttcttagttaacctggctaaaggttattgtgcttttgtttcttttcttttttcttttttttttttttgaaacaaagtctcattctgtcgccaggctggagtgcaatggtgagatcttggctcactgcaacctccgcctcctgggttcaagcaattctcctgcctcagcctcccgagtagctgggaactacaggtgcacgccactacacccagctaatttttatatttttttagtagagatgggtttcaccgtcttggccaggatggtcttgatctcttgaccttttgagctgcccgctgtggccaaggktactgattttattgatcttttcaaggaactggtttgggttttggkgatttttttctattgattttccattttcaatttcattaatttttgctttaatttttattatttcttctgcttactttggatttaatttgctgttctcttctcattaattaaaatataagcttagattcttgattttggtattttcttttctaatatatacattcaatgctataaatttcccactaagcactgcttttgatgcattctacaaattttgaaagttgtatttttatttagttgagaatattttaaattttttcttgagatttctttattgattcaggtgtcatttagaagtgtgttgtttaacatccaaatatcttaggattttccagatatccttctgttagtgatttctagtttaattctgttatgttctgagagcagacactgttatgatttatattcttttaaatttgttaagatgtggtttatggtccagaatgtggtctatcctggtgaatattcctttctagcttgagaatgtgttctgctgttgttggatgaaatagtctatagatgacagttgtatccagttgattgatggtgttgttgaattcaactatgtccttagtgattttctgcctgctggatcatccatatctatttaataacagatgggtgttaaagtctccaactgtaatagtgaattaatctatttctccttacaattcttttttgctacatatattttatgctctgttgttaggtacatgcatgttaaaaattgttatgtctacccttttatcattgtttaatgcccctccttatccctgataactttccctgctctgaagtttgctctaaaattaagatggctactcgcactttctttggtgttagcatattctttgtctgtttttactttaagtctataagtctttaaagtggatttcttgtagataacatatatttgtcttttgttttttaatctactccaacaatctctgtcttttaattggtatatttagacatcaacatttaaagtgattattaatgtactttgattaatatttaccatatttattattgttttctgtttattccccttgtttgttcctatttttatctttcagactttttctgcctttcatggttttaattgagcatcttctatgatccaatttcctctccttttttagcatatcaagtacagtcatatgctgcataacaccattttattcaatataacaatggttccataagattaaaatgcagctgaaaaattcctatccagtgacattgtggcaactgtaacatcatrgtacaatgcattactttctttaggtttagatatatgtagatacacaaatacttaccactgtgttacagttgcctacagtatgcagtaacatgttattattgtttcaaatattacttctgttccttcctttcttctccttctggtattctcgttctgcgtagttaataccttttgtagttgtcttgcagtgctaggtattgttctgtttaaggttttttttctcactgtttttcagaattggaagtttctgttgtcatatcctcaagttcagaggttctttccctgccatacccaacgtactaatgagcccatcaaagcatgcttcatttctattagggttatggttttttttttttcaattctagcatttcctttttattctttcttaaaattttcacctctctgcttacattatctatctgttcttgcatgttgtctacttttttcattaaagcccttagcctgttaatcacagtttagaatttctgtgtctgataattctaacattcctgccatacctgatgcttcttcagtctcttcaaactgtgttttttgccttttagtatgccttgtaattttttgttgaaagatggacatggtgtactgggtaaagagaattttgctaaacaggcctttggtaatgtgataaggctggagggggcatgttctcttgtcccatgatcagatctcagtcttgctgagcctgtgcccctggtgtgtgaacttcaccagtgcttcctggtatgtttttgttttgttttcccccaccccttagggtggacagtatgtctggcaaaggctggagttgggtatttctcctcccccagtgaggttaggctctgataaaatcccaatcgtttaggctctgataaaatagtttttctcaagggtaaaccttgaatgttttggtgtatttcaaagtggtttcatttcccttctgagctggaagcatgggaggatttttctctgatattcactgtgaagacctggtagagctcctggaggtaaaactcacaaaagtgtgaggtcctcctgtaactgggtcgccttggagtttttaactctcagagttgtccacactgagctaccaggaatttgtcaattacagctcaggcttctcctcatggcatctctgtatctgcctgtcagttgtctgtctctctggttctgaggacaagcagcttgccctgtgacctgatttctctgacaaatttaaaaattgttgattttcagcttgttcagctttttacttgataggacagagtggcagcttctaagctccttagatgccggatcagattgattttcaaattgattttaagctgggcacagtggctcacacctgtaatcccagcactctgggaggctgaggcaggtggatcacttgaggtcaggagttcaagaccagcctggccaacatggtgaaaccccatctctactaaaaatacaaaaaaattagctggacatagtggtgtgcgcctgtggtcccatctactcaggaggctgaggtggaggaattgcttgaacccgggaggcagaggttgcagtgagccaagatcacgccattgcaccccagcctggatgacagagtgagattccatcttaaaaaaaaaaaaaaattgattttaaaatccactaatgggttgtgaccacacttttaaaaacaactttacattgtattcactttaagctaagagaaaaacacagaaacacagaagactacaaactatatgatttcatttatataaaattctagaaaaactatagtgacagaaagcagattggtggtttcctggatcccagggtttagtgaagggactgattccaaatgggaacaagggaactttttggatgatggaaatgttctgtagtttcattgtggttctgtgattgtattcaattgctaaatcacatgcctacacttcaaatagttacagtttgttgtctaaaattaaaccttaataaagttaggggaaattttttagagcttaatagaatgccaatagatattaacataaggtttagttgccaaacaatctttcaatgggttaccagcaaaagggctttaaaaagaaattcctaggagcccacaatcagggaaaaaaaagttttctttttctccatggggttagggtgagatgggatgtcatggtatgakgctcccaggatcttggtgctctgaggcagtaacatgtggtccacccttgttctcactgttacaagctgaaayggattcataatttgggcttaccatttgctcacaaccccaaatatacttttccgttgccaaatttcatgcagctctctatttttgactaagattcatatgctgctgcaaatgcgagatgttttcttcatgaaatgcaaagtgttaccattgaatgaagacagcggtaaaacttgatgtgatgcatcatggaagattttggtttgctactgattatacactattgaatatgaccattgttttttaccttttagggactgtggagtttattatggactcaaaacataatttctgtttcatggagatgaatacaaggctgcaagtggaacatcctgttactgagatgatcacaggaactgacttggtggagtggcagcttagagtgagaatattttttctattaaaaatcagccttggctgggtgcggtggctcaagcctgtagtcccagcactttggcaggccaaggcaggtggatcacctgaggtcaggagttcgagaccagcctggccaatgtggtgaaaccctgtctctaccaaaaatacaaaaattagccgggcgtggtgccaggtgcctgtagtccccggtactcaggaggctgaggcaggagaatcactgagcctgggaggcagaggttgcagtaagccgagatcgcgccactgcattccagcctgggtactccatcttaaaaaaaaaaaaaaaaagatcagtcttgatgggagggatgtgagggctgaaaaactacctaaatggtaccgtgttcactgtttgagtgatgggttcatcagaagcccaaatcccagcattatgcaaaatacccatgtagcaaacattcacgtgtaccacctgaatctataattcaacaacaacgacaacaacaacaacaacaacaacaaaacagtcttgagaataggttactaccttctggcctcctaaaacaggtgtcattttggacggggttcagttcttggtggttatgaggacaggaagatgggaggttaaaagtgaagccacatttgatgctgtagctttttttggcactttagggactcagattcacttccccctaggcccgggcagccagcaggtgagattgtgtcacaggggcttgctcacaaccacatcacctcaaggtcaaagcctcatggtctacytaaggccacagcattctgggccaggccatcattcggtttcagatcagggcagatactaggcaagatgaaatgagctaaggcagagttgggaatgaagagccaaggagatggtctagaatgatccaagtaaagtgcggatttatggctgttgcgggcccatgagtaaatgttcattcagagtaaatgtttggaaacttttaaagcattttggcattgctatgacatgcctactgtatttttcaaacatgtaagtttataactgttcttttactatggatagtttgagaagcactggtrtaaaccagaattccacaaaacatacttctcaaatattaataatagcttagtctgtttttgttctcataagaacaatagattttactttagccttctttttcctaacatgaaaaaaatctgttaagtaatatagacggtcctgatatatgtaggattcgtggttccttgtatatcctgcatctaaattgttttttcctggtgtgacgccaaaatcttgattattttggtaattttatcttttcagaacttctgtagataataatatgatactccttttgttggttccttgggggtgattggtggttctaattgagccaaaaggttcttctagggctctatatcctagggtgttaacgaaaaccaggcacagcaagctggtaagttttagtgagtgtcaagaaaaactgtagtggctttggaaacttctggaaggagtgtttatatttccagaattcaaggaaaaggaggataatttttctgaagcagtaaatcaagagagtttcgaccttggaaatcataagagaaaaaaaggtttctaaggrttaaggaaggagaaagcttttgggtattaaggaaaccagcagacatctatttcttgtaagagcttgtcaaggctcttcagaaagagaagccagcttttatcatctggggagggacactagaacttagggaagctgctggacctggtttatagagttcaaggcatttggcatctggccttcaaacagaggtaaaacaaaggggctcaccatttggtgagtcaagagtctaagctcgaggacctgcctgtgcagtcaagccttcctagaacaagggttgaatgatgactgatgtaagtgtcctrggttcaggctgcagatacagatagttaacagtgttcagggaaagctggtgaaaatgtcaaggttaggggttccggagagccagtgtcagcctgagagaactcaaatggcacatatctccaaagacccagaggcatgattggggcctgtcttttctgggctcaagtggaagccaagcttggaggaaaatggacaggcaaagacaagtcaaggtgaacacaagagacagagttttgctctttttgcccaggctggagtgcaatggcgtgatagctcactgcaacctctacctcccggcttcaagcaattctcctgcctcagcctcccgtgtagctgggattacaggcgtgtgccaccatgcccggctaatttttgtgtttttagtagagacagggtttcaccatgttggccaggctggtcttgaattcctgacctcaggtgatccgcctgcctcggcctcccaaattgctgggattacaggcatgagccaccacacctgacccrgaattatttattaaaacgttaaaaaactggttccaagtctattgtgaacagtgctgcaataaacatacacatgcatgcgtctttatagtagagtgatttgtaatcctttgggtatatacccagtaatgggattgctgggtcaaatggtatttctggttctagatcctaaggatggaatgataataggtaacatagtgctgactgtatgccagacacttttctctgaagcatggaaagcttaagaaacttgtctagatgacaaagtaagtatagagacaaaatttgaacctaggcaatctgtctgcagagcctgaggtgttttcaaaatatactgccataaaggtattacctagttccgtttcctttcattcttaactgctgtgcatcctgatctttcatatttacagattcagaaaaatgaaacttttgcttctgttttatacttaccggtttagttcaatgtcatgctaagttacttagagtctagattttcctgtatctatattgctttctcaggttgtcattttctcatcttggaaaaaaacttaagagtaaagagagaaagtgcaatgtgtcctccaatagccatttccaatttatactagttaattgaagagagtgatttgttgtattggtacataataactaaaatagtaataattatagtaacaacaaacaatagtgatcaccctgtttgtaatctggtatcatgcagtacmtatcaacataacaaaattgaaaaaccatcattttyccctttctgttttgctttatcacccacttactggtgaagattacagcgtaggatgacaatgtcagctacactttttgcttggctgtgaatctagtcctaaacactaataatatactattttttaaaaaaaattgatttgggaattaagtgctaatgttttaaatgaaaactgagagtgtgttgctagtaagaagttttggttttgattatattgaacaaacactgatttttatatttgtaagttagccatcactttgcctgcttttgccatttaaaaactccrataccccaaatgatagactgttgccaagctgcatctgttttttrattttttgttttgcccaatactcaaatgagtagacaaaataatagtttttatttggctgcattgcaaaacctaaatgtacattttacctagaaaaaaagcaagaccattgatttactaagtctggtagccgctatacggtagatttcataagaaacactattctattgccagattgcagcaggagagaagattcctttgagccaggaagaaataactctgcagggccatgccttcgaagctagmatatatgcagaagatcctagcaataacttcatgcctgtggcaggcccattagtgcacctctctactcctcgagcagacccttccaccaggattgaaactggagtacggcaaggtaaagtgaaagaaaatgaaaagtctcactctttttaagtttttagtacattattgtttttggacacattcttatccctgagtcttacagaactgtctagcatattttaaaataaagaatttaagtgatttctcagtaaccattactttttgcctctggaattgttatttttaaagaataacaagtatttttcaacaacggactccttttttttgaaattcagcagtacttggtcaaacctaaccaggaaatattttrtgtgtactgttcttgaccttgcctcattccaaaaatgatttaagatgactgatatctgctatgcacaaggcagactgccttcaaaggacataaagtcaagttggagaattaacacataaacttagtataagctaaacaataaaaaaattaaagtaaagaaacagtggaagagctatcacagttcagcatatgattaataacagtggtcataactagtgattatttaggacttcctacttacaggcactgctctaggtgatttttctacttgtgttcctttcaccatgagaagtaccctgtaagtaggcattattatcatccctgttttctagatgaggaaactggagcacagaagagttaagtgacttgtccaaggtcatccttggagccaagattcagacccaggcagtcttgctccagagtcagtgctctgagcctccacggtctcctgtcatcttaatttcaattgctggaataagttatacagtgatgggatatagcaattctcaggggtaagaggtcacactagactgatataattaggacaagttttttgtttgtttgtttttttgtttgtttttgtttttgagacaaggtctcactctgtgcccaggctggagtacagtggtgtgatctcagctcactacaacctttatctccctgacttaagcagttctcaggcctcagcctcccgagtagctgggattacaggtgtataccaccatgcctagctaatttttttttttttttttgtatttttagtagagacaggttttcaccatgttggctaggctggtctcaaactcctggcctcaagtgatctgcccaccttggcctttcaaggtgctgggattacaggggtgagccaccgtgcctggccaggacaagtttttaagaggatgtctggaatggatttagataggtagatttaaacagcataatgaagagtgaagaaaagagaaaaaggtatgtttgaagaatagtaagaaaatatatgactggagacatgggttgaaggcaaatcctagtgtcctaaaagccaaaatgaggatttaggtcttcttaaaaataaattggcagcattttgagagctctggataagccacagcaagatttggtagttagtagactttttaacttagcaaagcatcttaactctgcttgccccaccggttccttccttttttttttttttttttttttttttttctgagatggagtttcactcttgttgcccaggctggagtgcaatggcacgattttggctcactgcaacctccacttcccaggttcaaatgattctccttcctcagcctcctgagtagctggaattacaggcacccgccaccacgcccggctaattttttgtatttttagtagagacagggtttcactatgttggccaggctggtcttgaactcctgactttgtgatctgcccacctcggcctcccaaagtcttgggagtacaggcgtgagccacctgtaggcacctctaatcttatcaacgaggactctggggttcaaagaggtcaagtgacctgccaaaatcctggaaagaccctgcaacaacgttcttttcaacacaccacatcctttctacttgaaccatttctaaccagtggaatgtgccctggttcagattcttgttctctaggactgtaaccatcccagtgatgatagctgccattggtttatcagctttgccaggtatggcacttgtcactttattgtcactcctcccagcaaccctgcaggacagaggaattattaaacttgcttgactagtacggaaactgaaagagtggaggggaggggaatgctaagggcagaaatgaggggaatgtgagagggtggagggagattgtgttgactttgaaaatgagaagggaaaagaagattcagaagaagataggacggggaaagccagcttgtgtgccattgaatcaccacgttagggcctggtgctgttgggtggcccacctcgttacacctggtgagttttcaaagccytctgaacctcagggtcctcatgaataaatttgtgttgttatttatcatgcaggggtttatgaggattaagyrtgaaatgtacataacaaaatgtcttgctcgttgtattttattccttcgtgttttgacttgaagaggttaccgtggttttcaatttcaggagacgaagtttccgtgcattatgaccccatgattgcgaagcyggtcgtgtgggcagcagatcgccaggcggcattgacaaaactgaggtacagccttcgtcagtacaatgtgagtgatctgagaccgtgccagtgaccttgatgtgtttggtcagcaccagaggtcagcctttgtctttggcagggccttggtctcgtcagcatattttctatttccatcaattgcccaaacaaaatagtttcacatgggagaattttgcgtgggccagaacagggtttgaggacttcttcatttcagttacaaaagaaagattgcagaagtaaaattgttagtgtcagtgctatgcttcggtgaaatcctattcactctgtagataaggccagctatacatggtaccttcgtaggttttttatttttcctaagagctgtccacagtagaaaatacttaggaaataaaagcagatgttttcctgaatgttgttttcgctacccagtatgcctgcagtccagtagtttttctctaaagtaaaataattatgttcagtttcatccctttaatagagtttgttatttttctgtagaacattaatttccttggtgcagaaagtcccataccacattgatttggctcatagaaggatttattaacccagttattcaacttgttattgttaataattgatcaaagctctggtctctgtggctccaaccacactggccgcctcaccgcttctgagactcactcagcatggagccatgcattcctgtccaatcttccagaatgttcttcccccacatgattgcagggctccctcctgactaccctgctctcctgctctgagccctttcccaggctgccccatttaaagtatgaccttttgttattctttatcctcttagccagccttcattttcttcatagcatgtaacattatattcaatacctgtttacagatattgttacttgttgccctagaatgtaagcagagactgtgaaggcagggacatcatatgttttgttcctcactatgtccccagtgcctggatcagagcctggcacttaagagatgctcaggaaatggctgttaaatgaatgaaggaatggatgagtgaatgaatgaacccaaagctcagatagctggttttacttttgatcccatttattggtgtatttgggttaattttataccttttaaaatttttgtatcggtatataaaatttggattttattgttggaaagaagctcttttgagggcatttaatcctatcctctccccagtatagcaatccagcttgctgtttgcagtcttcctattctgtggaagtgttctgagcagcaagtcttcgataccttgcaaatgaatttcatttatgtttcttaacatttattatgttcctaacctgagtcaagtaagtgcctcggtatttccagcatcctctttgtcatattaaaatgtaatttttagtgtcaagtccagatggatatagtaatagcggatggacatagtgatagtgagatggtttttttgtgttttttttcctgagaattgtcctgttgccacatggtaccttagtaggttttttatttttcctaagagttgttcacagtagaaaatacttagataaaaagagcagatrgttttctgaacatattgttttccccactcagcaggaactgggggtttattctcttcctagattgttggactgcmcaccaacattgacttcttactcaacctgtctggccacccagagtttgaagctgggaacgtgcacactgatttcatccctcaacaccacaaacagttgttgctcagtcggaaggctgcagccaaagagtctttatgccaggcagccctgggtctcatcctcaaggagaaagccatgaccgacactttcactcttcaggcacatggtatggaaggcttttctctttcctctgcttgtcaagttytgcaaatcatcattgaacatgcttttctttctgtatggcacactgacctctcttttctcctctcagtgactgacaccattcttttcagatgtgttttttagtatgaaggaaagctcttcacttaccrtggatgcacccataaacactatttaacccattaactggagtgtaactaatcacctaacattgtagaaatggatctctttggccrggcgcggtggctcacgtctgtaatcccagcactttgggaggccagggcggctggatcatgatgtcaggagatcaagaccatcctggctaacacggtgaaaccccatctctactaaaaatacaaaaaattagctgggcgtggtggcacgtgcctgtgatcccagcactttagaaggccagggcgggcggatcatgatgtcaggagatcaagaccatcctggctaacatggtgaaaccctgtctctactaaaaatacaaaaaataagctgggtgtggtggcacgcacctgtagtcccagctactcgggaggctgagacaagagaatcgcttgaacccgggaggcggaggttgcagtgaaccgagatcgcgccactgcactccagcctggacaacagggcgagagttcatctaaaaaaaaaaaaaaaaaaaaaggaaatggatctcttttcagtcaaacacttgttctccccacatcctacactaatttcttatcacttcttttgttcgccactcctcatagccctactttgttttgtcctctgtacctgcagcaactccctttgtcccagagtctcaagacaatctaagactggagacttagattccccagggttacccatgacttattgtcgaattacttccgctttttccatcctgtgattgaatgtctacctagagacttcatagtgtcatagaatccaagcataggaagggccatagtggggttcatcctggctaccacacatatgcattgcatccctaccccagcacacccactaagctgttgcccaacttcttcctaacaccttgggaaactggaagttcattacctcatcaggtagcttacagtttcagtcagttctccattagaaagttctgcctttaaaccaaacaccgcatgttctcactcataggtgggaattgaacaatgagatcacttggacacagggtggggaacatcacacaccggggcctgtcgtggggtggggggaggggggagggatagcattaggagatatacctaatgtaaatgacgagttaataggtgcagcacaccaacatgacacatgtatacatatgtaacaaacctgcaccttgtgcacatgtaccctagaacttaaagtattaaaaaaaaaaagttctgccctttaaattgatacaaaatctcagctctcacatactttttgcatttcaggctagctctgactttcggagcaaacagaatttttaaaaatctgatctatttttctcttttattggtaattattatattaccctatacagtttgagcatcccaaatccccaaatccaaaatgctccagaatcggaagctttttcagcactaacatgatgctcaaaggaaatgctcattggaacagttcagattccagatacttggatcagggatgctaagccagttaaatataatgcaaataatccaaaatccaaaaaaaaaaaaaaaaatctgaaattcaaaacacttctggtcccaagcattttgggtaagtgatactgaacccgtattattataggatcctatcattagaatctttaatttctgaattcatttagattcattcaagatagctgtatggaaagcttaaaatgtaaaatgttttaagtcccgaaaactgcatctttagaagatttgtgctctatcctcattttatccttttacattgaatgaaaatgcatctaaatacgtcccatgtggtattcctgagcctgaccttaacgtttttagaatggarcgttgtcttactgtgaccttccttttgaaagtttataattggtacagatatgaggttcagaataaattgcatcagcttagctatgctgaagctcctggatattgtccaatagaggatatacacccaaatgcctataaggggccaggcgcggtggctcatgcctgtaatcccaacactttgagaggcccagggcgggtggatcacttaaggtcaggagtttgagaccagcctggccaacatggtgaaaccccatctccactaaaaatagaaaagttagccagctgtggtggcacccacctgtaatcccagctactctggaggctgaggcaggagaatcacttgaacccaggaggtggaggttgcagtgagccaagatcatgccactgcactccatcctgggcgacagaacgagactcgtctcaaaaaagaaaaaaaaaaaaggcctataagggctgggccaacaacataaaaacataaaagagtaaaagaggccaggtgaaagaaaaatagtgaatagtagagactggtgacctggaatgaatttgccccatcaaaaggtggtgactgtggtacagtttatgccactatgggattagagtttagattgcaaatattcagattcttcaatagaagctagaatttttcacatgaaatttcataagatgtaaacaaaacyakccctttaaacttaacaagaagaacaaaaaaagcacatctgagctgccagtttaggacgtgtgtttttttttttttttttttttttgagacggagtcttgctctgtcgcccaggctggatccggtgcagtggcgcaatcttggctcactgcaagctccacctcccggattcacgccattctcctgcctcagcctccagagtagctgggactagaggcgcccgtcaccatgcccagctaatttttttgtatttttagtagagacggggtttcaccgtgttagctaggatggtctcgatctcctgacctcatgatccgcccgccttggcctcccaaagtgctgggattacaggcatgagccactgtgcccggccagcacttgcattttatgttttcttttgtaaggtgtaaatttcataggcttgatactcataagtttgttactgaattttaaattttttctagatcaattctytccattttcrtctagcagtggaagaagactgaatatctcgtataccagaaacatgactcttaaagatggtaaaamcagtaagtaatgtttcattaaaagagaaatgtgagtcatagaaatgtatcacattaatctgaaaaagaggattccagcctggccatnatcagtcagttacattttttaaatgcctaggctaaacattggagggaaatatgccaatataatagaattgattggctctgggtagtagagttgatggtatttgcttttcttctttacactttttaaaaattttgtaaatattctaaaaatatgtcataaaataaacatagcaaaacagctgaaatgaaatatgccagaatgttagaaatatgcccaaaaaaacctctttttccccaattctttgtacttttttttttgctttgcaatttttctgcagcgagagtgtattacttttaaataagaaaaacagttttcaaaactatgtcagagagggacgattacccactgcccatgcagtgtttcaggggtttcaggtggaagtgggtcactgcagagctgtaatttattaagtgccttatctgatgtaagtttttatcttcacaacgtaaatgagggggagtcgctgttatacccacgtatggaagatgaaagcatggatggtaaggcacagaagtgaagtagtttagtcaaggctagtgagtggcagaactaggattcacaccyactctttgtgacattgactcttaggctgtttccaccacttttccagtagaaaattgatttttgattgtaaactaatttgagttggctcgacttagtgactgattttctttaactgatgtcaaaagaggctgacgcttaagccagaaggcagtttataaacttttggctggagcagtgtagcagcaggaccagaattctatgatagctggtcactgtatcccttctgctgtgagacagtttgtgtgggaggcccaatgggcagagtcagagctcagaatcctggctaaccttgaatgtgacatgtcattgaactgtgacagttctggtataaaaatatgcctcccaggtagagcagaatactttcaccagctgatcacagaacgctcttccttggacagaggaaaatctcttttacttcacctctatgaagacactcacccagtaacaaatttttttttttttttttttgacacagactctggctctgttgcccaggctggagtgcagtggcacgatcttggctcactgcaagctccacctcctgggttcgtgccattctcatgcctcagcctcccgagtatctgagactacaggcacccaccaccacgcccggctaagtttttgtatttttagtagagacagggtttcaccattttagccaggatagtctcgatctcctgaccttatgatccactcacctcagcctcccaaagtgctgggattacaggcgtgagccaccatgccagccagtaacaaatattttgttcacacaagtttattgggttacagctcttcagttatttttcaatcctgagcctagatggtcattatcttaagtgcattgggcatattgttaagcctttataatgaaaatttgtaaacatctttatatagtagcattctgcaaatggttaacccatccatttatgctcatttcatcctaaaaaatacaaccccccaaatctggaagtatcttattctagactcctatatgctgaatgcaaatatcaaaagcggtaaagtttcactggcttcttcaacctgaattgaacagaagaattacatatttgattgtaattcatataggccaactgtgttatttggcatggctcttcactaaagcaccaagcactgatttgaagtatgttgcattttttggaattaaaaaaagttttcatgaaaaaataaatacataattgaaaagccaacatgattgctgttcactacacccttttggcagtattctatgaaaataatccaagtctgtatgtaagagctttcagaaaatgatacatagctaagtctccaaaaaatgctaataagcaatgaccacaattaaatagaatgcatgaaacaggaagcttaagagaccargctggtcacagtggctcacacctgtaatctcagcactttgggaggccaaggcgggaggattgcttgagggcaggagtttgagatcagcctaggtgacatagtgagatcctgtccctatttataaaataaaaatttttaaaaaggaaaaaaaaaaaaaagataccagaagtgccaggcacggtatctcccacccgtaaccccagcactttgggaggctgaggcaggtggatcacgaggtcaggagatggagaccatcctggctaacatggtgaaaccctgtctctcctaaaaagtacaaaaaattagccaggcatggtggtgggcgcctgtagtcccagctactcaggaggctgaggcaggagaatggcatgaacctgggaggtggagcttgcagtgagccgagattgcaccactgcactccagcctgggcgacagagcgggaccctgtcccaaaaaaaaaaaaaaaaaaaaaaaaaggtgccagaagcatttatgagtccaaagcagaagcaacttctagtgaccacagtgagaatgaccaactattttaagtattcaaggcttgcaagctattcttactttgctactagaggccacgtttcacagaaccctgcctaaactcaatgataatagctaagatttattgagtttttggtttatgtcagatactgtattaaacactttccaaagattgtttcatttgcattttcagaamaggccaatgagattagtgttattgttagtgtgaactttataaattactaatctctgtgagccaaggtcaaggctcagagagattagtaattttccaaaagtcacaccagaagttattggtggagtcagggtttgaacccacactccaggatacacgtgctgacctaatactgcaggtgccacacttgataccttcttaaatgcatgagaggatgtttaaggtcctcttgtatgtgacaagagatatctagggtaggagtttttttggtagtgtctttactgtgatctgttggcattcgcgccagttaaatacatgtcgtattttataaattcaaagaaaatggccgtggtgtaactggaggcactttctgataagaagagtaaaagcctgttgacatgatatagggtggagagttttattcattcatacattcaatacaaagtttttgataaaatagatatgccaagtgatgtggagaagagaaggaaatgtctttgtccctgctttttttctgttaaggaatttgccatttggaagtgtgtatgwtgagaagctggagagcatgatggtcaagagtgcgggccctggagttcctgtactttagtatttgacttttgtgaacatttttattttgataatttttctgaaacaactgatagagaggaaaatcactctttgtaaaccaggatgaggagagaatcatagtgggtgttttgtatgcagaaggctaaatgttcagaggagggagaaattaagctgcccaggccaactcttcccaaggacagtgaggctgatgtgaatgggcaatggggtttctgtgctgtggcagggcaccagcagcgtagtgaaggagaagcgtgagcacagagccacagtgcagggaaagctgggggcatatatggggaattttttttgtgtgtattggttttttgtgttttgttttgagacggagtctctcattctgttgcccaggcaggagtgccgtggtatgatctcggctcactgcaacctctgcctcccgggttcaagcgattctcctgcctcagcctcccaagtagctgggactacaggtgtgtgccaccatgcccagctaatttttgtgtttttagtagagatggggtttcaccatgttggccaggctggtctcgaattcctgacctcaggctatccgcccacctcggcctcccaaagtactgggattacaggtgtgagccacctccccgggcctagagaatgttaattgtcccactttcctatttgggtggagcatcaggccgtccatggaggagaatggtaggaaataagactgagagggtggggcctccaatatcaggccaagtatttggaatggggtcggaacatcagctctgactattgagatgagaagcaggaagaccccagaggacctcctcagattcagccaggcctgaggcagtggggcctgaggcagggtagagcagtaggaatggaaggaagagatgcataggayagggaagaatttggcagctttgtagtaactgtccctatttataaaataaaaatttttaaaaaggaaaaaaaaataagatgccagaagcatttatgagtctaaagcagaagaacttctagtgacctcagtgagaatgaccaactgttttaagtattcagggtttgcaagctattctctgctactagaggccatgtttcacagaacccagcagtggaaactgttgcatgtgaaaagcgaaggagtacgaggcatggatgttgcatgtggaaaacaaaggaggatgaggcaaggatgacaggtttcaagcctggatgacaaggagcatagggatgccagtcagggagctcacaggtctggagaagaaggtagagggagatgatttgtcggccccgccatgttcgtcttaagtcaccagtggagcatccagctggtaatgacaataatcggaggtcacctggagaaggaatgtcggggctggaaacagatttgagctggcagcatcaaaatgatcattgaagtatcagaagcagacaaattgattttgacctgtatattctaccccacaaaactttaggttttcgtctcctcggataatcaaccatttccatactcatgtaatctaggcatactctggagttattacaggtttggttccagaccactacaataaagtgagtcaaagtttttggtttcctcatgcatataaaagttatgtttatattatactttattgtgtgccaataacattatgtctaaataaaaacaatgtatataccttaattaagaaatgctttatggctaaaaaaaaatgctaatgattatctaagcctccagtgagatgtaatcttgttgctggcatagggtcttgcctcaatgttgatggctgtgattgatttatagtggcaattgctgaagattggggtgactgtagcagttttcataaaatgagataccaaggaggtttgctgcatctgctgactcttcctttcatgaaagatttctctgcagcatgcagtgctgttgagatgcagcaattcagtcacatcttcagtctccacttctagtcctagctcccttactatttctaccacatctgcagttacttcctctgctaaagttttgaacccctaaaagtcatccatgagtcattaacgtcttctaaattcttgttaatgttgataattcgacctccttccatgaatcacaaatgttcttaatggcatgtagaaggttttcaatttactttgcctagatccatcagaagactcacaatgtatggcagctattgccttacaaaatatatttcttaataagacttgaaagttgaaattactccttgatccrtgggctgcagaaaggatgttgtcttagcaggcatgaaaacattaatctccttgtatgtctccatcagagcccttgggtggtgactatgtgcattgtcattgagtgataatattttgaaaggaatctttttatctgagcactattgagtaggtctcaacagtgggcttaaaatattcagtaaaccatgatgtaaacagaagtgctgtcatccaggctttgttccatttatagggcacaggtagatttagcatcattcttaaaggccctaggattttcagaatggtaaatgagcatttaattcaacttaaagtcactggctgcattaacccctagaaagagagtcagcctgtcctttgaagcttcgaaaccaggtattgacttctccactccagctatgaaagtcctagatggcatcttcctccaaaagaagactgttttgtctccattaaaagtctgttgttttttgtagccacatttatcaattatcttagctagatctcctggataatttgctgcagctcctctgtcagcactttctgctttatcttgaacctcatgaaccagtctctgctagcttcaaatattttttctgcagcttcctcacttctcttggccttaattgaattgaagagagttagggccttgctctggattgactttggcttaagggaatgttgtggctggtttgatcttctatccagaccactaaaacttctccatatcagcaacaaggctgtttcacagtatttattattatcattattattattttagagatggggtcttgctttgtttcctagggtggtctcaaactcccaggctcaagcagtcctgctttggcctcccaaagcactgggattacaggcgtgagtcactgctcccagcccagctatttcacctttttatccttcatgtgtttactggagaagcacttttaacttccttcaagaacttttcctttgcattcacaacttggtggtttggcatcagaagcctaacttttggcttatctcagcttttgacattccttcctcactaaacttaatcatttctagcttttgatttaaagtgggagayatgtaactcttcatttgaccacttataggccattgtagggttattaattagtctaatttcaatattgtattgcctcagggaatagggagacccatagagagggagagagacaggggaatggctggtcagtggagcagtaagaacacacacaatattgattgaggaagttctctatcttacatgggcgcagattgaggcaccgtaaaacaattatagtagtaatatcagagatcgcagatgactgtcacagatataataatttaaaagttttaaatattgtaagaattacaaaaatgtgacatagagacacgaagtgagcacatgctgttggaaaattatgcttgacatggtgttgccacaaactcaataggtaaaaaacatagtatctgcagaatgtgcaataaagtgagatgtgcctgtaacatgaatcatttattaggtgtatatagtcttaccatttctaaagcattttcatatttgtttaataattgttacatttttatacccatttaatggctcagaaaatcaaggctcggagatttagtgagtcaagatgacagaggtgatcaggtggcagattccattctcaaccaaaaacttctctttaccaattcattgcattttttttttcttgagatggagcctcactctgtcacccaggctggagtgcagtggtgcgatctcagctcactgcaacctccacctcgcaggttcaagctattctcctacctcagccccctgagtagctgggattacaggcacgtgccgccatgcctggctcatttttgtatttttagtagagaccgggtttcaccatgttggtcaggctggtctcaaactcctgacttcgtgatccccactcctctgcctcccaaagtgctgggattacaggcatgagccgccgcacctggcctgcatttttaaaattataatactgcagcctttttgttgagggaaaaatacgtaaaatattcgacaaccttaaaatatctaaaactcaagcctggatgtggtgactcatgtctgtaattctagcactttgggaggcccaggcagatggatcacttgagtccaggagttcaagaccagcctgggcaatatggtgaaacctcatctctacaaaaaaatcaaaaaattagccgggcgtggtggcacgcctgtagtcccagctacttgggaggctgaggtgaggggatcacctgaccccaggaggttaaggctgcagtgagctgtgattgcaccactgcagtccagccagggtgacagagtgataccctgtcttaaaaaataaatcaaaataaaaataaaacccctgaaattccattttaaaaaagaaaagtttgaaattcatctttattggtactagcttgacagatgcttttctaacaaaatactttatttccaagaagttcaaagttgttgattttcctttgaatagttggttgtctttaggttgagagtgagattctttatatctcggttattaaataaatgaatgtcttctaatttttcttcattttttccctttttccataaagatgtagccatagctgtaacgtataaccatgatgggtcttatagcatgcaggtaagccttactggttttgttctacagtgcagagctgaatctgaccgcttttatactgaatagggtctttcactctctggtttcccttaagcctttgactattatgactgtagttaagagaatatcttatgcttgtatttcagacccaatttggggaaattaccccctatacrgtttctaactgattgtttactcagttgggctgtgattcctttaagaataaaaacttggcaaaaagtaaaagctcaaatcagacattcacaagcccctaaagtktgtgcctgtatttacagcaaaagcagcagttttcacattttttgtctcaggaactgtacactctttaaaatacccaccagagcactttggtttgtgttaattatatctcttgatatttaccatttagacaatttaactgagaaaatttaatttctaattttttaattgtggtgaaatacacataatgtagaatttaccattttaaccatttgcattcagtgcattcaagttgatatgtaaccatcacaaccatccatctccagaacttctttcttcttgtggaactaaaattccgtactcactgattaaacagttaacactccgttccttcttcccccatcccctgagaaccacgattctactctctgtctctatgaatttgactactctaggtacctgatataagcrgaataatgtagtatttgtccttctgtaattggcttatttcacttggcacagtgtcttcaaggttcttccatggtgtagcatatgtgagaatttcctttttttttttttttaagggtgaaaaatactctgttgtatgtatataccacatattctttatccattcagccattaatgaacattcgggttgtttctagcttttggctattgtgaataatgctgctatgaacaggggtgtacaaatacttctttaagaccctgttttttgtcctttggatatatatccagcagtggaattgctagatcatatagtgattctgattctttgaaaaaccgccatactgttttccattgcagctgtagcagtttacagtcccatcaacagtgcacaatggctccaatctcttcacttccttgccactacttattattttctggggttttgtttttttttttgttttataatagcaatactaatgagtgtgaggtagtagtatctcactgtgactttgacttgcatttccataatgactaatgatgttgagcatctttacttattggccatttgtatatcttgttagaaaaatctctattcgagtcctctgccaatttcttaatttaattgttttgttgttgttgttaagttataggataaattgaaaaaattgtaaaacctaatcacaagtacacattccattagccatcagagtgataacattatcacacgttcagtagcctctggaaaattccactgtgtacttatgagagaatgagagtataaaaaacaaataatatcttaatctttttttctttttttttgttttgagaaggagttatgctcttgtcacccaggctggagtgcaatggcatgatcttggctcaccacaacccccacctcccaggttcaagcgattctcctgcctcagcctcccaagtaactgggattacaggcatgcaccaccatgcccgggtaattgtgtgttttcagtaaagacagggtttcacygtgttggtcaggctggcctcgaactcccgaccccaggtgatccgcccaccttggcctcccaaagtgctgggattataggcgtgagccaccacgcctggccttcttagtcttattatgactttgtggatgccctaaaagggtattagggaccccaaggaacacataggtcatattttgagaacctctagtgtaaagttcatggtaatcctcaattagaagaagaccattacattggcaaaatggaatgcttaaatggtttaaaaaaaaaagtgggaattcaatcaaattcctatagtaaggtacaacttcagggaatagaataaatcatttttaatatgagctaagagatgtcaaatcctgcagaacagatttatcagtggtatgtattagacctcccaacactttgagacacattgattttctttctgtgagattcagaaaaaccatggaaagtctgcctacttgggtatgagggttataattcatattaatgcctctggtttgagattatttcttgtccctgttagctggtaaagtagattgccaatttgttctaatctgctcatggaactacattcacaattttaaaatgtgttttcgtgaatctttaaacaaaactgttttcaatctaacctttatgtcctaagagttccacaaacattcaaatggctgttttagtaggttacaaagcatagtaaaatgtcatatttaacttaggatagatgagaaccaatgtgtaaatattgcagtgtgacctatttcaccttagtgtacgtaatatatttgaaaagaatagccatgtgacttctacactagcattgtgggaattgaaatgaagactagagagagaagatgtaaatggattttttacctcagggaaattttaaaacaggttccatgtccttttatcagcttccttgaaacattgtgaactttgttctttggcatatggtctctgagagtgagaaaattatggccaatctccagctaatttatgttcttaaatcataactgaaacccatgattgggcctacgtgttgataagataaaagaatatcatctaattatgtgattctggcatttttttggtgactgactttggcacaggaaaactaaatttgacttcaaatactcagaaataagtttatattacaaacatgtaatatatgcaaatgaattttaataattttgcataacttggtttgtatttttgtttcatatttttaatgctatctttatatgtttacgtgaacctttatctatagcattatggtgctatggataagttatataacttttttttcccttttaattatcttcctgtcatttctatgtaaagtatcttggttaggaataggggaaaagttccatgactttttaaaaaatatatgttatatatgtttaagacacattttatgttttaaaactaccaatagtgaagaattgattctgatcttattaattctgtagtgttgttcatttattttaaaaatcttatttttcatttttttcagattgaagataaaactttccaagtccttggtaatctttacagcgagggagactgcacttacctgaaatgttctgttaatggagttgctagtaaagcgaagctgattatcctggaaaacactatttacctattttccaaggtaatgtctcttctttataatatccctcctggggcatgggagaaaactgtttgaccagagacattccactgaaagagattagaaagatccagcttcctgtgaccactgctgtgacctttttccctcagtttcccccaccattctgtgtttctttgccaaattcctgccctctgtagtttcccattcacttctctcgttcacacagatgctcattgatagacacatacccattttcttcctgaattctgaaacaartccttccattttctttgtcagagcatatctccctgctcagtgggtggtggtatctcagggctttgatgtctgaacacttttccccacccaccatccccctgacaactggaatcctggtgattttggaggaggtgaccactgagagaggagtctgtggaccagttgttccttgtggggaaggtggacagtaggaaggtggatggcattactgctggtctcttgacagtcaaaggatagccgaggcaggctttgcatggttttggttagaagcctgctgcccagtgagtccttaaccttcggcctgggcagaaagaggataatgcattatcatatatgctgtggcctcacagtgctttgtgatgagattcctttagtagtctagtaattaaactactatatatggagttgaggatgatcccactttgccaggcattcctttccatagccaattacgctacagtaatatgatgatagaggccgtataatggaatggtgaaaaactcaagttctaaaatgtgaagctgctttggttcaaattctgccttgccacttaacagccatgtgaccttggccgttaaactctctgggctttagctctcctatctataaacagtttaataataacagcagtaacagtaataataataggtgcagtggcttgtgcctgtagtcccaacactttgggaggccaaggcaggcagattgcttgagaccaggagtttgagaccagtctgggtaacataaccccatctctacaaaaaattttaaacattagccaggcatggtggtgtgtgcctgtaatcctagctacccaggaggctaatgcaggaggattaataggctcaggagttcaaggttgcagtgagctatgattgtgccactgcactccagcctgggtggcagagtgagaccctgcctctaaaaaataataataatgacagtaccttcctcatagagttgtgatgattcacgacatgatgtgtgtgttaaagacagttcctagcatactgagcatctgagagtggggatgctactgaaaatggcttccagacagtggctacttgttgtctacagtgaatgctttattcttattttattttttgagatggagtcttgctctgttgtccaggttggagtgcagtggtgccatctcggctcactgcaagctctgcctcccgggttcactccattctcctgcctcagcctcccgagtagctgggactgcaggcgcccgccaccatgcccagctaattttttgtattttttagtagagatggggtttcaccatgttagccaggatggttttgatcccctgacctcgtgatctgcccaccttggcctcctaaagtgctgggattacaggcgtgagccacggcgcccrgcctaaatcttttaatatactgtgaggcatgtataccgttacgcctttacaatgggaaaccaaggctgagagaggtttaataatttgctcaaggtcataaagctagattagaaccctggtattaatggtgactaatttatttttttttttgagtcagagtctcactctgtcacccaggctggagtgcagtggcgcagtcttagctcactgcagcctctacctcccaggctcaagtgagcctcctgcctcagttcccaagtagctgggactataggcgcgtaycactacactgggctgatttttgtattttttgtagagatgaggtttcgctatattgcccaggctggtcttgaactcctgggctcaagccatctgcctacctcagcctcccaaagtgctgggtttacaakcgtgagccactgggcctggccatgatgactaatatttaacaaattgctgggaaacaattattacctcaggtatattagtaaaaatatagtgataggatgttgattcggttttcagtttgttttctgtttctaggaaggaagtattgagattgacattccagtccccaaatacttatcttctgtgagctcacaagaaactcagggcggccccttagctcctatgactggaaccattgaaaaggtaatcacatgacatctgtagaatgatgttcagtaagttttaatacgtggctttgttaaacttgtcatttatgtccttttccctttctaaaccktgctcattggaaagcatccacttcacaaaaacaagaggatctattacagattcaaattgtttattacagtcctcactgaaaatacccatttacctaatttatgaaaaagactgctgtttttgaaggcaggcatttgcatcaaagtacaaataatctaaattgtctttttatgattaaaactgagcattcattaagcattattcaaaaaagctggttttgaatgttaaatttaatagcagcaaatttttcatgaaataatgacattttcttttagtgtacgtagttgcatctgcgttaatgtaaaaggctggtatyggtgaagaacagtacggtttggtgttgaatgcagtatataattcacagttgcagtccatactgtctgagtcagttcaggctgctagaacagaataccatagactgggtggcttttaaacaatagaaatttatttctcacgattctagaggctgggaaatccatcaaatcaccagcagattaagtgtctggtgagagtctacttaccgatttcataaacagccattttttctctgtgtcctcacgtggtggaagggacaagggacctctcttcaggcctctttcataagggcactaatctcwttcatgaggccagatccctcatgacctaatcacctgctaaaggccccacctccaaataccatcatcctggaggtcaggattttaacaaatgaattctggagggatatagacatttagaccctagcacatactgatataacatcaaatggtgatagatcagtatccgtagtctccttttatatacttgaatacagtagagtctcctcaaatacacttaaatcataaaaactcaactgtatatgcttggaacaaaaaaagaagaagaagaaaataactacttaaatagtgtgggtgatttcagccactattctcgtttggaaatatttaccccaagtgggtatgagctaggagacctggatctgcctttagctcatttgatttcagttcccacaggcctctcatagtgcaggcatctctgcacaactctgttagtctcccacttagtagccatgttaaccaaaacgaaagtgagaccatataggatctatgagtccatttatatgtatacaaaagaaaatagaaatctctttctggggttgctaataagtttgattctgttgcatgaagattgtcttcacatttactacacagggctccgaagacttcaaacacacttactatacttagccctagacaaccccaaaacaagaaaaccagtcaagaccctcatccctcttccctctctggggaagacatttaagtatattagtccttccctactggcaatgtgtcttgtttctacattcttgaaaaaaatgaaaggatttcaaaatacatggagtatattcatgtgattcaagtaaaactaagtggttttgtgggtggggacaggggactaagcagtgctacccatggacgacagtgccagcaatgccagattgacctgtagggctctcatttgaccagtgcatttgggctgtaggcctctgatttgaccagtgcatttgacctgtaggcctctgatttgaccagtacatttgggctgtaggcctctgatttgaccagtgcatttgggctgtaggcctctgatttgaccagtgcatttgacctgtaggcctcttatttgaccagtacatttgggctgtaggcctctgatttgaccagtgcatttgggctgtaggcctctgatttgaccagtgcatttgacctgtaggcctctgatttgaccagtgcatttgggctgtaggcctctgatttgaccagtgcatttgacctgtaggcctctgatttgaccagtacatttgggctgtaggcctctgatttgaccagtacatttgacctgtaggcctctgatttgaccagtgcatttgggctgtaggcctctgatttgaccagtgcatttgacctgtaggcctctgatttgactagtgcatttggtctgtaggcctctgatttgaccagtacatttgggctgtaggcctctgatttgaccagtacatttgggctgtaggcctctgatttgaccagtacatttgggctgtaggcctctgatttgaccagtacatttgggctgtaggtctcagatttgacctgtacatttgggctgtaagcctctgatttgaccagtgcatttgacctgtaggcctctgatttgaccagtgcatttgggctgtaggtctcagatttgaccagtatatttgggctgtaggcctctgatttgaccagtgcatttggcagatggcacaaccacatgggctctacttctgctctgtaagtttatatamcaaatctrtggaccacaaaggacctctgtgttgttttttttctttttatttatgttttattgtttatattcatggtttgcaacatgatgttatgagtatatatagacmgtaaaatggttactataatgaagcagatkaacatatctaggacctctgtgttttcaaatattaacctgtcacactgaatctcaaggtgtttgtcaaagctggagacaaagtgaaagcgggagattccctcatggttatgatcgccatgaagatggaggtaaggaaatcatgagttcatttgctatgargactttgggagcaatcatacctaatggttcttttgccttattttgtaagttaataccaccttaaatatgaaaagccatgattgacgaagcattaattgtaggaaacaaaaccaaactatccttcttgtagaaaagagttttactttaactttgtgaaattgcacctgtcatttctgattctgaaattaatgaaattatcaatagcttggaatcaggcgataatccaactgaatgttaactgttggtattttctaagataatccaactgaatgttaactgttggtgtttctggaatgttaactgttggtattttctaatgttaactgttggtattatcttggttctaaggccgaaccaaggatgccaggcatcagtttcaaagtgaaaaccgcaatcaaattaaattagctgtttaggtttttagatggttcaaatggtaggtcagtgattcttagccctggctgaatattgcagacagtcctcaacttacaatggttcaattaaggatttttcagcttgacaatggtgcaaaaccatacacgttgaatatgctcctcagcttacattggatttatctggacctgaccccatcgtaagtcaaggagcatgtgtacagtcacctggggagatttgaaaaaattcttccccagacccattgaattgcaatctccaggagtagagcccaaggatcaatacttttgaaaggctgggcgcagtggctcatgcctgtaatcccagcactttgggaggcagaggcaggcggatcatttgaggtcaggagttcacgaccagcttggccaacatggtgagaccccatctctattaaaaatacaaaaattagccaggcatggtggtgcatgcctgtaatcccagctactcaggaggctgaggcaggagaattgcttgaacctgggaggcagaggttgcagtgagccgagatcttgccactgcactccagcctgggtgacagagcgagactccgtctcaatttaaaaaaacaaacaacaaggccaggcgcagtggctcacgcttgtaatcccagcactttgggaggccgaggtgggtggatcatgaggtcaggagttcaagaccagcctggccaacatagtgaaaccccgtctctactaaaaatacaaaaattagccaggtgtggtggcacacacctgtagtcccagttacttgggaggctgaggtgggagaaccgcttgaacccgggaggcagaggttacagtgagctgagaccatgccgttgcactccagcctgggtgacagagtgagactccgtctcaacagcaacaacaacaaaaaamaaaaaaaaaaaaacaaaagcaagcaaacaaaaaactgttgaaagcttcctaggtgcaattctcatgtgaagctcaagttgagaactgcgagctacaccagagcttcccagtcatatcgttgaaaggttactgctgtgtcccagtgttcattcctctcaacttgttgctgttctccctgtgtgctgtgatgttaaaaataaaaacaacaacaacaacaaagcgttggaaagcaccgagagatgacaaaacatcaaagttggctacagttttcatttttggtctccctttcttgacttggtgtatactcagtcctcattagtattgcagctatcatttgtcctgtcatgtgtctctgcagcataccataaagtctccaaaggatggcacagtaaagaaagtgttctacagagaaggtgctcaggccaacagacacactcctttagtcgagtttgaggagraagaatcagacaaaagggaatcggaataaactccagcaaggaaatggccagttaagtagtgtcttctctctccaccaaaaagaggaagtgcctccagcttttctgggggtctcataaagagcagttttactaaatgattgtatgcttatgctgaacacctttcatattggagaatcatgcatttgggtcactaattatctcaaaatatttcatactaataaagttgaattattttttattggaagccaatgtttgtttctgcctcaaattttttacaaggtagtctcttttaggaaggggggaagagaaaaggacatttaattaaatgaattactttccagttgctgttatgatgaaaatgagcagtaatatgtttcagagacaggtgccctggagttcaacaactaaggttttgtctggccaaaaagcaacttgctaggtagtttaaaagacatggatattagtcgggcgcggtggctcacgcctgtaatcccagcactttgggaggccaaggcgggcagatcacttgagttcaggagttcgagaccagtctggccaatatagtgaaacccgtctccacaaaaaataagctgggtgtagtggtgaacatctgtagtcccagcaacttgggaggctgaggcaggagaatcgcttgaacctgggaggcagaggttgcagtaagtcgagaccgcaccactgcactctagcctgggtgacagagcgagactctatctcaaaacaaatacataaatataaataagtaaagacacggatattgtttctagtgtttgtgattggaaagttwctaactagattgcctctgcctttattgtactttctaagcttataaaaatatatgtattatatatctattacatgctaaaatatattaatatttaatataacattttggtaaatttgaaaagcataattttacagaaaaagttggtaagagttaaaagcctgagcctgctgaatgctttttttagaaatacttttttcattatgaagaaaaaccattcagtttacttttgtctagattctgtgttacttttactaacagatgtgcagccctttgcatttttatgtattcattgaagtgttaaatatttgttgaattgagttcttgctgaatacataagactatgctaaatgttgtggaaaatacagagaaatataaaagatggtctccgtactttaagatgcctataattggaaaagtaaaacataaatcatgtctgctatgattagaatgggtcccctatgtttcacgtgttaaaaacttaatccccaagttcatgtgttgattagaggtaggactttcgagaggtaattaggattggatatggtcatcagggcggggcccccatgatgggactggtggctttaaaagaggaagagagacctgagctggctcgctcttgccctcttgccatgtgatgccctccaccatgttatgacacagcaaaaaggccctcaccagacaccggccccttgatcttgaacttcccagacttcagaactgtaagaaataaattagttcataaattatccagtctgtgatactctgtttcagcaatgcaacatagtctatgacaatgtcgaaagttacagttttagcaagggtgccgtttcccctttccaaacaaaactttctctgtttaaaagagggaaaagcagccgggcgcggtggctcacacctgtaatcccagcactttgggagctgaggcaggcggatcacaaggtcaagagatggagaccatcctggccaacatggtgaaaccctgtctctactacatatacaaagattagctgggcatggtgatacgcgcctgtagtcccagctacttgggaagccgaggcaggagaatcgcttgaaccagggagtcggaagttgcagtgagccgagatcatgccattgcactccagcctggtaacagagtgagactctgtctccaaaaaaaaaaaaaaaaaaatagagggaaaagcaaaaggtgctgtgatggaaatttcacattgctgtttgccccctttcggagaatgctgtttgtatccttcagtggaacatggttgagttcactgtttcattgttaagtgactgtgttggggatatgtgtattgaaggaattcgaagccagctagcccaattacccacatattggtagaattctttctttaggatctttgccagttctggtgctgtgtgagcagagttattttgcacatgaatgcatctgtttgtgctacagacacttacagagcatttgctctacactagggcctctggaacagagatggtaagaaatgatttctgctcttgccctatctaatgggaaacaggatccagctgcatagaaaaatgtaatataggccgggcgtggtggctcacgtctgtaatcccagcattttgggaggccgaggcaggtggatcacctgaggtcaggagttcgagaccagcctggccaacatggtgaaaccccatccttactaaaattactaaaattaattgggcatggtggcacatgcctgtggtcccagctactcaggaggctgaggcaggagaattgcttgaaccccagaggcagaggttgcagcgagctaagattgtgccactgcactccagcctgggctatacagcgagactccatctcaaaaaaaaaaaaaggtaatataattgacagtaagtggtataatataccagtctactaggtgccatgtgcggtgaggtgagtgaggtactaaattctgctttgggtcaggaggcagagggagaggcagtgatgtctgaactgggctttggaggatagctgtttgccagatggagaaagaaggtggtgagtccaaggccactgcaggcagaaggactggcaaggtctagaacagtaaggcatgaaggcatgcaatgtattcggggcacagagtggatggcctgggccactaggcagagaagggcaagcaagggaygcagctgcctagcaataaaaggccttctcttgtcccagaggacttcattctggaggcagtgaggagctgctggagattttcaaccaacttaagtttttcaagttgtataatgtccacagtctggagtacaggccggaaagtggagagaggctggagacagtcccaaacagacaccagatatgtgggccaggctggctgcagtggctcaagtctataatcccagcactttgggaggcagagtctggagggtcacttgatgccaagagttggagaccagccccacgccgcctgccccatgtctctacaaaacatttaaaaattagccaggcatggtggtgcatccctgtagtcccagctacttgggaggctgggatgggaggatcgattgaacccaggagtttgaggttacattgctctgtgatcacatgccactgcactccagcctggacgacagagtgagaccctgtctcaaaaaaaaaaaaaaagacaagaaaaagtacaggtcagagtggggaaaacagactttggtgcacatcttgacttaaaagtacttctctgttggataagacccattagaggcatggaccaaaacagagtcattagttgggaaaaaagcagcttgctaccttctctttgacagcagcatggctcaggtatttaataaccaagagaacaacaacatttaagcaccccaatgattgctttttgatcacaggggagaacacacagcattgtagttgaaatacagcggttaaaattcttgcattcaggccctagctttgtcacttattagctgtattgccttgggcaagtcatttaacctctccgagctttatctgtaaaattgaggtggcagcactacctcacaggcttgttttggagattaaaggagaaaatgtagaggttgcctttagcattgtacctggaaaatcatttatacttccctggtagttattaccaactctggttcttgctagggagcaattaagaaactgctttaaattcagactagctggttactcttgccaggaaaaatcccaggtcccaggatggtgaaaaatcctgcctggatatgcatcaccctgtcccctccctaccctcccttccccagctgtagcctgctccggtgtgacccaggcacctgtcaaccacttaacagactgtgttgctgccggactgtggggggaagcctccgtcagtagctagagctgtgtgctggtgggacagcggcccgcccacttgcatgaaggctgggtaacttggaaaaactcacttggaacaactcacctagaacaactcacttgtatgaaggctgggtccagacttgctccacctgctgccatcagttgtcacgtgtgtagctggtgctggaggggaagcctgtgtccggcttgcgcctcagtgtgggcaggcatcatacctgctgccggacagcagagtagggtggtctttcatttagctgaactctttcccccctttccccctccacaatcaacttctcactcctgcacacttactgttaaccctcaactagtcctcttaggaatattagaaggtgaaatgtgcatctgagccctgcgtagccagggctcttctgctgttgtcattaaaatattcacagcgttgttagtcatgtttgcacgtctattgcatctttcatcagagggtctcaaaaaagcacttctaggccaggtgcggtggctcacacctgtaattccagcactttgggaggccgaggcaggtggttcacctgaggtcaggagttcgagaccagcctggctgatatgatgaaaccccatctctacttaaaaaaaatacaaaaattggccgggcgtggtggcaggagcctgtagtcctggctactcgggaggctgaggcagaagaattgcttgatcctgggaggcggaggttgccgtgaacctaggttgtgccactgcactccagcctgggtgacagagcaagactctgtctcaaaaaaaaaacaaaagacacttctagatattcacactaggcttcaaaataccccagaagaggaaaatgtgatttaaactgtgtggtagaagaggagatggctgtccccaaatgctttgctccttgcctagtgcggagaaccttagggtaccagtcccctcctgctaataacatactgttccctcagggctgaccccagggtgctgcccctagaggttagtagtttttccccaccagactgggagtatagggcatcacaagaggccctgcccacagctgtcagctctcaaagccacaggctgagtggaaacactcttgcccaccctcccccaacccctgggaatgtccctggggacaccatgccttctggaccaaggggtgcctgggcctttaggagattataaccctgataccaatgattaccttgtcaccctgacatttgtctcccatttgctggatccctggggactcagaatgccttggtgcctctaactggctcagtctcctgcagcgagttccaagtgaagtgtgcactctcctctgccacctccaagccacagcacagacgttaactccctccctgctaagaatggctgacgtcattctctgtatctaccacccctcgctaccatttcgctaaactgttagattagattagatataattcttattccaaaaccagcttcccacagaaacaaaaaaccactaacaaaaacagggtaatttggggcttctccctcttacccagttattccttcatcatgaccaactatgtcataaaagcattacggttttttccattattgaaagcaggcagttaaaagtgctactccagtgaacacacaaatgataagaaggtgaaacagccaggctgggagcagtggctcacacctgtaatcccagcactttgggaggccgaggcgggaggactgtttgagcccaggagttcaggagtttgagaccagcctgggcaacacagggagaccccatctctacaaataatttaaaaaattaactgggcgtagtggtaggcatctgtggttccagctacttgggaagctgaaatgggaggattggctgaacctaggagtttgaggctgcggtgagccgtgatcgtgccactgagtgacagagcaaaactctgtctcaaaaaaaaaaaaaaaaatctatttagaatgggacttttattaaaacatttctccagactaactgatcctctgtttgacttacagaagaagactaatcacttgaaaccttaatagaaataatatgtttcaacgttgctgaggaatttgttaacttcccagacgaaaattc

SEQ ID NO: 12232 - DNA, 170896 bp, Homo sapiens
  misc_feature (1)...(170896): n = A,T,C or G, or insertion/deletion polymorphism (see Tables 1-2)
ccacattcccatccacccactttcttcttcttctttttttttttcttgagacggagtcttgctatgtctctcaggctggagtgcagtggcgtgatcttggctcactgcaacctctgccttctgggtttaagagattctcctgcctcagcttcctgggtagctgggattacaagcagctgccaccacacctagctaattttttttttttgagacggagtctcactttgtcacccaggctggagtgcagtggcgtgatttcagctcactgcaagctccgcctcctgggttcacgccattctcctgcctcagcctccgaagtagctgggactacaggcgcccgcctccacgcccggctaatcttttgtatttttagtagagacggggtttcaccatgttagccaggatggtctcgagctcctgaccttgtgatctgccccacctcggcctcccaaagttctgggattacaggtgtgaaccaccgcgcttggctgctaatttttgtatttttagtagagacggggttttgccatgttggccaggctggtctcgaactcctgacctcaagtgatccacccacctcggcctcccaaagtgctgggattacaggcatgagtcatggtgcctggccagccaccatgcctggcccacccattttctgattttttttttttttttgagaaggagtcttgctctgtcgcccaggctggagtgcagtggcacaatctcagctcactgcaacctctgcctcctgggttcaagtgattctcctgcctcagcctccctagtagctgggattgcaggcatgtgccaccatgcctggctaattttgtatttttagtggagacagggtttcaccatgttggccaggctggtctcaaactcctgacctcagatgatccatctgccttggcatcctaaagtgctgagattacaggtgtgagccaccatgccgggccactttctgtttgatctactatggcagaggccctcaaactttttggcctcaggaactggtttcggggatgtggaagacaatttttccatggatggggtggggggatggttttgggatgattcaaacgcattacatttattgtgcactttatttctattattatattgtaatatataatgaaataattatacaactcaccataatgtagaatcagtggaagccctgagcttgttttcctgcaaccagatggtcccatctgggggtgatgggagacactgacagatcatcaggcattagattctcataaggggcgcgcagtctagatccctcacatgcacagttcacaacagggcttgtggtcctctgagaatctaatgccaccattgctgatctgataggaagcagagctcaggtggtaatgtgagtgatgggcatggctatacatagagatgaagcttgcttacctgccactcccctcctgctgtgtgacctggttcctaacaggccacagcctggttctgatccatggcctgagggttggggacccctgcactatggagctgactggtgggagcggggccagactgggaggcagcggcgggggcmctgggtccccatcttggctttgccaccagattgctgagcaatcttggacaagtcacctaacctctctgaccagggaaataccacccctgtatgccctcattctctctttcccaggtcagcagcggagacaaggaggacagactcctgagtcccatccagatgtaatgtatcattgatgattttgcttacacaataaatcctgccctcaccagagtgctcagtgagtgggtaattctggttaattgaatgttctgggacatggaaatgttcccagaaatcctttttgttccttttgtggctattgaaacccatccactcatctattcagcacatatttgtctcgtgtctatgctgcaccaggttctggagcaggtgctggggataccacccggaatgagacaacagagtccagcctccgtggactcacagtccgggggggagacatggggcaaacatgccaccacatgtggtaggttgggcacactgaccagggaatgcaggctgcaggtaggggcctggggcccagtgtggccgtccttggaaggagctccctgagaaggtgctgtttatgttgacagcactaaaaagcagttaaccatagtgtctgggggatggagtagtcaggggcattccagccgagggcaaaggctcagagaaacacctgtgcattcatttgtgctgtggagcttagagtgtgcagctggggcagggcacaatggctcacacctgtaatcccggcactttgggaggccagagcaggagaatcacttgagcccaggagttcaagaccagcctgggcaacatggtgaaaccccatctctacaaaaaaatacaaaaattggcggggcatgatggtgcacacctgtagtctcagttaggaggctgtggtaggggggtcacttaagcctgggaggcggaggttgcggtgagctgagatcacatcattgcacactggcctcaatgacagagcaagactctatcaccaaaaaagaaaaacaagaatgtgcttctggggaagtgagagtgaagaggcgggtgcatgtcaagagggcaagaatacgtgaagatgtggcctgctgagggctggcctggactgtgagggctgcaggtttatttattttccagcatatgttttgtgatgtcactctttctcgccagagtggagagtagagggaaaatgaaatcaaaacactatcacagaggaggggccttaaatcagaggagtgacagagggctgcgagtgacgttgacaagtggagagcacagctgtgtctaaagggccaccactcctggggccctgcagagtgtggccctgggggaatgtggacctggcattatcagatcttccgatttgttaagagaagctagaaatctggcttttaatttttttttttcagagacagagtcatgctgttgcctaggctggggtgcagcggtgggatcatggctcactgcagcctcaaactcctgggctcaagtgatcctcccacctcagccacctgagtagctgggactataggcatgcactaccgcatctggctagatttttattttattttattttattttattttatttttgtagagacaggggtctccctatgttgcccaggctggtctaaaatgcctggcctcaagcaatcctcttgccttggcctcctaaagtgctgggattacaggcatgagccactgctcctggctgcaatctgactttttatgggaaatctcccaatgattaaatgatggcaactaacaacaacaaaaccactgtgggcaaaacaaaatgcttctgcagactcaatttgttttatgagcaggtggtttggaaccctagacccagagggttatattgataagggttctagggtgtcctttagaatccattacgatcctctaaagagtgtgcccctaacctgtgctgggctctgagggcacaacgggggtctggggcatggcccctgccctcaaggctgtatcatagctgccctcaagctagatgggtcaaatcagttatgcacccagagccaacttacaacaaaaggactaggtgctatagagctcagaggagggagaggtcagggaatggaggaggccatgtgaaaaggcctcctggagattctgggccttgtgttggttctcagacaggagggtaagacttagtacaaccaaagaaggtaaggggcatcctgagctggaggcgtcagacatttcaggatcagatgggaaataagacaataaagaaggccgggcacggtgattcacacctgtaatcccagcactttgggaggccaagatgggatgatctcttgagcccaggagttcaagaccagcctggacaacatagtaagaccaccatctctacaaaaaaaaaaaaaaaaaaaagaaagaaaagaaaaaaaaaatgagccaggcatggctacctggcaatataggcactacaggcaccaccatgcccgcacctgtagtgccagctacttgcaggctgaggcaggaggattgcttgagcctaggagtttgaggttacggygagctgattgtgccagcctgagccacagggcaagacccagtctcttaaaaaaaaacaaagaaagaaaaaaaacatagccaaggaaggggttggagtacactgtgaaagaccgcgatgctggtctgggatgtgtacttggctctggctatgacggcaggactcaaaagtccatttctggtccaaagcttaatgccatgagcctgaggtcactcaatggacatctgaagtcttcttcctgctttgctagcatccccaaacctctcctgtctgctgtcctgccatcatttattcacagcagggcaggggccgtgcctgttgtgttcactggtgtctcctgcgtgcctagaacgatgtctggaacagagcaaaaatgctcaaagaatatctcctgcctacttaaactatgagccagtgttgccctagcctggggctcaggacaactctgtggtgcttatgttcttgtgtcgagagggacaataaacaaaccaacaagtcggtgaataagatgatttcagtgcgtggcctgtgtggcttgtctcactgcactgtagccgtttgtttatttgcgtcttctcctaagcctatgagctccgagggggcggggctggggtctgtctggttctttgtctcactggtagcccctgaggctggtgcctgacaaatagggagtagttaaaaaaaaaaaaaaaaaaaagtttttgctggctgtgggctgtaaggaacacaagctgaaaatgatttcaacctacgtgcacctgtaccctttggaggctgcagaacttatcattatcaacccaggagtaattgctgataagcccgcgtgtgaatttccttgcaaatagaggggtagcgggggagtgtttaacaacaacgcggataatcttaattaatgacctgataactgtaattaattgcatcatatccagaggccctctttggaatttcaggagggagtacctagtgtttggcagctttggagctgcaaaggcaggggaatgctaggatctcagtctcagcactttgctgctcagtgagctttgccaagttactctcagttctgagcctcagttttctcctagggaaaatggggctacatcactggggtgttgccggtctcaaagccgtcaatgcctgaacccgccagggttgttcttggaggtttggctgcatggctgcaaggttccccatgttgccatggcgggggtggggggcaatacggggccgccaagactggttgaggggcaggtcataagtctagggtttcccctggggccggtccaggattctcacccttttgggggaacctcagggcaaaatgttgaagtgggggaggagaagccagcaccctgcgcgcctgcggggtctccccgcggagaaccggggaaggagaaccgggaggcgggaagtggggaccccggggtaggtgaaggagcgaggaggtcgccgtgtggccggggccgggccccatccccgcgggcctcagtttcccccctgtactgtggggggccggtgggctgccgggaccgctgggggctcgcagcgggtcgggggaggccacgtctccctcgcggcgcgctgggagcagggagggggcgcggcggccgctgccccggccaccaggggttaagcggtgacctcagccgcggcgccccgggaccgggcgggcggggacggcgccgcgtcgcgcacggcggcggcggcggacagcgagggccagtcctcgaagctcggcgggcgcgggcacagtcccggcgggcccggacctcgcgggcgggcgggcggcgcggccattggctcgggtgacgacgtctgcgtcggtgggggcgccgtcccggccatgggcgcccgcggcggcctgcggagctggaggcgcggcgccggccgccaggcgcctttgtgagcggcgcggacgacaaaggcgcgggcccgggcagccgaggtgggtgagtgagcgcgggggccctgcctccgcgggatcctcgcgtgtgccggagtctgcgagtgcgcgggaggcgctccaggcgccagggtcctccgggtgtcctgggcgtgtcgccgtgggcgggcgggggccgtgtccgccgctgtgtccctgtgtctgggtgtgagagccccgagcccgcgtctcccctctgtgtgggtctctccttgtgtcactggagttctggtgttactagggcgagtggcctttgtgcttcagcttgtgtgtgtgtgtggcctccagccggctggagtcaggacagtttgggaacccccacccccaccctgtgcctcactttcccctgtggtccacttcttcctgcgctgaccttgggggtccctgggatcgggtgaagtcagggagtgcccctgtcgcctctgtggtgagtcagcctctcccaccctggacccccgcccagaggcggaacgggacggcctcctgcaggaggagactgtgggaggagaggatgccgggtcagccggaggccgtggctgcggagccgccagtcccggatcctccctggaacagggatatatgtcagggagggccctagatgaagaccagcccccctggagtcgctgggatggcctccgagagggagagcaggcctgactgtagggggcatggggacaattcttcctccctctgccaaagcggggccctggggcgggggtctcgaatcttcctttggccctgaaagccaggaggccctgcgttgcatcagtgccaagtagagaggtggtggctggtgggctgcactttcccactggctttggagctcagtttctgccccagagtccttggcctcccttaaggatgctactgggaagccacgccccacctgccgggagccccatctgctcctcctcgggttctggggagagagggcaggttgtgcgggctcattagaatgcatagctcttcccagcatccgcccagcactgtgccccccacggtgttcaggccctggacacacagactagaaagcaggycagcctccggaaatctccaagctccctgtgactgtgggctggggactgcccttccccttcatcgggccctcaggctgaagctcagaaccctcctgtaaggaaggcttcctggggtgcccgaatctgatgctcgctctgtccccaggcgcttgccttcctgaggccccctgtcccttccccttccaccaaagagcctctgtgggctgttctctctatccaggaagtgggtcccatccttcacctctttcatttctcactcgggagctacttcctctccagtgagccagggtagccmcagtgctctgagggttcctgccccagttgtgggggcggggggcttttttcagtcttccagtggaacaggggccrtgtctgtccttgatcacagctcagaacagtgcctggtgcatagtgggtgctctacacatagttgctgaataaatgaatgtccaataactaatggttcccaaattctgtttcaagttttaactctggagtagtctggggaggggcgaaagctggtgtactgctctggggcccaggtaccaggttagtataagaggaggttgggtgtggtggctcacccttgtaatcccagcactttgggaggccaagttgggtggatcacttgaggtcaggagttcgggatcagcttggccaacatggtgaaaccctgtctttactaaaaatgcaaaaattatggccaggctcagtagctcatgtctgtaatcccagcactttgggaggctgaggtgggcggattacctgaggtcaggagttcaggactagcctggccaacatggtgaaaccccatctctactaaaaatataaaattagctgggcatagtggcacatgcctgtagtcccagctactcgggaggctgaagcaggagaatcgcttgaacccgggaagtgcaggttgcagtgagccaagatcgcaccattgcactccagcttgggtgacaagagtgaaactccatttcaaaacaaaaacraaaacagaaattagctgggtgtggtggtgcacgtctgtaatcccagctatttgggaggctgaggtgggagggtcgcttgaaccygggaggcggaggttacagtgaaccaagattgtgccactgcactccagcctgggtaacagaatgagattctatctcaaaagaaaaaaaraaaagaaaagaagaagattgagcatggtggctcatgcttgtaatcccagcactttaggagcctcaggtgggaggatcacttgagcgcaggtgttcgggaccagcctgggcaacacaagagaayatgtctctacaaaaaattttaaaaattagttggatgtgctggtgcacgcctgtagtcccasctactcaggaggctgagatgggaggatcacttgagcctggaagttcgaggctgcagtgagctgtgattgtgccaccgtactacagcttaagtgacagagggagaccctgtcttaawtatatatatgagraaagtgtactgttacttggggaaatagtatattaattaacagacatttatagtatatgctgagtgccaggtgttgggctagatgctttaagcatgtacctcttacacactgagaaggaacagagtggaaagaatacatgtaatcttctatgattaattttgaaaagataaagtaaatgatatatatgccatgataagataataacgtggatttatattgyactttcatatctgctatctctttgttttgacaacaccctagtagttaggcagggagatgggttcatatccatcttacagatgaggaagctgagcatacagcatttaagtgactgtcgaaggtcactgctgaagcgagtcagygaaggcgccagcactcagcctgggactccctggccactcagtccttgctttcttctgcacaactgtctccagtgccttttgtattcctgtcacccggctagacaagggtgaatgggccactgttcttgccctcaaggggtctaaagtccaggagagaatcaggctctttaacaactgagtgtgccagagttgttccgccccayggtgccaccttgggcccagctcagcyccttccttgcagtgtcccagagagttcttcttctctctacctcagtggagggcatcagagccattttcattcaggaccctggtctgatgacattcccaggagtgactggtccttacagagcctctgccgggtcctgggcagtggtgagttgggagccagctcacacctacacataagagctgattgctaaattttaggaattttatgagccggttgttaaacrcarccattataaaaaattctgaggccaggagcgatggctcatgcgtgtaatcccagcactttgggaggccaaggcaggcagatcccctgaggtcgggagttcgagactagcctggccaacatggtgaaaccccatctctactaaaaatacaaaaattagctgggtgtggtggcccatgcctgtaatcccagctactcgggagtctgaggcaggagaattgctggaacccaggaggcggaggttgcagtgagccgaggttgtgccattgtactccagcctgggggacaagagtaaaactccgtctcaaaaaaaaaaattttttttgagtgtatacattcatcattaagtaaattatatatatatagtttgtttgtttgtttgttttttgagatggagtctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagctaatttttgtatttttagtagagacggggttttaccatgttggccaggctggtctcaaactcctgacctcaggtgatccacctgcctcagcctcccaaagtgctgggattacaggcatgagccaccgcgcctggctgctattatatatttttgagatggagtttcactcttgttgctcaggctggaatgcagtggcgtgatctctgctcactgcaacctccacctcctgggttcaagtgattctcctgcctcagcctctgggattacagtagctgggattacaggtgcctgccaccacacctggctaattttttgtattttagtagagatggggtttcactatgttggccaggctggtcttgaactgctgacctcaggtggtccacctgcctcagcctctcaaagtgctggaattacaattatgagccactgtgactggccataaattttatacatatatatgtgtgtatatatatatawaataattttttttttgagatggagttttggctcttgttgctcaggctggagtgcaatggcatgatctcggctcactacaacctctgcctcccacgcacgttcaagcgattctcatgcctcagcctcccgagtagctgggactacaggcgtgcaccactactcccggctaatttttgtatttttagtagagacggggtttcaccatgtgggccaggctggtctcaaactcctgacctcaggtgatctgcccacctcagcctcccaaagtgctgggattacaggcgtgagccaccatgcccagcctgtaaattatattttataaagtaataaatactcaatttttttcctaattattttattctattattacctgtgcttttgtggttatttgctgctttgtgtgtgtgtgcrttggggagtgtattagttctttttcatactgctattttcatactgctatgaagaaatacctgagactaggtaatttgtaaagaaaaagagatttaatggactcacagttccacatggctggggaggyctcacaatcatggtagaaggcgaaggaggagcaaaggcacatyttacatggtggcaggcragagagcctgtgtargggaactgtcctttataaaaccttcaggtcttgggagacttattcactatcatgagaacagcatggggaaaacctgcccctgtgattcaattacctcccaccacgtccctcccatgacatgcagggattatkggagctacaattcaagatgagatttgggtggggacgcagccaaaccatatcaaggggtgtgagtgtgggtgtgkgtgtgtgtgtaatgtacgtagtggtgtgctactgcatatctcaactccattcagtgatgtcacattggcagcttgaaattggccagagtgagagtatttatatcacagaaattggcaaacactgcaaatcagaatcttttcccctgaagagcctgtttaccagcacaccactgggaatccagcaatgagcaactcagtccctccctttgaacttacattttggtgtgatggcgctccaggactgatcttagtgtcctcattgctgaggggcagctgctgggcagggcctgctttggtgatagaggttgtaaattgccctcaaatcacaggagctctccattccagcaagtgagttgttaccatgcaccaggaagagaggaaatgggacaaggaggaaattcagttaattgagagctgactttrccattgagtaaccctattcaggatgactcaggcatctgggaggaaaagcagcagtggtgtctgaggacagaccgtggacaarttaagtagcttggggcttgtggagttgtgatgtccaggacatgggtggctagagctgacataggcaacagtgggcatgacctgtccatatggattcaggacctgcatgagagagtagaggcagacggttgctcttgtacatcctgtgatctctggttggaagatggacatgtgcacatgttacatacagtggagggatgtgcggagtgtagcaggggaatggggtagggagaggggaacaattcwtgcctctgaacctttgcacatgctgctccttctacccaggggagttaatgtgtgttttctccacccagaaggaatggcatgtgcaaaggctcagaggcatgaattattgagagttcagtctggctctggtgtcaggtgaatcaaaagtctgcagggcttgaaacagagtaggggaagcattgaaccttcctcaagtcaggaggcacagcatcatctgggtgccagcaaaggaaatctgacaaacctcacctgtcaggggccttgtgctgtgtggatcaccctgcttccctaaaaatctttgagktttcttggtagtttcctgctgtccctgaagcttgctggtcttccagcccctgcatctgtggctggtggattctcaaaaaaaatccatgttaatatcaagcacaaaacttaattgggaagaggggtctcctgttctccccccattgctaattgataccagaaaagctgcttctgtccttcatttaggcagataattgagaacttgtttgcttaaaggcaactgattttgactttatgcctataggtgccagatatttttcatgcatcaattcatttaatttccatgccgatcctgcaagtacgtcctattttccgatcttatcgatgaggaaattgagtctcagagacttatccaagggcactgtgtttgtaagtggcaggatttgaacccggcaggccctgagatctttctgcagtcccgtgctcccctcctttatgcggttttccttttccctttgaggaggggagggagagattcatcacatgcctggaatctcagcacactttgcctttcttagttcrgagttaatgtatgtttttttaattcagtgttggcaaggcccagtctggtcatagctgggtttgttaccttgtggctcaggggcaaggatgagaatagaattctggtacccacacgggctccctaggcctggtgtcaggaaagagctaatactaatggctcataattgcagagtggcaggcaccttggtagtgcatggctcgtgggagctttctcagttctcagctactccaagaggtggggtgcatcattatctctgttttgcctccattgaacttgcccagggttgagcaaccaagagttagaagcaccacattctgctcgccccggagtcctgcctctccactcttgtgtctttccttgagcagcgccaaccctcccagggcctggcccggctgtgcctttgacagcccctagcagcagtgcccatatgctatggaaaatggggaaggataattgaccacttggccacaggcccagggtctgcccacctcttggttagagccagcactgagctccctgccatggggttcatcttcccactggcctgttggttgagaggatggtctcagaccaggccccaacaccaccttcttgcagatacatccccagtccagggcagtgcaggtggtttgtgatggtgccagcccatgttggcatgttgggcccaagatgaggtggcatttctgagttttggaacccctctttctccttgagagcctggccccagagtgccctcctctctgtaaaagtcctggttctagtcgctggctgattggtatgcatcccagaatcccggccattagcatacaaggcgggagccagctctcattactcccctctcttcattgtttgaagtgggcagacttggagtgagctttggaaatgtgggctttttattcaatttccctagaaaaacaatggttaaattaagtaggaaaataacagtctcccgaaattgaagaaaaatattcctgaacctagacattacccacaacctttgaatttcttttaaaacaggcatttgttttactttaagttatacatgtatcgcatgaccactgaagaaaacacagagaaaatacagagagaagaaaatggaaatcattttgccacctgaagacagcctctctcaatattgtggtgcatatcattcatgtattcagtgattcatttactcatttggcaagtatctatttagggcccacaaagggagaggctgtgttgggttctgggagtagacgctgggagtagaggggtaccctgctccctgctggggctctttctatgttgggccttgggcaactcacttgacccttctcttatctgttttctcatctgtggaatagggataacactagtagctgtgtcataaggcatggagatttgacaagaaagggcaggtaggatgctcatgatattgcgtggcccaggtcaaagcttagtaatgttggcttttgtcatgtaggggaggaatatcttttcttctaccctgttaggttctgtgatagagcctatgaattaaactgacaaaagacagattaataggagaaaaggcatatagattttatttaatgttactatatatatgtatttttttactgtaaggggtctccatagaaaagaaatgaaaatccaaagaggcagttagacccaggagcttaygtaacattttaacaaagggcgataaattgtggagaagtgaggagacaaaagaaaagtattggactcttaggggtcagtaaatttcaggaaagtgactaggaaatgtatggtagataagggtggtttagtaaggtttgttatgcagataaagtaaggtagaggggtacacctttgcaaatggaaatttatgtcacctttacaaagggaaatgtgtgccctgcttttaggcagaaaaggggaggcaaagagctcttcctgtattggctgctgctcaagtaccttgagctcaaaataattctttttttttttttttttttttttttgagacagcatcttgctctgttgcccaggctggagtgcaatggtcttggctcactgcatcctctgcctcctgggttcaagcaattctccagcctcagcctcctgagtagatgggattacaggtgcgcaccaccacactcagctaatttttgtatttttagtagagacagggtttcaccatgttggccaggctggtcttgaactcctgacctcaaatgattctcctgcctcagcctcccaaagtgctgggactataggtgtgaaccaccacttctggccctgggatggcatattctgatccttttcagttacaacagtgagtaagctgacattaaccttgccctggtggttttgtttttgtttttgtttttgagatggagtgttgctctgtcaccccggctggagtgtgatggcatgatcttggctcactgcatcctctgcatcctgggttcgagcgattctccagcctcagcctcctgagtagatgggattacaggcgcctgccactatacctggctaagttttgtatttttagtagagatggggtttcactatgttggccaggctggtctcgaactcctgacctcaagtgattctcccacctcagcctcccaaagtgctgggattacaggtgtgagccacggtgcccagcctcgtgagtcttatatgatggtggaggagacaaaaatcaaacacatcaaatttataaagtaaccacatgttatgcattaagtcctgtgaaggaaacagactggtggatggtgataactggggatgaggggtagagagggtgtatgtgggggtgggggtacaggattcgttagctgcaggtggtcagggaggcctctctgaagagagacatttaagccagacctgaatgacaagcaggagctccccctgcaaggatctgagggaaaagtattccrggtaggagctacagcaaatgcaaaagccctgaggccagatgaacttggcctgtttaggagggtgtggaagaggccatgttagttaggactgttactctaggtgcaaaaggaaaccatcggaggtttgttttccacttcccataaatacctttactaatgaaatatagttccaagattccagctagtaaaaactctgttaagaaattcacctttttccaataatttattcaaaaataatttaccaagtgcctatgatgtggaagcacttgactcagtgctgtggggtgatggatgggtayaaagatatggtgaagttttacgctccaataacccatggtccagcaaacaagactacgaacatttgcagggtcaagggcagggagggactgatttacctttgcaaaagatcccatgtctgctgggaggagaactggctgtagagagccagggtggaggggtggagctgggaaccagaggaaaggcaaggaaaggttcccatttggcagtggaataggagaaaagtctggggtttgggttatatatcagctggaatcaactggaatttctggtggattgtacacaggggtgagggaaagagaagaactgagcatgacttctagattcttcttttgagtctctgagtgagtggtggtgtcatgaaaggagacggttaagagggagtgaggagcatggcttttggagaaaccaagggttaggtttggggcaggttcacattgaaaggctggttagaagtccaagggggtaggccgggcacagtggctcacgcctgtaatcccagcactttgggaggccaaggcgggaggatcacttgaggttgggagtttgagaccagcctgggcaacaaggtgaaaccccatctytactgaaaatacaaaaattagccaggtgtggtggcgggcgcctgtaatcccagctactcaggggctgaggcaggagaattgctcgaacccaggagggtggaggttgcagtgagctgagactgtgccattgcagtatagtgtgggcaacgagagtgaaactccatctcaaaaacgaaaaaaaaaaaagccaaaaaaccccaaagaagtccaagggggtagtgagggcctctgggctggagatgcaaacttgggcatccttaacatataaaggggacaggtgtgaccacccagagagacaattcagaggagagatccctccacagggaggtgagctctgggagctcttatatttatagtctggtggaggaggaggagccagggcaggcagcctgggagctaggggaagatgggtgcaaggaacttacctttagtgccaggtgctgaactaaacacctggggaggatcggcccctggtcctcacgataagtctgtgaggtgcaggtgctattaagcgtctcaccttatcgaagcggaaagaggcccggaggtgacccagtgcacctgccagcaggtgcacgactgtgtagggagtgaggattcacaccaaggggggcagtccacctcgtttgcccacggcattcccgtgttgcagaggaggattccaaagcttgtggttttgttcatttgttttcatttgtctgtccttgcattcctctcctcccaacacatatttactaagcacctactgaatgctgtgcactgggcaaggaactggagattccaagatgagtaaggtgtggcgccccttaatctggtgagggaggtggatgggcaacagctgaagggtgggcggtgcctgatgcaggtggagggactcccgaggaggcttcccaggggagtgtccaagccaagcagtggaaaaggcagagttaggtcaggaagcaggaggcatccaggcatgtgccaaggctcaggggagggaatagcagggccatgtcagggagggtgcaggagggtgctgctcaggagctctgtccattgyactaggggcttgtactttatcttgtgggccctgcgagccagtcaactgtttcaagctaggggatgacgggattagaactttttgtttggggtagagattgggctgcaagggacagaagagttaccagggagagctttcaaggctgttaaaaggctctcgattcctaggtcattctctgaaccctgctgcttccttactccttcccaaattctgctcatttttctcttccaaaaagatttccgagtcagagaggttaagcaacttgcctgaggtctcccagcgtgccaggtcatccaggctgggactggtcttctaactaaaacaaccacagtcccaggggtggaagcggatggtgagtaaccccagggagcggctcactggaggcttgagttgaaggtcaccgtccacagtccccgtgtggctttaaacattgcctttttgcagtctcagagaacagttggtgcttctgggcaggaggagctgggctgctgctgggagccagggctggggctttcccagagctgcacgggttatttaagcagtttcctgggcatctgcttcctccccaatgagtgatgggaaaactccatggggctggtgcaggattygattaacaggtcacatgaggccagtgagggaggcagtccctgctgggaagggcagatgccaggcagagggcgaggggagggggagatggggagcacttcccagagccctgtgctatgagctctgtcactttgggcaggtgtctcacctctctgcagtcttggktccctcgcctgtagagataatatgaaatgtgaccaataggactgaagtaataaccagtgtccactgtaggcctgaagtgtgccaggtaccacgcatgatcttgtttcaatctatcttttttttttcttttgagatagaatctcactgtgtcacccggctgcagtgcagtggcatgttcttggctcactgcaacctctgcttcccgggttcaagtgattctcctgcctcagcctcccaagtagttgggactacaggtgcatgctaccacagctggctaattttcggttttttttttttttttttttttttttttttagtagatacagggtttcaccatatcagccaggctggtctcaaactcctgacctccagtaatctgctcccctcagcctcccaaagtgctggggttacaggcgtgagccaccgtgtccagcctcttgtttcaatcccttgtcatcttgtgagctatggatggtcattatcttcattttatagatgacacagctaaggaacagaaagggtagatattttgtcccaggtcacacagctagtaaatggcagaatttgaacctgaccctctaactctggagccctcccctgaaatccctgtggtcccccttcaaactttgttcagctgagcatgagtcccttccttggcaaatcacttgataggatcctgtggggcactagcattctgcccacttgactttgggacaccccagtccctacaaccccttaagttttatcacgaagacttggarctccagtgggcctcagcccctggctcatcatctttcagccaagtggggcagacccgggaccagaaccccagcatcccagactcctggccttctgctcctttcactcctccagggcctcagagggggactggactgggagscagttgcctgggttctaatcccacttcttccttggaccagccagaagagcttgggcaacatttcactttgccccctgcctttaccctaagcctcagtttcctcttctgtgagatgggtagattgagaatctagaatctctaccaattctaataattcataagtgtaagatttcaggtttctatctaggaatctgtaagagtcaaacatttgccacctttttctacttcctgtcctctattgcctgtgggactcgaggagactgagatgaggaaacaattyagtgaaccctctatagtttgacacactgtagtttgagggtggtggctcatgcctgtaatcccagcactttgggaggctgaggtgggagtgtcgcttgagccctggagttcaagaccagcctgggcaacatagtgagaccccatctttaaaaaaaagccaaaaaacaaaaattagccaggcatgatggtgggcacctgtagtcccagctactcaggaggctgaggcggaaagatggcttgagcccaggaggttgaggctgcagtgagctatgatggcaccactgcactccagcctgggcagcagagtgagaccctgtctctaaaaaataaaaaatatatagcttaatagcagcgtatgatgacgactatcacttgagtaccactgggtgccaggcactgtgctggctgcatcatgaattatttttttgcctactcaacagggaggcgagtatgattagctccatgttaaatgtgagaactgagacacaaaacgtttagctaactttcccaagggtcaagtgattgcatgacctgtatatgaaagctggacttcaaagaccagaggaagtgcagaggatacgtttgctaggtgcttccttgtgggggtgggtacggcctctctacctcacgtcccatcacttggagctctctgcaaaacccrttctcccgggccctagatgcaaaaatccacccagttcatccgcccttgagaaatgatgttgagtcagatctggaaacactaaatgggtgagtcacagtgaggatggtgaggggctgggcagggaggaacagtgcttagcccaccattggccagagctcagccttgccaaggagcccagcccagggggcaggcctcagctatttacagagaaggggacttgggagcagagagaggatgcggctggcagggagggagacagaggagctgagggtcagacagcagagctagaagagttttcagggatcatctagtccacacataggacatctcagtcccagagaggggctgggacttaccctaggtcacacagcccatgatgccagacccagcaatagaaggggattttgggaggctgaatcctcagcctccctccctccctcctttccttccttccttttttttttttttttttttttgacagggtcttgctctgtcgcccaggctggaacacagtggcatgattacagctcactgcagccttgatttcctgggctcaggtgatccttcaacccacctcagcgtaccgagtaactggagctacaggcacatgccaacatgctaagctagtttttgcatttttttgtagagatggggttttgccacgttgcccaggctggtctcaaactcctgcgttcaagcggtctttctgccttggcctcccaaagtgcctggattagaggcatgagccactgtgcccgaccctggccactttcatgggcatgactttctgaccaggcactatgctgtttgccttctctttctccaatcaggagaacaagaacaaacagcaacaataataaaggaatcatcttgctaaatcctaagcatgtgtgttgccaatatgggtagactgtacccaagtcccacctcctcctcttcctaggtggatgactctgggcaaggcacgttactcctcttagcctccaagttcctttagctgcgtcatggtttaagcagattctgaaattgcagcacttctcagtgcctttaacatgtggagtattgttattctccagcagggagacttctgctgtggttttccattgttctttgagtattgaatgcttttttttttctcccaatgagcacctattgacatatttcagggcacagatgtttccccaaatatacagattgacaacactggtgtcagtggtttgtcaggactgtttaaactacttttttttttttttgagatagtcttgctctgtctcctaggttggagtgtaatggcatgatctcagctcattgcaacctctgcctcctggattaaatgctttcttagcctctcaagcagctgggattacaggtgcacaccaccatgcccagataactttgtatttttagtagagacggggtttctccatgttggtcaggctggtcttgaactcctgacctcaggtgatccacccaccttggcctcccaaagtgctgggattacaggtgtgaaccaccacgcctggcctgtttaagcttttaaactcagacactgtggactgattatggagttttgggggacacatctactgagctgtgacagtcaacccccctctggggtcaggagcaccataaccatgccccacctgcatctgttcttgcttctttctgtcgtgtcccttctaccctggagcacccattgctttacagcgggagccttcctgggaggaaggtcaggctcctgtaattggaaccaccctgcctttgtggggcaggaagactggctgagatgtcttgggcagcagcagctgccctacaaaggctcttcccagggacgctggctcacctgggagcatatttggaggcaaagaggatggcgagggagaagcagagactcccaattaggttagggcagcctgggagcacggggttgagcctgggagcacgggggtgggcctgggaacacagggatgagcctgggagcatggggggggcctggaaacacaggggggcctgggagcatatggggggcctgggagcattgggggaggctgggagcccggagaggggcctgggagcacagggggaggctgggagcacggaggtgagcctgggagcatagaggtgggcctgggagcatggcggcggggggggggcctgggagcacrgggcgggcctgggagcacgggggtgggcctgggagcatgggggtaagcttggctctgtcattcacccttttatgaccttgggcaaggcacagtcctctctgggcctcagtttcctcatctgtgaaatgaaggcctgggcttagtgatttgttgattgccttcagggctgacgttctgtgaactgagtaatggaggaataggtacatttcgtaccttttggccacaccctggtttgctgggtttcttggggtccaccaaggcttgccccatcaggaacttttctctctcagaaggcgcagtgtgtgcgaaggtgctggagactggcaggtggcctaagcaccctgggaactgagagctagtaattctcatatgttaatgtgagccagggtcacccagacaagcctgctaagaaggcagattcttgggcctcatcccaagagactctagtattataggttggtatcaggagcttagcatctgcatttaaaagaagcctcccgttcactcaggtgactctgaagtcagtagttcaaggaccactttttgaaaaaggccgttagactctttgagccttaggaaaggctgggcacagcggcacttgcctatagtcccagctaatcaggaggctaacgcaggaggatcacttgagtccaggagtaagaggtgcaatatgctgtgattgtgcttgtgaatagctactgccctccagttcggacaacatagcaagactccatctcttaaaaaaaaaaaaaaaaaaagaaaatgtggccaagtgcagtggctcaggcctataatcccagcactttgggacactgaggtggatggatcacttgagatcaggagtttgagaccagcctgggcaacatggtgaaaccttgtctctactaaaaatacgaaaattagctgggtgtggtggcatgcacctgtaatcccagctactcaggaggctgaggcaggagaattgcttgaacccaggagggggaggttgcagtgaggcaagattgtgccattgcactccagcctgggtgacacagccagactccatctcaaaaaaaaaaaaacaaaaaaaamcaaaaaaaacaaaaagaaaatgcgtaggaacatgctaaccttttggggttggtgacgggctctgtgttggatgccctcacctgcagtatcagccttcaagagctagtgactcctcttcccacacactggtgtgtcccaaacctggctgattgtcagaattgccaggaagcttttgaacaaaataggaattcctgagcctcatccttagagattctgaagcagcagatctcggctgggaccgcggaatccccatgtttgaaaagcttctcaggtcttttgttaatttatcattcgttcgacaagtatgtctcgaggcctgtgatggaatggcctaggcccaggggaagatggcctaggtccggggaaggactcatgtaattgtaaggccagacacagtctcggacattatgtcacctgctctatggcttggtaaaggagacagacggtgattacatagggatgattggccaggctggggaaacacgtagcaaggaaatggttgggtcagactaaatacttggggtaaagctaggattcctgggttgctgagctccagtaaattccacactgaaatagagccctgggcacagtgtcctctgaccactacttacattctcctgtcatccatcgactcttcctccccaccatccacccactcgcccattcattcatctctccattcatttacccacccacccgtgcatccatctgtccatctgtccatctgtctacccgtttgtccattgtccatccatccatccattcactcatccattcatccatttatccatccatccatctatgcatccatccatccatccacccatccatccatccatccatccatccgcctgcccatccattcatccatttatctacccatccacctactcattcattcatctatccatccacccacccgcccatttattcacccactcatccacccatcatctcttgaatctcttcggcatgctaaggactgccctgggtattggagagacagaaatgaaaggcattattcttgccttcaaggaactcacagtctagtgggctgtcagaaaactaagcaaatgattccagtccagagtgttaggtgcccagagggacaagtggccagctgtctgtcccagtggtcatcatgggagactgctctgatgccagctgcatgtgctaagcaaagtgtatttgggagtggcccaggcagatgaggtggggaatggctttcaggccctggaagggtcttgcctttgggaaggcaggtcatcgtggctggggcaggtggggaccttttcctcttttgacactcaggttctctttggttttgcaagtggtcccacgaggtctgggcctcagtagatgcttagccaacatgagttgtcagtgaatggggagatgagtcagaaaggatgccctgtgaacctcactgaggagctgtggctctgtggggccacagatagggtccaggcaggggacaacactgtgccacaggctccctgggctgggcagggagaatggtggggagggctgaggggcccttccccagcttcctcggctttcagctcttttcttgtgtagattggagcctttgcattcatgaaagctgatgactcctttccaccagtgaatttcctgcaacccacagggcccggcctcagttggggtgtggggggagcagaatgatgtggggagagtggtggatgctgtggcagctaagagccttggcctccggaatcagactgcctgatgtgggagtcttacttctgccatttgtcagctgtgtgtcctggggcaagtgtctcaacctttctgtttcagttcagttattcagttggggataatatcagtccctatctcatatggctgttgggacgattaggagttatttctggtaaagcacttagtgcaatcctggtacatggtaagtatcgacacaaggcagcttcggtgtggagctttggaggcagccctgtcacaggggcgggacactagaaggggctgggtatttattagccttggagccagaagacctgcttggaatcccacccctacctctgactgattgtagagaccttggcaggctgattcaatgctctgagctcagatttgtcatctgtgaataggggaccgacaccccccagggccgctgggaggagtcactgggtctgatggctcattctctgcattgggcttatgattgaggtaggaaaactctaaacaggaggagtgaaatcttcatttgctagggtggcctggatggccatgcctgggggtcagtctgtggggtctgtagggccacctctcttggccctggccttttcccttagttgccctcactgttgcaggttcctaaggaaagggaccgtcatgtgactggggcccagggtcttcagaacaaggtgctacaggggcagagggtcaggctggtgccatttcatttgcaggagtgctggggagggtgactgtcctcctccagccacactgggtctgggtgcctgggagagactgaggtttctggtgcctgccctgggttcagcactcctgtccctccacacctcatgttcctgcttgatttgaattctcagggttgggtgactcaggcatgcctgatgccctgcaagatttggttcacaagcaggtaaatattaacccacacgcatagctccaaatgcaaacctgtttgggctggcttcttgggggacagctaggctccgagtgtccccctcttcccccagctgatggccaaggtaagcaggtgccctccaggggaacgaggtcacctgctttgtgccaggtgattgtactgaattcgcaccactgtccgggggcaggggctgctgtatctattttacagcagaggaggaaaccaagacatcaggaggaggccagctcggtttacacagttaatgagaaatgggcctatggctagaacccaggagtgcctccctgcaaagtccacactttccccacctggatctccagctgtctccttgctgttagggtcacaaggcaatgctatgtgtatcagaggcacctgaggtttgctttctggctccactttgcctgggcctcaaatgccccttttgtgaagtggggccaggctggtttggggtccctgataggcaggaaccagcccaggacacttgagtgcagtaatggggcctgggcttggatttgggagtaaccacctggccagccaaacaacgatcttttttttgagacggagtttcactcttgttgyccaggctggagtacaatggcgcaatctcggctcaccacaacctctgccttctgggttcaatagattttcctgcttcagcctcctgaatagctgggattacaggcatgcaccaccacacccagctaattttgtatttttagtagaggtgggstttctccatgttggtcaggctggtctcgaactccygatctcaggtgatctgcccaccttggcctcccaaagtgctgggattacaggtgtgagccactgcgcctggccctcaagcatctcttgaagacctgccaggaggcactgtggggacacccagggaggagccacagtttctgtcctctgggagctgacaygtgagcaagagtgagaacacaggtttaggggctccaggactgggtttgaatcttgggtcttagtagctgtgtggtcttgggcaggtgcctttgccttgctcagcctttggggctccctccaaagatgggaataacaagccttacttcagagtgcattgtgaggctaaagtgagatggtgtctgcaaagctcccagcacgtagtaggtgctcagtaaggtggtttcccctgcccagaacctcagatgactgtcttctaagtctgagagcaaccagtgggcctcaaaggcgattgagggctgcttcccctgccctgcacctcccccccgccccgtcatgctggcagcccgggagyagtctctcacggttctgtgggcagctggagatggggcagaagcgggcgtcagctccacagtgggggcactgggaggtggggccaggcttgactgggaggagagggagatgctggcttttccttggtcctgccccccgcagccttgcagtcagaggcagccccaaygagccctctgcagttctgagtgccttcctctcctgtctcgcagagggggagcctcacaaaccctgacagcagaagtgacttgcccagcgtcgatgggcgctggtggcagagccaggctgacccccagcctgaggcccacccgatcccgatgctgcactcctagctccttggcgtaggtccctggggctgtcgggtgccctggcctccctggcctgccctggagccagctatgaaggaatattctggggcacatgactcacaaggctggcccttccactttttgttttcctttcttttacttttccctaatacggtctcctgtggcccttgcttctcctttcttggggctctgagatggcagtgccttttgccctggaaagcctgtcctggcagagctcctgttagctgtcgaccacagctgctcaatcgggaaggttccaagggaggccgagcaaaggcatcagagctgcacagacctgggccatagcttggctgacctactccctagctatgtgaccttggacaagtcgctttgcctctctcagcctcagttttcagattcagttcaatccaaccaacatttattgaagacttgttagtgcccagtatgatattagccattgcaggtggagcagctcccctgggaacctcaagattgagtcggggttgggtgtagtggctcacacctgtaatcccagcactttgggaggctgaagtgggtgcatcacttgatcctaggacttggagaccagcctgggcagcatgatgagaccccgtctctacgaaaaaatacaaaaaattggctgggcgtggtggcgtacacctgtagtcctagctactcaggaggctgaagtgggaggatcatttgagcctgggtagtagaggctgcagtgaaccataatagtgccactgcactccagcctgtgcaacagagtgagaccttgtctcaaacaaacaaacaaaaagagtggggagtcaagtggggccctggatatccacctcatagygttgtgaggatcacgtgaaataacacataaagcactgcatatggttcctggttttagtagagtctcagaaatgacagtgagcattcatttattcctggctagtgagagcagtgctgagatttcaggtgaatcattgtcactttgatttcatacttgttagcaggaaagtgcggaggctgcttctgctggtactgtgttgattttttgtatacattggcgaggtgagctagtccctggttgtgagctgaggctgccatgttcccatgtgtgcccagacctttgaaggaggaagcgcagcccatgtggtgccctgtcctagggcagtccactcctggcccatgctgggcacccaagaggtgtttgttgaactaataggagaggcagtggcaagctggggcacatcctagcagtgtgattgacgtgggagccrggggtctgggagccacagcaggcggccatgggaccatctgaccagggcaagaggggccctgggataggagcggaagttgaggactggcctgtgcaggaggagaggcctcattctgagaaactcgaggatgaggggagggctggatgyggggaggaggcagatttagactcttctcctgggggacgatgaatcttctgccaaaggaagaatttcaatatgggggtatgatgtgggtcagtgattcgggcttagagtggggggcatttatggaatacccacactgggccagrcacagggctaggatcagtaagctttgtcagagagcccttttctttttttttttttttgagacagggtctcgttccattgcccagggtggagcgcagtggcgccatcttggctcactgcaccctcgacctcccaggctcaagtgatcctcccactttagcctcctgagtagctgggactacaggcrtgtaccaccatgcctggctaatttttgtattttttgtagacatggggtttccccatgttgcccgggatggtcttgaactcctgagctcaaggaatctgcctgtctcggcctcccaaagtgctggagttacaggcatgagccactgtgcccaggccctttttcttttctgtttgttcactgatgtgtcccaagtactcagaacaggacttggctcatggaggtgcttaataaatgtgggttgaatgaatgaatgrttggatgaatgaatgaatattacctaattgggtctcaggagtgtcatgacacccagtttgcagatgaataaactgaggcttagggaggttaagttgcacatttgctaggttgtggagctgggatttggagtccccactgtctgactccagagccggtgyacagacccacccatctattaggatcctcaaggaggaattctttctgtggctgacaggttggatttcaacctctcaaagacccctccgtcgtctgagagcgtctgattgtgggaagaaacaaaatgacccagacaacagctgggtcagtgctgcaagtgacagcagatggctcctgccactaactcctgttctgatcagtgggtgccctttcaaggagccaggttgggagagagatggatgctgccagccccaaggaggcccttccaggcttggtctgacatcatcrttatcctcagccacagagcgggagggtgctggctctggcacagctggcacatagtgcttgctctggcctgcacagtggggcccgtgtctcaggtcacccctgcctgggtgcatctccagggtggtggctagatggcctgggtgaatcccaggtgttcacggggacatgtgcctgccctcagcccccaggtggttctggaccagaatgcccaggagcttagggctgggacccagagagacttggaggggggctgctttgagaggctctgttaggggcagtgccgctgcaacacttcaggggggccactggtcttgggcacttgatctgagtcccccaagttctcctcctgatgtgctgtcccactggggccctgtcctacttgctcccatgggtggaggcttcatggtcccacctgagtgtaccccagcagcacaggagcccagctgactggtggctggctcgtggctgaggttttaacctgtaaatactgtaggggctcaagacacaggctctgcagccacgtggcctgggttcaaaggccagcgctctcatttattgactatgtgacctcgagcaattttctgaacctctctatgcctctatttcctaacctgtaaaagggaatgagagtggcccctgtctcagagggtttttaggaggaaattataggagctgtaggagtaaagggcttggattagcactgggcccttagcacgcagttaacacgtgttcggtgtctgatgttgattttggcactgacattgggcaacccaaggagccactgcatttctgctgtgccctgtggctggcacctggattccacttcctcagtaatgcttgtcatgaatgggccaggtcagcagggacaagaagagcaaaggcagcacccgggcacttcactcccacccaaggccccattcgggcagctgtaacgaaatgccgtgactcttaccagcaacaggcagttatttctcaaagttctgaaggctggaagcccatgatcaaggcaacagcagattyggtgtctggtgagggcctgttccttatagatggtaccttctcactgtgtccctgcgtggtgggagggcctagccggggccttgtttacaaggatactaatcccattcacgagggctctaccctcatgacctgattacctccccaaagccccactgcctaatccatcaccttgggggtgaggtttccgcataggaattttagggggataaaaacatgcaaatactgtggggctcaaggcacaggccctggaagccctcatttctaccttcttcccttctccctcctgcttaacatttgctccttgctgctgcatcccaggcattgcagacgaactatccatgcttttggtcaccctttcaaggagcactaactggtggayggcccccctccaactcctcattgcctgaatctaggctcaagtctgctctcaggagtttctgcagcccccaggtctcccgaagggaagcccagctgctattgtcaacactgttcagttctccttccccttctggaccgccagtggctgtgtctttctcaccacagcaggggatacttgatgaatatgcatagagggttgagccatgcgctaggctccgggacacagggcaggagggtgcagctcctggcctcggagagctcggcagtctggttgtttatttactaactcgggtaccaggaccgtggctgggcactgaggacatggagaggcaaaagatgcagtcccaccttaaagaggcggctgtacatattccccctccctccctggctgcctcctctccccacctcctgtattgcggatgctgggccaggtggtgcagatacagacacaagtaggtcgtggtctctgcccccacagtctagcggggagaggcacaaaaacaagtactgtagcagaatgcagtttctttagatacttgtagcctggtgtttgtctgccatggaaaccagtggcaatggctttggtctttgtattcctgtgactagtaatggtgacacaaccctgcattaacaggccagcgtctgctatagatccccagaggacttcaccaatgccctctgatccgggtttcccaacctcgatccattgacatttgggctggatcattctttgtgttggggctgtcctgtgccctaaaggatgtttagcrgcttccctggcttccacccaccagatgccagtagtgtcccccctccccacctagtgtggcaaccaaagtgtctmctgccattgccaaatgtcccttgggggacacaacagcccctggttgagaaccatggcctcccatagatctgtaaagctgtaactataaatcaaggtgggatggaaattttgaaatccaatactgtctccctccccaacatcccatgtaccttgggagcatcagtgatctggtttggcataaaacacaaacatcttctgggatgtggaggggcccttggaggctgtgcaccttgcccaggccacagagaagcagggcccctggcggaatgaactggatcattgccaggtgttcatgtgccctgttctgtgtggatgcagtgttgggccggtcatcacatggccacatggagtatgcagggccagtatcagacctgggagagttgagtccagatgttcaactgtcctcttgaatctcagttcagccccggtattctccttcacctcacagcacctatgaccaggggaccaagtgctcatcagcaaaccccataacctcgagtgcttcctggggcacaataaagatttgctgaatgagcaagggggggttgttggatggcagagggatgccaagggatgcagactggcttttctgtcaccctctcgaatgccgttgaacttaaaagtccccagagtgagggagcggggtctggagaccttggctctgacaaagcacgtgtggaagatgtgactgccatcactctcttcctgctttgcaccctgatctggaagcagatggtgtccccgtgtccctgtcctctgacaaagaactgggccacaggacgaccttggatagacctggcaaaggctcagtgttggcaggcagtgtccaggtggccatccgtgcatccgcccctccagctagcatttttgggcacctgttatgcttgctggcagtctgcaagaagcgagcccttgatcccaccttcccaggccactggcctctttctgctggttacttgggatgctcctgtgtcaagtgacattggggacatgctggtggatcattgaaggtttgctgcctggaggggtttgctgtccctaaattgagcagaattttttttttgagatgtagtctcactctgtcgcccaggctggagtacaatggcgcgatctcggctcactgtaatcttcgcctcccaggttcaagcgatgctcctgcttcagcctcttgagtagctgggattacaggcatgtgccaccatgcccagctccttttttgtatttttagtagagacagggttttaccatgttggtcagactggtctcaaactcctgacctcaagtgatccacctgtcttggcctcccaaagtgctgggattacaggcgtgaaccactgtgaccagcctagcagaatattttttgagatccagtcaggaagtggaacctgagttcccggggctgattctccagccggcgtgctttgcttgaagggtccatgtctgcagatggctccaagctggccctgtgctgactatgcggatgcagggaattggaatgtctctttggcaccatgcacagagcttggtcattgctgcatttcgcaccaactaaggcaactctggccttgctgtctcatttttggatcctcccccttcctgtccttgaccctcttccctggaatcttgactttaaaagaggaaggggctgggtgcaggcttttgggtgctcagcactgggccaagctgatggcttcctgtagcacttcagtgagggcaggtactgcatggtcagatgctgctagaggggctgcctcctaagccttgccttcaccatccaggcaggcagtgccttcctggagggcagtgacggggagctctgggacccttcagctctagcctgggacaccaccccttcttgtaggccggtgctgctgttcatttagcaggaggcagtcatttattcattcaacaaacatttattgagcacttactgtgttccaggctctcagtgaagcactttctgagaattattatctcatttaatcattagaacagccctgtgcatggtgattcttatagttgtcattgtatggaagaggaaaccagggatcggagcagtggatggcatctgtgtcacagctggcctcagctgggatygagcacagagctcagtctcctaaaaatccctacccagggcatgatggtgacatggcaaaaaggggaacctggggggcacactggcaggaccagagattgcttcagagcagaaatgacctggagtagagtggtcccatttttcactgggcaagcagtggtgtctctgcctgcaggatgtcggggggtgcttgaagctcattacacccagtgtggcttccatgccaaggcagaaggaatactagggggagtttaggaccaggctgtgggcggcatccgcattgtctggttcctcgtaagtygcaccacagggttggtcagcagcagttcagctcttgttaaagctgatagggaaagaggacgggtgtttgggaacagttctcttgggggatcctggtcccggatttgacttcaactcaggacaacaggactcagggcaaatccttttaatgattgaagccatccctccctgctctccctcccccaacacctccagcccagtcttccctgtccccttcccacagccccagtccgcatcttctcagattgtgaagttaattgcaagggagtgggatggacccattggcctgatcctgatggatctttccagtcacagctgaaagaccttgggtctaatcatggatccacctttgatcagattcttggctttgaacaaatctctctccctctctgagcctcagtttcctcctctgtaaaacagggtcaggtacctgccattcgtgggttggctctgcccctggaggaactggtgggaggattaggggaggcaccaggcatcccctggcctggagcagtgctcagagccaactccckccagaggtgccccagaacagctggaactgcactcacacccttatctggggaggacagcacatcrctgaggggtgtggtttgaatcataagtgctggctgctctgaattcagccagagctatcctgggctgtgtggctgagggcccccgggggtcctggggctccatgctgggcttgcatttcaggagacctcagatgctgctggcctgcttgccctgccgttgttgggtgggttgagctgtttttagctctaagctttgcaaaggctgtttctttcctgcccagagctccctcgtgggacagagtgaacaggcccctccctgccagacagagattgggcctgaagaaagagcttggagccagatgggaccctgtgggctttgaaagggaggcctggtttgctctctgtggcctgccaacctgggacaccggtgcccagccttgctccttccctgggaaactgaatagacgccagggtctcacacctgccccgtgggaaaggctggggtatgtgcctgcctggtgacggtggcagccgcggaggctcgcggatcctgtcccctttgyyggccacatgcttctgactcatcagaggaagaatgtggtctttttgggagagagtttttaaaaatagtccaagtcctcctctggccctgtcccactcctccccttctgaccatttcctggcatcagccccagacctctttccactctggttttggggaactgcccctttgcaacttggctgtgaatctgtttgtgaaccttactggggaggagctgtcctgggtgcaggctggtttcagaagggaggggcccagctgtggccgcctcctccccaggggcccgacttgggacgagggatttctgcattcctttggcaactgtgccttgggtcgcctgtgtgtcaggcctgtgccatgggtgcagataagagcggtgaacagtggtcacagtcctgccttcatggagtccacattctcataggaggaaactgataaataactaaaatttgtagttgccagaggtgttaaatcctgtgaggatggggacactgggtcagggcatgtgtgtgggctgtcaggagaaggcctctgatacagcgaccttggagcagagccctgaaggtgagggcagcagtgtgtgggtatctgggggaacagcatttcaggcagtgggaacagcaagtgcaaaggccctgaggcagaaacatgcttggggcattcaggkwgctggaaggtggtggtgactagagtgagctgtgtggagagaggtaggacatgaagtcgggggggttgtgggggctctgacacgtggggcctcagagatcaagatgagggcttgggtcttccttaaatgaggtgagaaaacattccaggctctgagcggaggatgaacttggccgctgtgctgagaacaacatgtcagggcaggggtagaggtgagagcagagggactggtcaggaggcgttttgaatagcccaggtgagagatgatggtggtttgggccatggtggtactgtggagggggtgagatgcgctcggattctgggcgtatgttgaaggtagagccagcaggtttgctgaagggtgggccctgggtgtgagacagaggtgtcaaggatgactccaaggttttggccttagcagctggtgggatggtgctagcaagcgggatgggaagactgggaggagcagggttctttgttctggcagcatggtgatcaggaggtgggtatgggcacgttaaggctgagatgcccgatcaatcactgagtgaagacacagagcaggcagaggggcagagcctggagttcaagggcaggacaggctggaggcatcactatggccatggcttaggacccacgaagtgagccaggtgacccaggtggcccagggaggagccgcggtgtagcctgaacctgggaactgccaacctggagggaggaaggaggagcggaggaaggggagctggagcgagacgtgaaagaagggagcagctggcaggtcaggcagaatggggaccgagatgctcctctctccccatcctggtccatcagaaccggtgtagtggaggccgcaggtgacctcgtgagctggctggcaaagcggtgggcacacacttggttgggaataggtagctcagcacagaataggagacagggacaggagacggagcatgggcactcctcggggaagtcttgtaaaggggagcagagaaatggggtagtgggtggagagggtatgggatcagatgagcagtaatgcagcgtatttattcatttatttattatgacttttttgagatggagtcttgttctgtcaccccagctggagtgcagtagygcgatcttggctcactgcaacctctgcctcctgggttcaagtgattctcctgcctcagcctcccgagtaactgggattacaggtgcccgtcaccactcccggctaatttttgtatttttagtagagatagggtttcaccaccttgaccaggctggtcttggacctctgagctcaagtgatccaccagccttggcctcccaaagtgctgggattataggcatgaaccaccatgtctggccacatatttctatttgctgggaaggatccagtagagaggagctgcgtctcttggtggcctcggcttctaccctagaaagacgtccttgtaccatgcaaaagactcctcccttccctccttaccccatctcatttctggcatcagctcagaggccagtttrggggggctcctccagttgcccatctgcagacctgtggaccagtgatgggatgggcaggggacccctgcaggtaattccgctcagaaaggcaggggccatggatgggcagcaattctgagatccagctgtgcgcaaccatctccctgacccagcccgaattctttgcttgcgggggtcartccacccgatgtgggagggtgcggcctgggagagaccaccagggcaccggcagaggagaacgccttgtactgggtccattttgggagcccgggacgccctcctcagccccctgctccatggggccttgtgggaatatcagggtagaaaactctgcaggcatggagagtttagctgtgggttagctcccacctgtgaccgatggagagcgtggtgcgggccccttcctgctgtccctctgttgtgctttaggtgagttcctgcccagggctgggccaagtttattaccttacttcttcctcatctgaactggagagagcctcacctccttgcacactccccccttttacttacaaagctaagtgagtctaagaagcctaagccagtggtggagccaggatcagaacacgcctgatcccctagcccctgccctggctctgatctggaagtggggcactgtgccctcccctgccttgggtatgtacccgctggcctcctgtggctgctgcctgaggacaggaacccggaactctcttttgtttctttgtccccagtgccaagctggggcctggcaggcagtaggtgcgcagtgagaagttggctgagtggggaaggatgagtggcttactttgtgaaaggtggagraggtgagcctgacccctggaggtgaggagggtgaactggggtcacagattccccaaaggttgtacctcagcttggccccctggaggctttagttcagccctgaggtgtagcaggagcaacgctgcccctccctttggctccaccctgatgcctggggagtggtagacacccctgtgtgtgcccccaaatcctactgtttcccttggcagtgcccctccgtgagctccagctctttcctgccattcttccgtctgtacacctgctgggttgcagggacgcacatggacctccctttccckgcctgcctcatcctcctggggggctttgggtaggtcccttcccatctgagcctcagcttccctgtgtctaaaaaggaggtgaggaaacccacctctcaggctgcctgcagmctaaacacactctcatgctaagtggygagggcccagcagcgaggacgcccagcagctgggaggcgggcatccctgttgtaggtggggaagctgaggctctgatgggcgagttgatggcacacagtatgtgtcatgccagctgctgtcccctctctggcttccaggtgggagccacggtgccccatcacagggacacccctgatgtggggctgagggtctggggttctctggagaagaggggggtcagttcagctgatggcaggtggcttcctccggcacttcagcttcttcactccttctgctgggctggatcgccggggacaaaggggttaatgtgtctgggggctgggagggaaggaggaagagcaggaggaggaggtagaggaggggggctggagatagagtctggggccgcccccctcccacgctgtccagccacttctccaggctggctctggtttcccaggcaacagcccccaggggtcccctctggcctggcctcagggtcggctccttcccacagagacctactcccagggccccctccccagtgctccccactcttcctgcctgcagatcctcaccaggggctccctaggaggtcagtgcrggagggtgggtgccaccgactctgggctcaggacagagtctccattgtctgaggctccagccattgaccaaacttggcccctgccccagtgaggcaggcccccttctcagagctcccctccccctccctggtgaagaggaaaggaagttggagccgcccccacctcgggaagccctttgagtgtccatcaggtsggtgagggaggagctggggtgtgtggtcccttgccagattctgcagctctggcacctgcagggttgaggagggtctgggaggacgctccctgacccacccactcccctactcccccttccaccctgggcctgggaccaggctgagggtcctgccctcttgctcccaggggctccgtagctgtgtggccttggggatgcccctcagtctctgtcagcctcattttcctcatytgctatgggaatcaaatgagatgcaaactaaaatgttcagtatggggcccrgtgcagacagtgctcggaggtgtcagctattgtcatttcaaattttgtgatctcaggcctggtgttccggtggaatacgtttgtcttggacttagtttagcagtctgtaaaatgagaaaatgctgttggtcctcagggactggcaggaaccgtgggaaggaaactgacattcattacaaacctaccagtgttgtccaatgtcatcttatttacacctgcacctgacaggtaagcacaggaggcgcagagggctgcctgcttcrgagtggggctgctggagagcagaggatgagtgttgtctgggctggcttcataccaaggccgggttcctgtccacacacctcatccttctcttctgcctgcgcccctcctgctatagctctgcctgtgttttcttgaaggcagctcctctctccccatcccggactctccaccaggtggccctttgcgctgagaagagctgtgggcatcttgctgccctgcgtgggggagccgtgggccctcttctctgtcaggagaccccgccccacttcctgttccagctccattgtgtggtttgcatccccttctcttccttccgggccccgggctttcaggacaggcagaggacaccaggagggcttgtacctcaccttccatctgttctcccctcctctgggccgaagccccacacaagcagctccccaggtccagggatgtcccagcctcatgggttcctggtctgtgccctttggttccatgctgggtgggtcccaagcaggggaaggtctcagctgttgtctagtgtgtaccccgggccagacccagtgctacccatgctgagatggaaagaagcccagtgcccccagagaggtcacaggctcttggggagggcaacagttataatggggctgtgtctgcaggcatgtacctgtcccagcaccacccatgctctttgaaaacagcctgttggccccctatcagctgcacctctgagccactgaatcagaatctctgggtgtgggcctgggacataaatatttttaaaaagcttcacaactggaaaccactgtgtgaaatgggtctaaggaagctttgyagaggagaaatggggtctggttttgatgactgaacaggaatttgcttgctggttgtgagagagaattccatgtggagggaacagacagcttaagcaaaggcctggagatgtcaaacaggtcaggtggcatggtcatggggctgaaagccattcgtgagagccagagcagagttccaggccaggcccggagccgatgagatccgagaggtcggtggagggggcgaatcttggagggccttgcttaggacccaggctccattctgacagtgatggggaagggtttgaagcaataaggtgatgtgacaggtgtgtttgcggagtgtctctgtggcagcggaggtggcaggtgggttggcctagcgtgtgtctaatgagagttgaaagccagagagacctctcagagaacacaggtacgtggaggagttctggtcctgaccagcccaagcacctggtctttcccccmattccccaccttctttctgcttcaggaggtgggccctgcagagggcctctgaggccagagcttgacaagcgtgcttgggccagaaccgattccttgcttctctctgggcagggctgggtggccgctgcccagctcatcccagcagtccagctgctgcttcccccgcttctgcctggaccttgttagagaaagaggccggccttycctgtcctcaaggcacgacttgcgcagccttccagactttcagggcccccaagtgttttcttcctccaggcctcattcaggtggaagagggatggggcagcttgatgtgtgaggggtgggagatggtcttggggggcccggggtgggacaggggcaggcaggaggagggtttcctagtggggcctctgggcagatggactttgaaccctagtgggaggggaactaataagcactgactaaattagccaagccaggaagacacctgctgtgatgagctgggcagctgagggcagagggaggtgccaatgccgggctgctctgggtggtcccgtcgctgagcctaacctgctccgggcctctggtgggcacaccccatagccgggagctggggcctcccctcttcctcccttgtctgagcactgcctcctcctcagccattccacgcagtagcaggaaggggaactgttcagtgtccgcctgttccttgggtttggtggtcattgttaaaaaggtgacctccaagagaaaacaatctcctataaccccaccacccaagcatagcctggatagggtccccatggtaacagaggcccctgtctacccagagcttactccgtgcagggcatggagcgtagaattcatcacacccactgctgggtcctcatttcatcagcacaggacgctcaggaagcaggtgctggtcttactcccaccgccccagtgagaaaggaattcactgctgctgtggcaagtggcagagctgggatttgaacctgaatcatcccggcaccaaatcctatcctctaaacgtggccttcggtgtcaccgcctggagagtcaccgtgctgtgggcagtgccctcctcctttggactcagtttccacatctgtaaagcaagagcaacactgccctcttggagctactttctggttctgacatgccatgcttttgtattagttctctttttaaagatgagaatggttattgtttatttatttatttatttttgagacagtcttgctctgtcgcctaggctggagtggcagtggtgtgatcttggctcactgcaacatccacctcccaggttcaagtgattctcctgcttcagcttctcgagtagctgggactacaggcatgtgccaccacggctggctaattttttgtatttttagtagagatggggtttcaccatgttggccaggctggtttcgaactcctgacctcaagtgatctgcctgccccggcctcccaaagtgctgggattacaggcatgagccaccatgactggcctgaagtgggtactttttaatccccattttgcagatgagtaaactgaggcccagagataggattaactcatccaaggtctcatagctgctgagtggaacccaggtggtattggggaacctgaactcttttctaaccccgtgaggatctgtggtggtggcagggggctgctgtgagccatccccactcccttgtccacatccttctgagactaacagcctgtgtgtgcaaaatggtggccacaggcctatgggtatgggcagggcttgctgggctgcgtcctcgtcccgacacttcagagccccgcattagcctgtagcaaacaccttccagattccagccccaaaggctagggaggcagtgcgatcagaggattgagattaggctttagggtcagtgctcactggctggaatcctagtgtggtcaccttgtcctcttgcttctgtgacctggggcaaatatttgcttctctgagcctctgtttcctcatccgtaagctggggtgttacgagaattagatagaataatgctaataaagtgtcaggctccatacatgttggtgtctctcttcctttctagggaaagccttgggctttggaggggagggcaggaatcagtcccaaagggtgaagaaaggggaggacattggactttctgccctggaagggaaggatcctgggttttggccccagggtagagtagcagcctctttctgtatcatcatcaaattgtatttaaggagcaatttggacaggaggctgggcaaagtgcctccctttttccttctgtaaaatgggtataggtctttctgctgcttccctcctggaactcttggggcagcagagccctcagagaaaggctgagcagacctcagaggttttgaatgagcccactgggagggggccctgtagcaggagtgccgtgcagctacaggtttgttttccaaaatcctttgctgaagtaaaagtttagtcctgagagttttcagcgtgggtctaaaaggcacagtcacacgcttagcagagagtaactggtatcatcagtcacagtgagaaatgcaggcaggtgtcagggttcacatctgtgatcccagcacttgttgaggtcaacaagggaggatggcttgagcccaggagtttgggaccagcctgggcaacagagtaagaccctatctctagaaaaaattttaaaaaattagccaggcatggtggtgtgtgcctgtagtcccagctactggggaggctgaggcgagaggatcacttgacccaggagttccaggctacagtgagccatgattgtgccactgcactccaacctgggaaatygagaccaaagcagcctcagtacctatcgatgggggctatataaattatacccccacaaaaaacacctacctcaaaacaaaaccaaacctactatgcagctgttaaaaaaagtggggttgatttctatgtattagtactattctgaaatcatcactgagatttaggttaaaaaggcagttgcagcactgtgagtgctgtgtgctccttctgtatgaaacaaggcatayctgcagatatgcaagttggcccatgcatgggagagttctggaaggattcttgagaagtcagtaacagtcatctcttctgggggactgggggattagggcaaccagggtgggaggttgactaactttttttttttwaattttttgagacagagtcttgctctgtttcccagactggagtgcggtggcacggtcttggctcactgcaacctccgcctcccacgttcaagtgattctcctgcctcagcctactgagtagctgggattaaaggcatgtgccaccatgcccagctaatttttgtatttttagtagagatggagtttcaccacgttggccaggctggtctcgaactcctgacctgaagtgatccgcccacctcagcctcccaaagtgctgagatacaggcgtgagacactgtgcccggctcggagactaacttttcattgtctacctgttgtatcgtttgagtcttgaaaggtgctagagtgtagtagctgcttctaagcacagactccagagccccatggcctgggttcgaaccctggctcttcctagctgtgtgatcttgggcaagttacttaaccattcttggtctcattttctcatttataatttggaataatagacgttaatatttgtaaagtgcttaaaattatgtctgaggtatcgttggcaatgcaagaatgtctactgttactaatattgccattaacctgcatttcatttttgtttagtaagccagtttaataaaaataaagcctttaggaatggaaaggaaaacaggaacacagccggtttgtggcctgggcagattagaccagggggctgggtgctttccctccagggtgcattctctcctccacaagatgtctaggaggacagcccccagtgcacaattgaaggtgacagtagggagcgggggcagggttggctccagggcccaggaagcccaccggaggcatcagccttttgcttatgtgagctcccactgtgaggggagggcggtgccaccttgggccaggaggaactgtgcccccacgctgagcatttgggattctgtccctgtcttatgccattggcctctggagccattgctttcctcacacccatgtgccaaggccaggttacctcctgcctgctggtcaacccatggggcaggacaggaagaggcagagtcagagtggccttcagcagggctaccggaagggactgacaggagtgggcagacctaagggagcccatgcttcctgggcagccaggaggaggaagtatccagccccatttgtgacagtcaggtgtgatctgattcctggaaggttgggggctgagcatgatcctggactctggggccagatttcacctgtaagccagaggggatgaggacggacacccagcaggtccctgcaggtcccttggcactggcaacaggaaggtctgtggctgcagggttttctgggaagaaggatttgggctgcacagctgctgatgtttctatgggttaatgatttatgaaggctggaggctggggcctttctggggctgccctgtgctctgagagccactgggctgaagcacaggttgtgagccagtgacttgtctcagtagctgaaactgcagccctgactccagctaatgcgatttctggtcttctttccacaggtgtgtagctgggacggtgctggtctgagctggaccttgtctgatggcttcctccaaccckcctccacagcctgccataggtaccgtacccagggcttcctgtccctctcatcctttcttagaagggggccgctgggggccggcggagggccttgctctggagcagcatggcgccgggtgggaagtctgctctgctggctgctggccctgcctgggccgcatcctctatctcacgttccttgtctacaaaatagaagtaactttctgctcacggaggaggctctgagcaagggtcaatccttttcctgtctccctgagatccgccggagaggtgaacacacgggggtctcaggctgaagcttataaatcaggggtgaggaactgaggttggaggagagggttgcgccatagggtcaggccgttgaacagtggtagcattgccgcatttagtgaaaaaaagagaaagtaaaagaaaaatacagccaggcatggtgtctcatgcctgtaatcccagcactttgggaggcygaggcgggcagatcacttgaggtcacgagtttgggaccagcctggccaacatggtgaaatcccatctctacaaaaatacaaaaattagctgggtatggtgtggcacttgtaatctcagctacttgagaggctgaggcaggagaattgcttgaacctgggagatggaggttgcagtgagccaagatcacaccactgcactccagcctgggtgacagagcaagactgtctcaaaaaaaaaaaaaaaaaaaaaaaagaaaagagaaaaagaaaaatacatacttatactaacaaaattattcgtcgtttatctgaaattcaagtctgtgtcctgtatgttatttggcaaccctggcactggggcctcagacactgcaggtggaatccaggccccgcctgggaggaaatgggcccagggctgtttcacccaggcggcagcttcctgtcctcttgtatcactatgagagaggcagaattgcagatggtaatgagtgagggctttgtcctcagccccatctgagtttgaatcctgascctgccacttagactgtggggctggttaagtgacatgttgtctctgtggcttagtttcatcatcagtaaacatggggacaatgataccctctcctgggctgttgcaaggtttaaatatatgtcaggcgtgggcatggggtaatcaattgctcactgacgggagtgcttatcatcgtgggtgtcagcaggacagacagcgtgtgccatgccctgcacccctgggagagccaaatgatgcatctcctcctccctgagcctcggggttcttcttgggcggggggtggggagcagcacagcagacctgtcttccctgtggcaatgggtggcttcctagggtccctcgcctcctggactcgcttgtattttctcacaaggaccgggtctgtccaggaacatcagaggcatgagtgaccagctctggctgtgccacctttgcaggctattaggaagggcttccttcagctctcagctgtgctgggatgggcctcctgagttttccttctgataaggagcaatgcctgattgccggggggaggatagaaggcggccttggagacaagcacatctcacctcccarttcatgactgggatttgggtcccagcatgcctggccttgccccatcccgcccctgctgccatgggcacctgttccctttcctctccccaccaagaggcctgaacctgaacatggggagtgagaaaaaaaaatttatgactaagtcaattctgttctgttcagcaaacatttgacaaatatttgttgttccagctctttctaatattgctggctagtatcatctgggtgaacccagctctttgccattttctcattctctgagagcttcccattaccttccyaaattaaattcaaattcctgagtaggggattccccacgcaccttgtcaactgtctaatgaccttcattcctgcgcgtgtcttcagcacccccggggcacttggtgtttgttctctgtctttgctgtggcctctgcctggaatccacgcyttagttggagcttgtcaggccttttctcatcctttaaggctcagtgcragggcagcctcatcctcggagcccttcctgaagccccagagagccccagccccttcctcttggcaccrtctcagtctctgaggttttwggttttctccygctggctctgtcctgtcagcctcacagtgagctccggaggggagctcacagtcacccaccccgaaccccaggactgtgtcttacctttccttccccctccctgcccactggatgctgggagctgctcactgcatgcatggataactgaagctatttgtactcttaaagggaggaggtgcaggccaggcacagtggctcatgcctataatcctagcactttgagaaaccttgcttgagctccggagtttgagaccagtctggacaacagagtggaaccctgtctctacaaaaaatgaaaaaaaaaaaaaaatagctgggcatggtgatgctacctgggagtctgaagtaggaggatcacttgagcccaggaggttgaggctgcagtgagccatgatcgcaccactgccctccagcctgggtgacagagtgagcttcatttaaaaaaaaaaaaaaaaaaaaaagaaggtgtagaaatgacctgagtccctggacatggctgggggcagggttgcctgaggccgggtcttgcctgtgagttggagaggactgcccttctcacccagcagcagggactgggctatgacaaggctgtaatcataataataacagtgataatggtggtaataatacgacagtgatgatgtaacgatggtgataataataagcagaatcatcatcgtcagaaaagctaacatttggtgagcacgcaccctgcaccaggtgctttatttatgttcattcattccctcctcccaacaaccctgtgaggtagttgctgttattgacctcattttagagatcaggaaactaggagggggtcaaataacccgacactcatccagctggtacctgggtgagctggagtctgagctgaacccaggtggcccgactctagaaccttagtcactgcagtgacaccatccacatataaagggagacccccacccccactccctgcccagcagattcacttaggcaaggaccagtgggcactgagaggctaagaaaaccctgtgtaagtcaggatgggcctgtagctggtacccccaaaatagtgggtagggactttgtggtcatttattccagtatttaaacaaatttttttttgagacaggattttgctctgttacccaggctggagtacaatggtgtgatcatggctcactgcagcctcaaattcctgggctcaagccattctcctgctacagcctcctgagtagctgagactgccggcacataccaccacacccagccgattttaaaattattaaaaaatttttacttttgtttatttttttttgagacagagtctcgctttgtcacccaggctggggtgcagtggcacaatcatggctcagtgcagccttgaactcctgggttcaagtgatccctccacctcagcctcccaagtagctgggactacaggtgtatgctactacacctggctaattttctcatttttagtagagacaaggtctcaccatgttacctgggctggtcacaagcttttgagctgaagccatcctcctgccccaggctcccaaagtgctgggattacaggcgtcagccacagcacccagcctatgttttaaactttgaaaattaccacccatagacatgacaacagggggacaaatgcttatcacgtgcctcctgtatgctggacgttacactagatgctgaggatgcaacagcaaacaaaacagacaaaaatacctgccctcgtgaagcttatattcgagtagaggagacagacagcaacacaaatagcatatggcatcatatgctgacaacagccatagagaaaggtaaagtaggcagggcaaaccgggagtctcagcaggtctctatggcagcgtgcagtagagatgccgcagcatgcagagagatgatgcgcagtaaagatctgaaagaggggagagcaggagaagatactcgaaggaagaacgtgctaggccctggggctgcgggtgcaaaggtcctgaggcaggagcatgcctggcacatttgtggtacaggaaggagatcagtgtggctggagtggagggagcaagggatgagcagaagattctacgcacatgtgcacgtgtgcgtgcacacacacacacacacacacacccctacccaatgtgtatatgtaactgaaacagaagtgtcaaaaccaatattgaaattataccaaggtgaattcattagtatcacaatacattattttttaaacatctgaaataattcaataccaaatgtattttatttggtattataatatcaaaaagataccccatatgattttattaatattagaatacaatgtttagaaacatctgaaacaaaacaagctatcaatccaaacaccaaatacaatgctgattgggaatcccctaattaaacttatgagctaccaggggttgggaactgcgtccgaaaaccacagatccagctcccacccaagccctttctgtcagcgcagggcagaatgtctgagggcttagtagaagagtatggagggtgaatggagctgggttccagtccatccccatcctcttagctgctgactgtgggcacattgctttgcttctgtctctggggtcttgggtaaatggaggtgatcctgaggctggatcaggaagctgcctggggcacagctcgggatctctcaggacttgcttcatgacacctggggaaggagtttgctctacaggccacatcgctgcccagagtccacccctgctgacctggcctgtgggatccccaaagccccaggaggagtggctgtgtctcctcctccgtggcctcagaggaagttgggtacttctcattctggggagggagggcgtactctgggcttccattgcagtcgagcagctgaagaaggggtttcttacatctgcccccaaaatattatgctctgggaacctccaggtcattgtaggggagtgactggatttttctagtccaagagactgttggaatcagatatgtccatctgtccatctgttcatctgctggaccatctgcccatctctctgttccagccacctcctcacccatcactcatccatccatctaatgtttattgagcatttgccagggctgggtccgcagacccatgggctagaaaatcctgtttgtcctcaaggatctgcggctgttgttgtcataatccttacatatacgggcactgtgccgagggctactcctacccagtggttctctgatagtggtgattttaccctccagggggacatatggcaatgtgtggagacatttttggttgtcacagctggagggtcccctgggcctgtagggtgtagaagccagggatgctgctaatcgtcctacagtgcacaggatagccccctctccacccacaaaaagaattatccagtcccaagtatcaattgtaccaaggctgagaaaacctaagctgcagctcagctgatgttcatgtcagccttatggggaaagtgctgtttttattctccagtttgcagaggaaaccaaaattcagagaggcaaagtgacttgctcagaaccacacagctagcagggagctcagacagggccatgtgagcgcagagctcatgcctaagctgtgtgtcatgtgcccacgagagggctgcttagggcggtcagcttggcagatgtttaaaaacagaaccaaactgcccgttggttttgcaatggtttgcataaggtaggggatggagttattgaactcctgaagttccattcagcccagagtttaggaaggaagtcttctaggaagaggactggggaacctccatgtggtgaaatggctggaaatggcttctcgtgctctctaggatagagaattcatcccttcactcatgtaacaaaagccgctgagctcctggtctgggccggtccaggaccagagagtagaggggacagacaggtgagatgtctgctctcagggatccgagcttggtggggagtacaaacaaggggcaggggcagagaaggagaggccacacctcctgtagtagggtaggcggggacagtctctctgcttgagttgagctttaatgggagaggaggacaggagttcatagtcacgaaaggggttccccaggagggtaaaagcagggaatgaggcctagcaagctgacctccatgctgagagcttggtgccttcccctgccccagccagtctgtgccctagtacctgcaagctggctgcctccaagtccaggcattcccaggcagctgtgtttcatgctgctgcacrtaccaaataaagtgtagtgggaaggatgcgctgtctgtgctcatttgcacacacaaagcacacagacacatcaacacacaaacatacaataagcttgtgctcacgcataaacacacatgtaaaaagaccccttgctcacaaaacagggaaacacgaaataagaagaggaaagatatacattgaagtactgaggtgcacaggctcrccctgggagcacactcccttccctccctcaactgccacttgcttagagacctaacccaaccccctccccccggccttaccagcactgtagggccatgtggcttgagtttgatggctctcattccctggctcagacctgaggtgctcacccagttccagccatgcccacctaccccagccatctctccattgaccaaacctcggagatcctgcagcctggccaactccttctctcttccaggagatcagctggttccaggagtcccaggcccctcctctgaggcagaggacgacccaggagaggcgtttgagtttgatgacagtgatgatgaagaggacaccarcgcagccctgggcgtccccagccttgctcctgagagggacacagaccccccactgatccacttgractccatccctgtcactggtaagatgtttctgggaacttccggtcctggggctacagggagcatggagaactgggcggaagctccaggctctcagggatgcctggtggcccctccgctgtccccagaaagcaggaagggaaaagccagtgggaagaagctgcagtctgtggcttccctggtgaattggaaattcctagcattcctgcaacatctggcgcactttggcacattgtaaatggaagtggttggcctgagttttgctttggagacagttgctgcccagagcttgtgtctctgaagtcctccctgcagcttctcctaaagaatccacaccagccagaagagcagcctcccagaggtyccctctcctgtctgccttggggagctggcaaccctggggggcaggagggccctgataagctggtgttaaatggcagcttctgggctcttagagtctgttatctgagagagagaatctggggactggaccagctggaacttcctgcaggcttggggacagcgggctcctggagcagctgggggtggagggcaggcccagagcaggcagggtggctgccacgggttctggctggagttgggaartgggccacggggtgggtgggggtggtgcaggccaggtaggggagctgatgactgagccagggctgggggagggaggcggggctcagcaggcacccagactggccaggccctgtctgcggygcccctggggaggctgggaaaggggcggggaaggcctgagtgcctggggccagcctctggcctgacaggctctctgtctgctcttcttttgcagacccagacccagcagctgctccacccggcacagggtaagtgaaccttgctcctttgctttggcggttggaaacagggagacaccgggcagtgggtggggatggggtggagctgaggcccagaggacccgactggtctttggctaaggaggaaagcatttcactgaggccctgtgccctgggggaagaggtcagttccagaaactcatggtactttttcctttattttgcccacaaacctctgaaaccgcaggaggcaggcctggctccaaaccctacctctgtggccttggaggagtcacagaaactctccaagtgtcagtctgtttgcggctgaaggggaaacaatgagagcaccccctctgttgggtttgtcttggagaagcaaacagctggagggtccccagtgtgtgtgtgtgtgtgtgtgtgtgtgtgtgtgtgtgtgtgtgtgtgtgtagtgggggaggttgggggggtttgagggtggggggggtgcagcccattgtaattatttttgcagttgccatttgtcttgttaatatcattcccattcctatgacagttgctattagggaccctgccctctgtgcctgggagcctgtcagaggcagtgtagcctagtggttaggagcctggatgttggggtgagggcctgcgtcttggctgtggcccccacactggccacaggtcctcatgtcagtcaagtccccctttggttttctcatctgtaaaatgggctatcgggtaagatgcccagcctcgtggtaggtgcctaatcaaggcatttgctttttatcacagttcttctttgtcttctgcaagtcaggtctgggttggaagggtaattgggtaactggaggtggtgggagctgaggcctctcaggaccaggtgttyagagcctccttgcctaagcagtggaggggtctaggctccaaatgaatggcccaagcatctggaaccctgagtttaaatcctcactaccctggtgaggggaggcatgtctgagccctgctttgtcttcctggggtgccccaaactgagcaagaggggctaattctcagggtggtgtcacccaacgggaggtttcagagatgcaggttgcaggcccaggcccccagaggagaagtccttcatgtgctcatttgctgtccagagtgggtggacttggggagggtttctcctgagcttgctactatgtaattaaggtgagaattagaggccagcctctccttcctgattagggacctgaaatgaatcagcagccattcgtcctgcacctgggctgggaagggccgtgatggctgcagtcttccaagggtttatatctccagggtgggccaggggtgaagttgtggagaaactcagtctggtgggagatgcagatgcgtcagagtgggacagagacggacgcccagggagctgggacactgactggaggggagyaaggatggggtcgtcagggaagacttctgggccaggtcctggctcagcgagtgaatggaaattctccattcaggatggcagaggggcagggggagtgcctgctgaggaagcccctgagcagaggtacagggctggcacacagggtggtcagcacactcacttccttcaagctaccctcttggagaccccaggagttaggtgatgtgctcagggttccatgtagataagtagatgctcattcagaagagagaccaaggcccctctgacaccgaggccaggcgctgggccaccgtgcttctctgcctccaggagctcatgcgctggtccctgatgagagggtgtggctggcttcataggaatgatctgattgtgtgtacattttttgaggaaagatttttgcccactcagagatgatctctgagctcttgggagagtggcgtctaagcagtcggtggaatgttccataggtccctcccggggaggcttgtgcggcagtgcctggtgtgtgattcctggtgaggtcccttcccttgacawgagagcagagcaaaaagagccrgctcttcgctcccccaacacrgagatcttgtgagggcggaggggtgtgcaggtgtgtctctccaccagcagttgcctctatggggacagggactttttgattttttggagggggatgttttgtttgctgccaaacctcatggcttaagtggcaggcacggggtgagtgccaaagacgtccttggtgaacgaatgatggacagaaggacaaggagggtctgtgttccatggaagcaaggagaaagcaaacagcatgtcagacctggtgaagtggctcacgcctgtaatcccagcactttgggaagtcaaggtgggtggaccactgaggtcaggagttcaagacccagcctggccaacatggtgaaaccccgtctctacagaaaatacaaaaattagccggtcctggtgaacggtgcctgtaattccagctactggggaggctgaggcaggagaatcgcttgaacctgggaggtggaggttgtagtgaggcgagattgcgccatttcactccagcctgtgtgacaaagcgatactctgtctcaaaaacaaacaaacaaagaaacaaaaccaaccaaagaataccaccccacccctctacccccaaatgaatggcatgtcaatagggtttctattggattctgactctggcagctgtagaggccaagacagaggccagggaagggaagcgcagagtggttgtgtggcccaaggccacatggctagagccacctgacctcactggtgctgatggtgctgtgctgagccacaggctgtgctaagtgctctgtgtacattatctctttttgttgttgtttgaaacagggtctcactctgttgcccaggctggagtgcagtggtgtgatcatggctcactgcatccttgaccttccaggcttgagcgattctcctgccttagcctcccgagtagctgggactacaggmatgtgccaycatgcctggctattttttttttttttttttctgagacagttttgctcttgttgcccaggctggagtgtggtggcgccatctcggctcactgcaacctttgcctcctgggttcaagtgattctcctgcccagcctcctgagtagctgggattacaggtgtgtgccaccacrccgaactaattttttgtatttttagtagagatggggtttcatcatgttggccaggctggtcttgagctcctgacctcaggtgatccacccacctcggcctcccaaagtgcagggattataggcgtgagccaccgcgcctggcctaactttcatattttttgtagagatggagatctcactctgttgcccaggctggtcttgaactcttggctcaagcaatcctcctgccttggtgtcccaaagtgctgggattacaggcatgaaccactgcatctggcctgtawtatcttattacttgtacccctaggagccctagaagacaggtactattgaatatgcccattttgcagatgagcagctgaggcttagagaactgaagtaatttacccaaatctcatggagctagtaaatggcagggctgggactaggcctgtctgccctcaaagctgtctactgaggcccacagggtttgcttctcctggtggactctgaagcacgtgcactcatgtccaccctgagctctcgctgggggagtcrtggttgaaagagcagccctgagtacccagcagtgcctgggaaacgtgagcgccacagatcgctggcttcctgtgtttttcctggactcaggcctgcacccctcacctctgagtgcaatagccccatggactctggccccctctggagttgtttgcttttcctgtttagttttgcctttatccccctgtgacctcagcacttttctgtgggtcagggttttggctcctggccctggtcgcagggattctcatgggctccctgaaggtacctggcctaccccttcctgggcttttctggataagatggttgtactgcctgttggctagtgtctctcattggggcctggagccaggggaagtgatggggcagccgtattctgggagaggacagggagactcatcttccctggatgtatcaggggctgagaggatcaggscaagaggagaccaggctcagcaaagcagtattggcacaggatggaaacagggcgctggtggcctgtggcttctgagactgctaggtgtgggggacataggggctcatgggaagggcaggtcagcaaggccggagtgggtccgcagcgtctggaggaaatcttcaagatttyccagattgccgcagacctagtctggagtygtttggaatcctgggcttctccttacatgtgctgtttcccaaatccggaacatttgagcctcctgcgtcctgtcccgcagggtccatgcgggacgtgaggcatggcagataccggctctccgcccatggagtcccccatgggagggttatggggaccaggtctttctttccattaaaaatctttctttaaaggtcccttgccaaatccataaattggacaagctggtttttgtgttttctttccttcttttccttctccgagggtagaaacaagggctcccagtttccaatcagagccaggacctttggatcccaggccctttgaggacccccacagcctcttcattgaagaaggcacttgcagggtacctggttggcacatctcttcatggtataaatatgccttcaaggaatcctgtgacgttcctccctgcatccctgcagcggtgggactctgcctcactcgttttttatcccagtgcctggcagagatggtgcaacaatactaacagcctacacgtgcacggactttacagtttacatctcattttgattctcacaactgtgggaggcagaatcatggcccttccaccccttggagatttccgtgtcttcatccccagcacctgtgaatctgtgacgctgcgtggcaaagggacttggcagatgtgattaagtgaggggttttgagatggggagatgaccctgggttatctgtgggcccagtggcaccacaagggttgtgacaagagggagacaggagggccagagtcagaaagaggtgggaagatgccacgctcctggccttggaaatggaggacgggattgtgaccaaggaatgcaggtggcttctcgaggctggaaaaggtgggggatggcttctcccctggagctgcccctgctgaaacctcgcttttartgagagcacagccctgccgaaacctcgcttttagccctgcgaaccccttgatggccttctgacctccacacctgtgagaacagatttgtgttgtaagtcactaagttcgtggtcatctgttacagcagccataggaaactaacacgacagccctggaaagaggaaattatcgtgggcaccattttgcagaccagacctgggagagagcgtcacttgtctgtggggctgggctggcaggcatggtgcttgggctcaaagcctcaggccaggggctctgtttgccctttctctatggccctctctgtgcatctaggatggtgctctgctgactggccggtattcccctgcccttcccttgcgtcttcctgtcctttcacccagcacctctttactgagtgactgcgatgggggctgacatgctctgccaggccatgttatttttatgtgcctgtgtgtgtgtttggctctagggccagatcataatggcctgaatgtacccagcacttcttacatgctgcgctctgagagctttccctccccagtgccattcatccttgcaacactctcacaggacaggcgctgatacaatctgcattctagagatgtgggaactggcacagagaggacatgacatcagcccaaggtcacagagaaagatgagcagagccagagttaaccccagctggcttccagaacctgtgttctaatccctctggtgcaaccgtctcccacacagagctggtttggatcccgcctgccctacatgttagctgcatgacccaggacatgctctttggcttctctgcctaaccctcagtttcttttcttttctttcttttgagatggagtctctgtcgcccaggctggagtgcagtggcgtgatcttggctcactccaacctctgctctgccccctgggttcaagtgattcttctgcctcggcctcccgagtagctgggattacaggcacccgccaccatgcccggctaatttttttctatttttagtagaaacggggtctcaccatgttggccaggctggtttcaaactcctgacctcaagtgatctgcctgccttggcttcccaaagtgctaggattataggtgtgagccaccatacccggccccctcagttgctaatctctgtaaagcagggtgatgagactcaccggatggcactgttggtggggatgaaatgagatgggagagattaggtgcttactcggtgagctgctcattgtcactgtctccaaagggtgtggagctgtctggggctgactccaggcacaagggacccctccctggcctgtgcattgcttagcattacctgagatgctcttcagtccatccctcctccctacctcctcctctctcttcctttttaaaaaaaatacagtttgttgtagaaaaattagaaagtacagaaaatgatagactaaaagcaacttttaatcctaccatgatgtgtttctgtccagcttctttgctaggcatgtatgcaagtatgcatgattgtttttatagaactgtggtttattgcacatgctgtttcgtggctcacctttttttttttttttttttttttttaaagctaattacatatcatgagcatttccccaggggaacttgtattgttttgcaacaacccacatggctctcgatacatttttgccaggggtgcagggcctctccatgtctgaccaagccctggggcccctgagatgtcagggagggaggtgcattgccacagagcaggaggccagaggctgggctttggcccagcatgtgtgtggggggccacctgtacagagatggctccycagaggcctcgacgctcactccctgctgaggtctgtgatatgatgccacctgagggccgctctgagacttcccctggggggcttctcactgctctctactcatccagtaaggggatctgtgaccatgtgtggggtggcacaggagagacacacggggtcctggaagccctctgtgcacaggatgggcggccacagagggaagagggaacacatgcaggtgaggcccccgtgcctggaggagaggcggagggaaggagggggcggggaagcagcacacacgaggccataccacgtgccagcccctgtgccagaggatttacatgccttctttatttactccgtaccagaaccctgcgagggaggtagtgttgcctcattttacagatatggaaactgaggcacggagaaatgctaagtgctttatctgcatcatctcactgaatcctcacagctggaagtaggactgatacttcaccctggtccacattcagtaacttgtcccggtgcacacagccaagtggctgagccacagtcatatcccaggtcgtggccccggggtgcttacttcttcccccctcacgcctgggagccctggttctcaaccctggctgcatgctgcagcctgcagggagcttacccctgaccaacagtcagagtctctggggcgggggccctggcgcccacatcttctaggggcgccctgctgactctagtgggccgccaagccagatgctctctaaggtcctcagctttgacatgctgtacaaccaggtcaagtggccagggccaaaaagagacccagcagcaggctgaacctgggctgcgtgttcttccctttccttcgtgtctcttgatcgggccatcatgctgggaggagtttccgaggcgggcggtgacactgtgtggggctgtcctacgcaaactctcctgtcctgtccctccctgtgctgcagcttgggttttccttgaggccttataaggcaaatgtcattccagtcctttctagtcccatccccaaaggtgaagttctttcctttctcatatttgttatgccttgtcctggcaagggccccagaatgcttgtgcgtgtggaccatgctggccaggaatccttagcttgttctggttttgggggtctcctccccgaccacccacatggtgcagcctctgggaagggacccttggaggttcactgagaaactggggcctgtagcagcccctgcaggggtggcgggtgccattctctggagtggggcttcttatctttaaaacaggctgggggcccggcgcggtggctcatgcctgtaatcccagtactttgggagtactaggcggatccgaggcaggtgggtcacctgaggtcaggagttcaagaccagcctggccaacatgatgaaaccctgtctcaactaaaaatacaaaaaaaagtagatgggcgtggtggcacacggggacctacccctccctgccctgctgctctttggagagagaagaggtggggcacaaaggtgcttggagctctgtggaccagaaacgcaccaggtggccttctggtgcacttgaactcctctgccggcaatgtaggttgctgcttgggggtgctgggaggggtcctttcctctcttccctgcttctgcatctgcttctgccttttcctccccatctcctgcccctcaccatggattcagcttctttcctttgcattcaggttgctggccttactctcatttgcaagctgagaggcattaggagagcaggaagctcagataagggtgagataattgcctcttactggtttttatggctcttttatgacccggaggcccctgaaggagtgtttgttcacagggagaattagacacggcagccctgcgtggcttccatggacagcggctgggagaggctgctccgggtgggtacagggtgggtccagggccttggcaggcatcagggagggtcacgggtacaggaggggcccccagcctcatttcttgccgtgccctctttgcatgcgtgtcttgagctggaacgttgctcgtgtccctgctcccccaactttattcctcttcccctgcctgggaagccctttccccatctcatcggcccgaggaacacctgctccagtctagggaggcagcggaggtggtcctgagagcaaggctttgcagatagatcaccggggttcaaactgccgctgtgccacttgctggtcaggtgacttgggtagtgggggtgggcaggaagtgacctctctatgctgtggggacccccattccccagcccagtacaccagagccagtacctgggctggtcgctcactgggttttgataaggtgcagcgaggaggagcctccccctgcctatgagtcggctcatcaggtgtttccaaatccctcctgaagttgcctgacctcacccagtgatgcctctgcccacctccacgtcacctttacagtttacatggggctttctctggtgttctcttggttaaactgcattctttcggttaaagcgtgctgcagcctttgagctgggtgttacgctttctcttggacagtgtctgagttcatttgggctgctgtaagacaatgccatagattgggtggcttataaacaagagaaactttttttttttttttttgagatgaagtattgccctgtccctcaggctggagtgcagtggcacgatctcagctcactgcaacctccgcttcccgggttcaagcgattctcccatctcagcctcctgagtagctgggattacaggcatgtaccaccatgcctggctaatttttgtatttttggtagagacagagtttcaccatattggccaggctggtctcaaactcctgacctccagtgatctacccaccttaaccttccgaagttcagggattagaggcgtgagccaccacactgtgcctaagagacttatttctcacagttcacaaggctgggaggtccaagatcagggtgccagcagattcagtgtctgatgagggctcatttcctgatcatagatgacaccttctcactgtgtccttacatggtagaaagggcagaggagctctctagggcctcttttatatgggcactaatcccaaccatgggggctctgctcttatgacctaatcacctctgcaaaggccccaccgcctaatactatcaccttgggggtgaggattttaacacatggactttttttgtcaggggaacacagacattcataccatagcagatggagacttgaacttgagcctctgagtgtgccgagggctactgctctctctctctctttttttttttttataaaatggtagctaaacaggcaagatctgaggtaaccatatgccacagcaaacctgtgatgtaggtgaatgtctacatgcaagttctcgacttccaggtggtctggttgaaacaatagaagctttgcaggtagacgtagtgtaagatcccagctcccactaattagctgagtgatttctgggtaattgaaactttgtgaggctcagtttccccacctgtagaataggggtaacaacacctgcctccggtgtgttcctgcaaaattaaatgtgcaggtcgggcttgtaggctcactcccagcactttgggaggccaaggtgggcagatcacctgaggtcaggagttcgagaccagcctggccaacgtggcgaaaccccatctctactaaaaatacaaaaattaggtgggcatagtggcgcgtgcctgtagtcccatctacttggaaggctaagatgggagaattgcttaaatccaggaggtagaggttgcagtgagctgagatcgtgctgctgcactccagcctgggtgaccaagtgagactgtcaaaaaaaaaaaaagaaaaagaaaaaaaaaacgtgcaattacatgtaaagcagagcaagcagtgcatggcggatgctttgtcacggtcactgtcatggccacatatcagagcaaagaggacctgtggccgggagactgtccagccaacctcttctaagctcacgtctgttccagccggaagagtttggttctgtctgagcaattccgagcaactgatgtggcgccttcaggatgtttctgtgttgaggaggtggcggctcagcgaagcagctgttagaaatcggggttcaggtggctcccatcagcccatcacccaccttcctggtccagagaagccctgtcctctcttggcctttacttcctgtcattggtggaaagtgtctccccaggaccaaatgtgctgccttccttgccctggggtgacactgttgacttctggcagtgaaatgtgagctgacacttgctcctctaatagggcaggtgacttagacctgcaccacccagtccagtggccactagtcatgtgtagctatttaaaattaaattacttgaaatcaaatagagttaaaaattaagttccttagtcccactagccacatgtcaagtgctcaatagccacgtggctggtggctgctgcaccggataggacaggcaggagcattctcgccaccaccaccgctctgcttattatctgagaggcagtggagggtggcactcagagcccagcttgggagctagacaagctggcctcatggtctggccctgccactccctggcagagtgatcttgggcaggttcttctacttccctgcagaatgcagaagatgccaggatcctgtgtggtgctgggaaggtgaggcagagggcctggctcacaggaggtgctcaacagcagagatccctcctcgcagcctcctcccctccctcttcccctgccctgtcctactcttcatctgctacaggctcgggtgccaggaagggaagttcaagttgattctttggcaacggtgctgttctcttgacagtctaaggcctctgccctctaggttggcataagtggtctttggtctttgttttgtttttttgaacctggacttcaaaaaaattcacgttagaatagctttagattttcagagatgttctgaagagggaacatagagctccacatacccctcatccagcttccctgctatgagcatctcacatggccttggcacagttgtcaaagctgagacctacgttggcacattaccattcactaaacagattttgtgtggatttcatcagttttcctacttatgtttattttttgacccaggatccaatctgggatcccacgttgcgcttaactgtcatgtctctgtagcctgctccagcccgtggcagtttctcagtctttccttgatttccaagaccttgagaatattgaggagtgatgtttaggtgcggtgactcactcctgtaatcccagcactttgggaggctgaggtgggtggatcacttgagttcaggagtttgagaccaacctggccaacatggtgaaaccccatctctaccaaaagtgcaaaaattagctgggtgtggtggcgcatgcctgtaattccagctacttgggagactgaggtgggaggattgcttgaacccgggaggcagaggttgcagtgagccgagatcgcaccaccgccctgaagcctgggcgacagagcgaggctctgtctcaaaaaaaaaaaaaaaaaaacaaaaaacaaaaaactctaaaaaaacaaaaagagtcttgaggagtaatgccaggtattcggtacaatgttccccactccgattttgtctggtgtcttctctgtgattagactggggttatgcgttttggataaaaacaccatggaggtgaagtacccatttcatgacgtcttatcaggacacatggcacctgcgtggcgtctctacagatgctcacctgggtctcttggttcgggacgtgtctgctgggctcctctgctgtttcccatttgcatgtctgctctgtggaagggactcactgggccagcccatcctcaagtgtgcatgagggactaagctctacctcccacttacagtcttttgaagctttgcaagtcttgtttctttttcctttttttgatggagtgttgttttgtcatccaggctggagtgtagtggcatgatcttgggtcactgcaaccttcctcttctgggttcaagtgattcttgtgcaccagcctcctgagtagctggggctacaggcatgcaccaccacgcctggctaatttttgtatttttagtagagacggagttccaccatgttggccaggctggtcttgaactcctgacctcaagtgatccacatgccttggcctcccaaagtgctgtgattacaggcatgagctaccgtgtccagccaagtccttgtttctttcaagaggcagggatcccccagcctgccccttctgttgtatgtgggagagtggagaggtggaggttccctttgagtctgcactagggagagacgagacagcccccttgcggagagtgcttggtgcttatcactgtgaacaaggttgatcttcatgctcttgtgaagtgccagcccaaccttatgcacgccttctaaagatgaggagcctgggggcttgtctgaggccaactccacctcaggtctccccagcagcctggccctcagcccacttttgcccatcatgtcccgctgaccaggtgaggggctgccagaggcttctgggagccacctctggacacctctgcagtgccatctcttgcccgcagggtgccagcctgggtgagcaatggggatgcagcggacgcagccttctccggggcccggcactccagctggaagcggaagagttcccgtcgcagtaagtctcccctccggcccaccgcccaccccaggtagcargctccaggatattctagtctttctaacccaagagagctgatgtgggctcctgtgagcccagggttcatcctcaccgggggcttctgtggccctggaggaccaaccaccgcccccaagagccaaggtccaggatcagttgacacacccagtttttcatctgctcctcaaatacttaygaagttcccacaacaggccagggcggcccagtggtgggagtgccctggggaccagaatgaggtccctctgttaacagaaccagacaccttgccatgggaaggtgcctgcccagatgagccctccagaaagagagggaggcagcaggggtgggggaaagagggtcccagacagaggggccaacttgtacaagggcctgagggcaggaggacccctgactcccgggaagcagcaagggcctcatctgtggggtgtgggggagcgttatggggtgaggtgtggctgcgggccctgcagctcctcagggccccagaggcagtgcttaaggttctcaaggcaataggaagccacagaaggaaggccagtgatgtggctgcctttgcctttcagtcctgttgcactggggtgggggcagtgtaggagaccaggtggggaagggtggagcctgctgggaggctatcgtggtcttgtaggacaggaagtctgagggtgggaactaggggtctagagagaggtgggcaggcctgggagctggtgtggggaggaagagggggctctgacagggctctaggggcccaggacctagggaagcatcacaggccagtgggtctcgtgacttcttcctggaaggcctgtgggtcaaggaccggctcccatcaggggtgggggctggttttccaagtcctagcactgctcagtgacgagggtctagccccggggtcctgggtgactgaggatgctagggccagggcacaggtgctggactgcgtcatgctccctgcaggggccgggagcagctgtccattagccagatgggcaggcctgcgggcagcagggagccaggtggggtctgtgcagtcactgggagggcgccttggagggggtggggggcggggagaagcgagggagccggcatcccctgagggcagctggcggagctaagggctgggctgggctatcagaaaggagggtgctgcgtgccaccagctggtgcagtcctgatgtcatctgcagcacctctggccaggctgccacagcccacggtggtgctstctctccccmcttccctcccagttgaccggttcactttccccgccctggaagaggatgtgatttatgacgacgtcccctgcgagagcccagatgcgcatcagcccggtatgatgtctgcagtgcttccctgtttctcttggggacaggggagggaggctgggactggggagggttgtctctttccgtttccttctgtccccacctggccaagtgcccctccttcttgtctttagaaacaactgtagtcatcggggagaatctggagatggctgagggcgtggccaccggggccgggcagggcttgggcatcatgggcagggccatgctccggctatgggtccccgggcaggtaatcacctttctaagccttggttcctccttcaggaaaatggggccataccccaggctttctggggctgttggggaagacgacagactgttacactcaaagggtgaagcagataaagctttgcaaagccctgcgccctgctctgggttgagggctgaggtgggcaggcaggcaggcgattgtggccgcagaagggagatggggcgggcctggggcgagtcttgctggaactcacctgatggaagagaggactgttcattggcaattaacaggaagagccgtctttgcttggacacgttaggccaagcatattttcaatcatgtaatggcttcaagactttgggatgttaccttctcattttacagacaagggaacggcagaggcagggctaggatttgaatgtgggtcattctgacccccagttcaatgctctgtcccctaccccaggaggatttctgtggcattttrtgacagatgaggcacatttgatcccactgatcccacgaccccttgaggtcagcagggccaggcttatttatggctcccatgatgaagaggttaaatcaccagccccagagtacacagccaggatttgaacagcgacttcttttcctactatgcgattcttcctgttttcaggggctctccgtccaatggggaagcacagcccctgcttttgaggagctccgagtctgatggggcagctctaaccatccttgagcagcacagagcgcaatgggagagacacacagacaacacggcaaggcccgagggccccagagccacactcctgactcctgtctcaggaacggggacacctgggccaaggatatgcttatccctttagcaagcctgggatgtgcttggagcacattttcctgtttgtagctcacttgagtccagggagcaatggattcccactgtattaggaggcaaaggagtctcagaaaagtcccagagctgggaggtctgagcggctgaggggcctcagttgttgtttaacccatttggcctatttcccacctgaattcaatcaagtcactaagtccctggctcctgtcttcactgtcctcagggtctgggaggatgtggcatgttcatggcctgggtgtcacacagcctgtgtttgcaccctagctctgagcctgcaaatggggaccacagtacccaccccaggatccccatatgctgggctgtgggaggatcatttgtgacaaggctgcacaaagctcagtgcagggtggagttttggagatgcttttcacacagggccactgttgctgttgttgttagtgttatgcctgccgagggtcccagcactggcctgcctggggctgatgtgggctcagcagaagcttggagaggagctcrggccagctctgccattgatttgggcacagggctttgtgcctttgtgccttggcttcttcacataaagcaggaaaatccccagctcacaggcctttggggagggtcacacggggtcctgaccaatctctctgggcctcagttgacccatctgtagaactggggcaataatagccagtcctagggtggtagcgtagattccatgaggtaattgatgaggacactgagcaggaagcatgaggggacccttatgtggtccctgaaagctgaggagttggccctcgggctgcacacaggcacaagagttctgtgactctgtctccactggagaggatatttctatatgtgtagatggcggggacttcaacggaaggtggtacagaaccctggccccgttcactgtcttactgtggccagccacatctctcccatctgtctaataggaggagtgatcattcacaccctgctgtctgcacagggccgctgggagccgtggcacaccgaggatggaggtggttgggtgcacggctcagccctgtggaggcgtggacctgccacatgctgccagggttcctcctcagggctaccctgagaactctgcctctttggccactagttcaggggcctccactgcaataacaggacaatcagcctggccttctgaaggtcgcagctgctccactctctaaagacattagttactattatcttttgcttaaaaatagcctcatgttccctcctggttctgggacccgtctcccactaagctttggcacatctgttttgttctttggctgacactcttgcccccaacctctcgcaccccacctttcctgtggggtgaagctggggggccctgggtctatggactgacacccaagctcccccagagccaccatgagtgacggcctactgctctcagccgagtgcgtgctatgtgtcaggcactttgccaagagctccgtgcctgttttatttactcaacttgtccacttattattagccacattttgcagagaggtctctgatgaccaaagctcgcagtttttcagcacagtcgtttctgagcagatttcttttcttcttcttcttcttctttttttttttgagatgttgtctctctctgtcacccaggctggagttcagtggcacggtctcggctcactgcagcttccgcctcccgggttcaagcaattctcctgcctcagcctcctgagtagctgggactacaggtgcgtgccaccacacccggctagtttttgtatttttagtagagatggggtttcatcatgttggccaggctggtcttgaactcctgacctcaggcgatccacccatctcagcctcccaaagtggtgggattacaggtgtgagccaccgcgaccagtcagattcctttttttttttttttaaaaaaacacaaaaacaaamaaacccttcccaatgctatatttcttctgtgatgacaaaagcattttcatcttcatgtactttttggcgtctgaccccagtttcatgaggtctgcagttctccaggtaacagatgaagaaatgaaacccagtggggcaaagggccttgcccaagatcccccagtgacggagctggggctgggaccctgtgttccggcctcgggacagtggctttcccacctcaggcttcaagtggcatctcatagccgagttgaatgggccccacgagtgccctggcccttgtgggacctgtccctccagactcttagctttttgtccccaagttttcagtccaaggcatttcccgcaggcttaggaaggaaaggagctcctggactctgggccagctgcgccccctactggaagatcccaggctgcacgtgaagtcagatttggggtgaggagccctgaggccccaacaatctctgtttcattcctgaggatgctgagggcctgagccaggacttggctccgggtcttctcttttccagtaagaaacaggccacgtgtggtggctcggctgggtgtggtggctcacgcctgtaaccctggcactttgggaggccgtggcaggaggatcacttgagtccaggagctcaagaccagcctgggcaacataacaagactccgtctctacaaaaaattaaaaaattagctgggtgtgatggtgcacacctgtagtcccggctacctgggaagctgagataggaggatctcttgagcccaggagtttgaggccacagtgagctatgattgtaccactgcactccagcctgggcgagacaatgagaccctgtctctaaaacaaaattgccaaggaggctcacaatgagcgctgagaccatacaaaagcagtgctgggagcaaaaggaagtgagcgggcttgtgcacgtctgacccatttcttgggttttccccattttctcaggccctccttgccctacgagggggaaaatgtattatcatcttcgtttcatggttgaggaggtagagctggagccccagggcccccatgttctccctgaccccccctcgccccacctgggttcagaaattgggtctgaggctggaagtctggtaggcttggcctcagggcctgggctcaccggctgccgcttggccagcaggggcagagaggaacctgctctacgaggatgcgcaccgggctggggcccctcggcaggcggaggacctaggctggagctccagtgagttcgagagctacagcgaggactcgggggaggaggccaagccggaggtcgaggtcgagcccgccaagcaccgagtgtccttccagcccaaggtgaggggaccgggggtgtcgctcacctcagtcagggcacggagaccccttcagggagggagggagggagggagctgggtagtgagggccaggcctaggactcacgtctgggtcccagggattcccgggtatgtgtggtgagaggggagccagaagcccaggtcatcccgaaacaggaggtgactcgtagacattgctgttggcagccctaagcccgggatgggcatggctggtacctggcacaggtgctccccccacccccttgctatggcagacctggtcaattgatcctgatgctcacgggctcagactgggcttcagagtcctctcaacgccgcactccaggtagcccagccacttgcttagaggtggagcctggatcagatccacttgctctccccgccttctgggactgatgctcagaccaggcctcagcccgcgcagtcctctctgctctggggcagtggagagtgggggctgctgtggctaagccagagcggcctggaagccttctctccagggcctcacacggtgccatccatgcattcagctttcctcgtgtttctgcctggagtagagaccattctgcttatttcctggaggggagcccctgaggctgtgagggggataggtcatctggttccttctttcccatggcacccatgctccttccctgttgttctgcggaagccaccaagaggcagcgtctgtccgtgctgagatttgcagtttcatggggacagcttcttacaggccctgactgagcagaggggatggcgtccctctcaggctacttttatgtttatttttattaattattcttttgaggcagagtctcactctttcgcccaggctggagtacagtggccctatctcggctcactgtaccctctgtttcctgggttcaagcaattttctgcttcagcctcccaggtagctgggattacaggcgtgcaccatcatgcctggctaatttttgtatttttgtagagatggggtttcgtcatgttgcccaggctggtctcaaactcctggcctcaagtgatccacctgcctcggcctcctaaagtgctgggattacaggtgtgagccaccatgcccagcctcaagctccttttaaaagatgtagcggggcgggagagctccacctggggccattcctgcatgggcagggtggggacaagagaggggactttcccagtgcctcccaccttttctgggcttgggggatccactctgggagaggcatgctggccggaggaacacccacacctgagtcctcaggcagccattcctcagaccaagatgggctccctgagtcctgagcaagcctgggactgagcaggtctctctcagcctgctgtttccagggatgggcctccaggggtgggctgtggaaaacagccttaatgtcttgctagccaaaaagcgaagcatttacaacacctactgtgtgcctagtccatatcttcagttgtgggacgggatacattggaacaggaagacctaatctgtgctcagtgaacctttacggtccataggagacactgaatgggaaacagtttgtcaaaaatgaacacaaaatgctggtcatcatgatcagtgtggtacaattttcaaagctaaactatcatgcccttcaaaacataatgaagacaaaaatgcctttacgtaaacatgagcctgtgtccagcctggctgtgtgcctgacaggggtagggactgatgagaccaatcagagacgcctctgagagcggtgagttggagctgggcttaggagctagaggagacaggacaggtgatccaggctggaggagcggcccaggcagaagcccaggaacagctcgttgctgcttcctgcagttcagaaggggcagcatgcactgctttagggaagggggctttggttatgaagcccccactccccccagtagcctctccatatggcaggacccgtgcgtcccagccctgctctgggcagtgtgaccagatggggctctcgagtcctggcccagccttttagcctcagcctctggcgttcctcctcctctcccatgttgtccccggccctcttgctgggactgggaggaaaccatgcgtgtctctcagagggaaggagggatgacaatgctgaattcaggctttccagcggtggtccccatgcttccacgggcatcagaaccacatgggtaactgattgaatcacagatgccagggcctcaccagggactctgattcaggggttgggtggggcccggtaatctgccttttaagcagctctctgcccccagggggtataaggggcccacagagcactccaagaaatgctgggctgtactcaccatggcctggccctgggacctctgggggctgcctgtgagctcgtgtccctcacactctcaggctgggggctttggacccttcctcagcagaaaaactatgtggcacagttgttgggatttctaaccacttggagtttttctctggccgtggccaaggcccacctgctcgctgatcagcaggctcctagggagacaggaggttgcggagggcttttcctctggtacccacttctgccagggactctactgagcctgcctgtggtgcttcaccctcctgagctgcttggggcgcacctgctcacccgctggcattgcagcagctgcatgttttagggccactgctgcttggctatgtgctgtgtgtgctgtgggcacaagctgacagcaggggtctggggatgtgttttgtcctgttcttggagactgaccatggccaggcaccctgcccagctgcaagagaactaatggaaccccttcttcagagatccgaagaggccgtccctaggcaggtggactcttgccaaaaaaagtgaccatggggtctgtagaggggcacggacccaagtggaagcagctgcctcatcctgttatgtgaacaagtggtcctgctggtgccaatccaggatctgtggttttttttttttccagttgtgggatggattgcattgaactctcccactctccagtggtgacctctttgaaatcaaggtctctgatccagctggacggggactgggcagaactcatggattcattacagaaacgccagccctggcccagcctggtctaccccctgctctgatctggccaactcagcaagtggcctctgatcctaacatttcctagttcttctgaccctgagagaagtgatggagcaccagaaggcccaggggctttatggttttattatgtgaaactattttatggatgaacaggactcaggtcaaaccccaaactcctcagttttttgggagtctgggtagctctcagagggacccctgtcctgcatgcatacttctttgcataacaatattgaacatttgcctagaatggtacactttacaaagcagtgtcatttaattttcccagtaccctaagtggtcagtattattgtccttaagattctcattttgttgatcagaaaacctgtgtgaagctcagagagacttaaatgatgtagaatgcaatatcacaggtgcctcatctgtctgtatatccatccatccatccatccatccatccatccatccatccatccactcatccattcacccatccaacaaatattgagcacttgcaatttaaaagataataatggcttccattttttgaatacttaataagctctgggctttgcatgtacatttaattttctcaacaaccctatgcagtagctactattatggccactttaccagtgaggaagctgcagctcaggtaaagagacttctctagctagtaagcagagatccatgatttgagcaggagcctacatgcctccagaactcacastcttgatccttctgtctacttctctagaagtagcacctgtcttggtcttttgtgtactttaccaaatatcactgttgctcatatggttcgtgcatttgaatatctatctgttcttctgtccatctacctgttctcccatcggtttgtccatccatccatccatccatccatccatcctccagatagtctgtaagctgagcatccattcttccatccagttgcccatccccctccctcccttttacccttcacccatcctccctccattcattctccagcagtgtgccagaggcagctagtgtcagctcacaagaactcaggagccagttatgagcatctctttacaaattcccattcagtgatgtcactttggtagcttggaattggtggaagtattcacaccatggaaatgcttcaaagcagggccctttttcctgcagaactggttgttaaatatttgccagcacagcactgcctgaatccattctcctaccgtccatccatcctcttattccttcatctgactgtctcttcatccatccatctgtccatttgcccagctatatagtcacctaaccaaatttatccatttgctcatccatctatttatctgtgcatctattcattcatccatttatttattcatccatccatccctctatgagcctgttcgtctacccatccacctgcctgtctgttgcccatccatctgccaaactcttcttctacccttccattcatctttctgtggatttacccacttatccatttatcccccaacctcattccatctatccatccacctgccatctgtctatctcacaaacttacagagaagctcctatgttacaagccctgtgctgggccacagggccggggagaagacacagttcttgccctcagagcattttcccttttccctaagacaggagacctggatttactcccctcccgcctctccgccccagcagcccagattccctgctgcagagacccggcccccagctgcctggcatggtggggttggacacagctggagcagattccgggcaggatctggctggactgctgcctgggacctggggtgccgcatcccgcctgcccgagctgtccgtccgcactttacctgagtctcctttctcccctgttgtctgtgttttgtctccttcctgtcccgcctgctcctctcacctgctttccttctgcctggccgcttggggctccagctttctccagacctgactaggctaaaggagagatacgccaggactaagagagacatcttggctttgagagttggggggagagacatgcaggagctgaagcacaagtacgattgtaaggtattgtctgtctgtcccctcaagccctggatgggggctgtttccagctgcagctacctccaagggttttcctgctgccctggtaccacgaagcctaccaggcccacccttgagtcccagggctgtcctgagacctggaccctggccacccttgcatctgtgctggaactggcagatgccttaagccacatgttcccttccatgttctcacccctatctttctccccacctgcaagtgaaaccctgatagtccacaagaattcccaggagggttttcaaactttaggacccttgcaatcacctggggtgctgtgttaaaaatgcaggttcctgagttccagccccaagggtgccacttacgtaggtctgggacgaggctcaggaatctgcacatttcataatctgcacagttggggttacacattgaaaaacgtgagtgttgctgacattggatgttcctatctctccacactattcagaggaatccaggataaggaagtctgtaggagaaatcacagtacttgcttaaacttttggatgatgatatcgacaacagtagcttccattaactgagcacctgctctgtgtcttggctaaaggcatggactttcgaggtctgtgggcctggtttgaatcccaatctcaccacttcctcatggtgtgatcctgagcaggccccttggcctctctgagcctcggtttccctgcctttgaaatgggggcattcacagtaccagcccccagggtggctttgaaggtcaacgatcaggcctcttgggtgtacggtgctgtgctgggtctagaagctcagtggacagtggctgttgttatctacatgcctgaccgccctgtccttgtggcactctgggcagtagctgcctttctgcatcttttagtgtcaagtacccggctagtggccacagcagtggttcacgacagagctgggattccaacttgggtctgcagtgtgccagagctcaaacgtcctccatcctgcagtgctgcccgctttattggaaygtgaagccttccaggaggaggagagcagaccctttacagttacgagacctttcacagatacccgcgagaggcctgcaacccagggtaggggcggggctaacctctcaggaagccaaggcttagagaggkgcccagagctagagaagggcagagtctaagactgggcctttcccccgcttcggccacacactgtgggaatgggkggattcggcagktgtactcggggacaccttctagggtgttggcctgttcttttttgcccaggaaaatgccaagagaagggcctcagatgatcccttgaaagaccactttgggggctcgcaggacagcaccactgatggctttctgccaggacaggaactggattctggaacagaggtttcagatctctgagggtgtgaccccctcctcccaccccccaacaagaagaagatgagcgtctatgccatccctttcgttagattctcaaaggcctctatgattaytccccttgcccaaccccagaaaaggccaagcacagcttctctaggattgtcccgtagaaatgcagggcaggcaggggacttccttctttttccctgctgctggttccttccagaaagtcagccttgttccttgaaagccaccacccctgcttccccatgcacagcacctggtggcttttcagcaacccttccttgcccagacccccaagaagtgcttggatacttaagtggggaccaaagggttattggaggtgatagagcagagaccagagacaaccccaccccgcagattagtgctccccaccttcagcagagagttttaggaaggagaaggttttcttaggactgcactgtccattatgatagccacgtggctctttaaatggaaattaactaaaagtaaatataattagaaatttgggtgcttcctcgcaccagcacatttcaagtgctcaatagtcgcatgtggcccgtggctcccattttggacagggcagatacagagtgtttctgtcattgcagagccttctctttgctggtgctgctgtatgctggagaagatgcgggtgctagggctggggcttgggaggacaaaggactggctgaggggacagcagctctgtcaggcctgggttcccccagcacctcggatgcccacttccctcttctgggcacgcggtctccttacgtctcatgttctgcttagcttgctacgctcgtgtccatggatcccctccccactgccagaggaagctgcctcttctttctggcaacttcagccttttctccttttcccggatggtggctcagtaagaaacctggctgtttcgggggaggcaagggacgggtccctcacctgggtttggcggatgggatgggggtgtgcacacacctcctttagttgctcctaaggtcatgttcaacattcgtggagtgcatttttctgctcagggagctttcccagacccggaatgtttggtgctcacagaccctggcaaggatcggtattgctgttcctcagttttgcctggggaaatggaggctcagtgacgttcagtgacgtgcccagagtcatgccattggcgggtggcccagggctccaggtctccagcacccctcggccccctcctcaccaggtcacatcatctcctggattagaaatctgctcacatagtctgtcctgaaaggaaaaaaatcggttacagcctcctgttgcccctaaagagggagatccccgggcatgaacgcaccttctcacccccactgtcgtccttggcctttgctcacggacctgggagggaagggtctgggtggttctgatctctgcaggccgaggcctggggaggcgggtggccctcggtagcaggcatcccaggccgtcccttccctgatgagcctctctacctttgctcagatgacccagctcatgaaggccgccaagagcgggaccaaggatgggctggagaagacacggatggccgtgatgcgcaaagtctccttcctgcacaggaaggacgtcctcggtgaggcgctgcccgagcgggagggtctggtgcccagctctgactgggggtcggggagggtgggattttgctttacaccccagaggtcatgctgggtgggtaccacttggcgtatggttcctctggtggtgggggttgggggctgagtcccaaatatcctggtaggtcccagtgtgcctccccctcctctggcaggcgtggcctgtcccttctgggagagctgggcctcttctttcagcgtccctgctcctgcttttgtcacggccgtcttggcctcctgccccctgcgctgtctggctcacctgtcctcatcttttttgttcctgttccctccttcctttatccatccacccatctctccaaccagctgacatttacggaatcctactaagcgccacagcctgtgctgcatgcagggacccacgatgcatgtatcagcagtgcctctggggccagctgttggcacagcgcgggagacaggcacaggcatgggaaatgacaggacaggttgacaagtggtccactggggtgccctggggggcatggaggaaatgaggatggacttgggggatgaaaggtcagggaaggaggaggcacaggtcaccaggcagagcggagtgggtgctctgggaagaggagcgagcgggtgtgcagagccccggatgtgggaaagtacgagatgttccagagatgctcttagtcagcactgactgagtatttattgtgtgccaggtgctgccctatgagcctacagttcctcacttcatccttatcctcaccacacaaggcgcacagaactctcacattcccacgcagcagatgagggaataggcacagagaggttgtgtcagggctgaggacacacaggcctggaagggatagaggaggcctcaggtggcggaagtgagggcgggcatgataggccagggtccggtcagtacaggctctgtcagccttgctgggcatttgcctttggtcttaaggatgctgcataaaccccattagagggttttacgcagaagcgtcccatggtcagatttgatcaattgatcattcatgtgacaagttttattaagcatctactatgtgctaggaactgtcctaaagccatgggacacagctgtgaatatgagtcctgcccctgatcccctgaagcccccttcaggtgcctacccttgctcctggtccccaccaggctccagtccattcctctggagaatgtctaggtcagggcccctgatgtattcccaggcattggtgggacagggtcaagtaagaccggcccctgctgcccatctcacatctttagaggtgacagacaaggagacaaggaatcccagtacagtgggctcacagctgatggaattctgggatgccagttctctttggaaggaaggaggctttgtctgctgcctgccctcggcacatggcctgatgcagcagaaggaacacaggcctcgagccaggcaggactttgagagcctgtgtcatcctagaaaattctgtaatctccctgtgcctcagtttcctcatccgtacagtggggtggctgtctgtcttgtagggctgtggtgaggatgtcctaggtagtatgaggagagagagagccccatgtagcagacgttattcttggtgggcggtcagtccctaagtggaggcgtttggtgccaggacggcctcgtgctggcctgttcagaccctggctctgcggctttctggctgtgtcgccttgcactttttcccctcttggggcggcagaccataaatgggttttcatctgtaacatgggttgagccccacccgtgcacttggtgcggtgctcagccagagtgggtgtgcacaggcctggcacaggctgggtgctcagtgaatgtccatgttccctctgcattttggggagcactgacccccgatgatggagggagcaggccaagtggccattctaaactcattgagatggtccgaagacaggataacgtggccaggccagctggctgggaactcttcctgggtcaccctcccaaccccaggctggctagggctctcctcagccctccccaccccgcccacaagcccagcgccttcctgaagtgaccctccctgcagaggcgatattaatagccgtggcagggctcgaatcacaggccaagaatgttacccagcagctcgtgggggaagaggaagctgcgaggcaggctggggtgggtgcggagtgatgcccggggcgtgatgtgggcccggcaggagggtctgcaccacccccacccccacgccgtcatccgctgtccctcctcctcctcctcctctgtctcctgctcaggtaagggcctattggggtgtctctaccccctcccacccttggggttgctgccgcttcttctttcctccccagcttcctcacagctcccatttcctgctgcccacagccaccgctggagtcagagccattcagcagctgggatcccctctcccggcacctgtaccttgctctgttgggggctggaaccctctccggagcctccctcactatctgacctcctcccactctcagaggcttgggcctctgtccatctcattccgtcctccgtctgaggtccagctccactcactcctgggattccatgtcaggctcctgttgaactttttccctttagctctgcatgttttatttcaaaaggaaagtgccaaaccacgctgccctgttcttctcggggcttattttcttcccccttttagacttccagaagaaaactatttttagttcctagtgatggggacatgggcagctagccttcgccaggccagagcgggcgggcctgagcagggacagtggcttctggcagcatggacgccgagaacccaggccccacaggacgcagctttgatttctgcctgttcaccctctcgctcacttgctcacaattattcactgatggaatgttccaggccctgggacgtagcagggaactcctgagaaggagctaccgggcggctctaaccccacggggccccaggagctgcttgcaccctaggacctgggtccaaggctggtctaggggggctctcagctcctgaggcctgagcagggtgtgctgtccctgccttagctgtgtcatcggcccatctgactttccaggtgactcggaggaggaggacatggggctcctggaggtcagcgtttcggacatcaagcccccagccccagagctgggccccatgccagagggcctgagccctcagcaggtctgtgggggagtggggcaggtgggggtctgcaggggaaggggtggcttgggggttccagcctgttctctggggccacgcttgtctggatctcacaggggatatgatgactgggggctcttggcagagcccagctggataggggcctcctaggttctctcctcagctattgaacaggctttccactttctaccccgtgtgctctgtgctgttggttttggggggtgggctcccggcatctagaacgcttgcgtcccccaactccatggcatgcagagcagtcccgttggctgtttctgactaaggtgtcatttgaagaatgagatgggatccagactcaggtgaggctgcaggtgtgtaggtgcccagtccctgccatctgtccacctgtcctcaccctgggcctcagagctgccacaagctcccaccaggaactgaggctctttaagaatggcttccttggctgggtgcggtggctcatgcctgtaaccccagcactttgggagggtgaagccggtgggtcagctgaggtcaggagttcgagaccatcctggccaacatggtgaaaccccatctctactaaaaatacaaaaaacaaacaaaaaaaattagatgtgcatggtggtacacgcttgtagtctcagctattcgggaggctgaggcaggagaatcacttgaacctgggaggcagaggttgcagtgagccgagatcgcgccactgcactccagcctggtgacacagcgagtgagactctgtctcaaaaaaaaaaaaaaaaaatggcttccttcttgtagagcatcgtgctgaggtcgggcagctttgctctgggatctcagcccagtcatgttgtcccttcgctatctgtgttttgccagccatgaaacagggtgcgagatccctgattcctctggctgtgaggccactgagcaggatgtgttgtaggatggtgggtagagaccagggaagctgctgaacatcctacgaggcacgggacagccccactatggggagttacttggccccagatgtccttgtgctctgctctgggtgccacttgagtacctggggattgttgacaatggatcaacaatgggacagtggtcttgccatctgctgggactgtgtggccaggccatggccaggcctggctgcaggcagggcagtgggaagatgggagaagagcctgctggaggcaggaggaggcagcagagggagtagggcagggagccggggttctggtggtggtgggctcctgatggacgctcaggacagctgtgggggtagagtagggggtcagtcacctcccaacccgagatcgagagggatgggctccccttcagacccctgtcacatgtgacacctcctgtgagcagcgtcctaactttgctgcacaatagagccacctgggaagatttcaaagtccctggtatccaggttccaccttgttcagaggacggtagaacttcagaaggtctggggtgggagccaggtgactgtgttggaaagatcctcagctgagggaggtgcaagccacaccatgctcgacggggtactgcaggctgcagctgaggggttgtgatccactccgtgggccaggcttctggagggttacggtgatggtggaagggaaaggagaagggactggggatgtttagccagaagcagagaccactcgtgtggggggacggtaccccaaggcctgtcttgtggaagagggatagctcaaggatttcattcgcaagtgaagggagctgagattcggttcatgctaatgctaagacagaattttcttttctttttttttgagatggagtcttgctctgttgcccaggctggagtgcagtggcgcgatcttggcccactgcaacctctgcctcccaggttccagcaattctcttgcttcagcctccaaagtagctgggactataggcgcgtgccaccacgcccagctgatttttgtatttttactagagacagggtttcaccatgttggccaggctggtttcgaactcctgacttcaggtgatttgcccatctctgcctcccaaagtgctgggattacaagcatgagccaccttgcctggcctaggattttctattagagttgtccaaagatggaggtggtcacccgccaccatggaggagcgtggtgattaccccatccccagatgtatgtgcacagaggggctttccctgggatgtgcccttcctcctccattctgtagccaggcagcagggcatttatttagggttggcaggggctctggaaggaagagtggccaccaggcccagtggtcccaggtgggacctgggagggatgggtttctctgtcctatagttgtcagctccccttcctgtcacttgggccctgtgcagcaggtgtcatgtgcgctgaccgtgctttttggcccgagcaggtggtccggaggcatatcctgggctccatcgtgcagagcgaaggcagctacgtggagtctctgaagcggatactccaggtgcgacttcagggagttctcaagggtctctggggagaagcagggagggccctggagggtaactttatacggagtgtttggggactgtgggcagttttaaggggacaggaccataagccagcactgctttatggggacagtagaacctccaaatgtaggcagcaagaattcctgatgccctggtgttcacgggagtgacttctttgtgaacaaaatgggattctttgaaatgactcctggagagctgagggcatatactcccatttatgactggaaggcactgtgtcctcctgccactctggaagcccctggggcttgggccatgtcttcccatcctcctgggatccttagttgggaagatgtgtaggatggagtcctccttcttgcatcgagaggagtaggatcgagtcctcttttttgcatcaggaggcccaggggttgctgagcagatgcttgcatgaagtgactagtatgtgccaacctgagaatccctgagacagtgtttgaatccctgagacagtgacttttccgggcggttgtgggctaccagagtaaggccaccagggtggggaattgttgctaatgataccctctcttcccctcttgagtttggatcctcagagagggatcctaggcatcaggcaggtagagatgaatatatcacctgtctctgacaaagctaattggagagtgacgcggggtgtgggagccaagggagcttgtagtgaccttaccgctcgtgggctcagtgacaggcagagcttcgccctcaggccggcctccaaggagctccttgcaggcagatggcgcataaaagaccctcttcctcccgaccaattaacacagaagcatgggggtgttgtgtgtggccagtgaggccaggggtgttatggtgatggagatccttccggaaggacgcatgaggagtgagggatgagtgcctcccctccgtgccacgggaaggcccattcatggctggccgagttctgcatgagggcaggtagggagagaggctgcggcctggcctgcggcctcaccccgccctccccggcaggactaccgcaaccccctgatggagatggagcccaaggcgctgagcgyccgcaagtgccaggtggtgttcttccgcgtgaaggagatcctgcactgccactccatgttccagatcgccctgtcctcccgcgtggctgagtgggattccaccgagaagatcggggacctcttcgtggcctcggtaagtgtccccaaactttttccccagcccaccaaggtaaaaccacaaccagtctgaccccggggccatgcagtccagcctcctgcctctgcctgcttgccttgttcaagtcagtgggattagagggtggcagggtcttctgggcctgatctaggggtgagtgtgacaccttgaagtggccaggatgtccttggatatacctggcaggccatggtgctgatgaagccaggtggctgtcctggctcctcccaggtggcagcaccccctggcctcccagtcactgtgggcagccacctggccggtcacaagctctcttaccgagcacttgaggggtttcaagccagtgtgaaatgctgtgaaagaccacaactttggcccggagaggatgtgccgcagtgctggggaaagggcactggctcacgatccgggggacctggttctggtcccagctcagttctgcaacctagggcaggtccagggcccactctgagcccaggcttgccatctgtggaatgaggggtgcactggatttctggcttttctagctgaagtctgcggaccccagatgttcatggggtgagggaaggtcaagttggtagcactctactttgatgtgttttaggtaactaggttttgctaaaagaaaaaaacttttttttgaaagccacagcgctcgatagagtcactgaataggtctgatgttctgggtgtatatcaagrggctctggagagagagttgattgactccaggccgaccatccctcccttggtaactcaactctgggcacgctgcccggtgagaggccaggagcactttccttaaaggtggagggcaaggggcattcgatttcctgaacgtgaatgcagtagaaggggtgttccccctgcccttctcctccctccacctgtgggcttgggctgctgcactggggatggagacctgggaggcgaaggtcccctgggctctcctgtggcaccaccccatcccacctgtgacctcaggccagcctctctacctctctgagctccatgtccacaccccagtgggggtgatggatttgcacagctcgaggtcccaagggagtgtggggtgagtgcaggcgcccttctgctccctgccttgaggcggcctccctggcccacacctgcctcgtttccttctgctccctgcattgaggcggtctccctggcccacacctgccttgtttcagttttccaagtccatggtgctagatgtgtacagtgactacgtgaacaacttcaccagtgccatgtccatcatcaagaaggcctgcctcaccaagcctgccttcctcgagttcctcaaggtgggcctccatggtggtaccgtgcctggtcagggtgggcagggagattgctcaggaggaagggagcattttggccccagctttgggtatgacatcatagctttggcctggacagctcccctctttcttttggggcagcccagtcccatgggaagaaaatcgttccctcctgcccctgggaggagcgtagccaagtgtctgtaagcaactgggatcctggagctttggcagggtggagggaagacctgtgtcatcttgctgaccctttgcctcctgtgccctggtgagtgggtgggtctgcctggctggccctgtggtgggctgtggctcccgggttgctaagctggttccttttcctcatttataaaagggtgaggaaattccttataggggtatcttgggcattgcttgggagagtaaaggttaaaggcttcgaaaagcttctgagttctcatgtgcccagcctctgctgatttctttgggagtgtagtctggtgagtcagagcccctgcctgtagggagcctgctggctggcagaggatgcaactgggctaggtgccaggacacgcacacatgtgccggcagcacaggttagatgccacggcctcagtggaggaacccactgtccccatcaaagagaacaggggatcaggaggagccaccatctgacatgggccctggcgggggatggtgggattgtgccaaataaagacagaggagagcctatatcaggtgtaaggatagtggagcaaaggttagaggcaggaggagagggatgggcaggtctgtttggattctgggagcactgatgcctgttggggagtcccaggagagaaggcctgagtgtgcacactaagaggcggctgagttcagttgggtggttctagacctccaggcccagggcctaggatgtaatatttcaggtaatggggagccattgaaggattttgagctagggkagatgkaagtggaggcaggtggagaaactgtgggattgcagcatatgggggccaggaccaggtaacaggtgtgtggatggagtgggggatggatgcaagagacaggacagaaggtccccctgtgccccgccccttaccctagcccaaatctgtctgcatttagtttaagtggagggaatggttgccttggccacttctagaagtctgacatcttgaataaattgctgagtttcccagttatgcctttagttcagagaccttaagatgactgctttagtctcctgagggtgcgcggccatgcaggggcactggtgggagagggatccctggctgcagaaccacggacctctctcagctcttcttgcaagcccagggataggcagggtcttagggcctggggagaggagcccagaatggggacagtgtctggactctggggcactgggccctctctgcagggggtcagcgaatgacggaaccttgtctccaccagcgacggcaggtgtgcagcccagaccgtgtcaccctctacgggctgatggtcaagcccatccagaggttcccacagttcatmctcctgcttcaggtactgctcaggattccagcagcttcaacccacagggtttgcctgtgggctgggaggtgcctcctggggtaggagggaggaggtctgggctcttgtccgtgatccataacccacccaacctgctgtgggactctggcctcatctttctccacttctagagtgaaattgattgtaactgacagctcagtttgcacgcccctctgtgggggacgctgagggactgctggtggcctgagtctgggttgcaggaagggagtgaaggcacagggaatcccgggacccgcagggctcctggcatggaggagatgctcagtaaacatgctgagcttggccatttcagattcgagcttcagaacaggggattcctaagggacattagccccacacagggtcctggagagcttgggacactgtcccaaccactgagggtccttgggcaggggctggccctcatcagggagctgagagggtggctaccaggctgaggggtccggtggcacattgctatccactctcagtgctgctggcctgtgggagtgggctcttatgtaaccataccatttatcaattgatcagtgattgatctataagtttatttatttaccatcataaccatttctaagtgcattcacattgttctgcaaccatcaccaccacccatcccagaactttctcatcatcctgaaccgaaactctgcccattcaacaactcccgattctccctccccacagcctccggcaaccaccattctaccctgtgtctctatgactctgactgctctaggaaaacacgtatacgtggaatcatacaatgtttttcttttcgtgactggcttgttttccttaacatgaggtcttcaagattcatcgtgtcctagcatgtgtctgaatttccttccttttcaaggctgaataatacgccattgtatggagagaccacattttgtttacgcgttagtctgtcgacggacatttttgcctccacattttggcgactgtggctaatgctgctatgaacatggctggacaaatatctgtttgagaccccgctttcagttcatgtgggtctattcctagaaagatccatgcttttgttttctttttcatgcattagctgtttcttgaggtcttgttctgcatctggtgccatctgtcctggcctcaggccgggccctttgcagacccagtgtgtgtagggggttgcgcagggtgaggctttgccccaggctggggtagagttggtcatgggtgggctgctcagtctctgctctgacctggcaggacatgctgaagaacacccccaggggccatccggacaggctgtcgctgcagctggccctcacagagctggagacgctggctgagaagctgaacgagcagaagcggctggctgaccaggtggctgagatccagcagctgaccaagagcgtcagtgaccgcagcagcctcaacaaggtgagctgggcctcccacctgcctgccctcacctgcctgccctcacctgtgctcctgcccgtgcccctgccccacgccacccacactaggtggcagtgttctctgagggaggggaggccttgctcttccaaggatgtgaccttggggattggatcctcagcgggacccccacgttcattcctgttcatgttattttaagataaaagttcattttgtgcatcagtgtgatttccagtaaagtctccagaaatcaaagcctagttaaatgaacaggctctggagagtcagaatctgggtttagatccagattttgccataggtgcttgctgtgtgccctcaagggaatcacccaccctctctgaacctcacttgctccctttgaaatgaggagcatttaatagcaccggagccctagggctgctgccgcaaaagagggagctggcaaagtggcttcgtgattgtccttaacacaagaagaaagatgaaaagtccatgccatgttttggggttgccgcttaggaacatgctattaaaaaaaaaaaaagaaaattgggctgggcgtggtagctcacgcctgtagtcccagcactttgggaggctgaggcaggcagatcacctgaggtcaggagttcgagaccagcctggccaacatggtgaaaccttgtctctactaaaaatataaaaattagccaggcatggtggcacacgcctgtaatcccggaaggctgaggaaggagaatcacttgaattcaggaggcagaggttgcagtgaaccgagattgtgccactgtactccagcctgggtgacagagggagactctgtctctaaaggaaaaaaaccaaacaaaaccaaaagacttgcaaatgagtctgtagaggagcctgtttttaaagcacaaggtcacctcacagagtcacctgttggtcactggagtccctcttcttccctctcagcacatgacatgaactgcctggctctgtgctggggtctctgggaggtcccacaccccagcccccctgttcacctactggagggtaggggagggctgggatagtttaggctggggtgcccaggccctgggcacattgcaggactgttctttggagaacggatactgtgtgaggtcatagggagaggttcaaattttctggggaataaactgggagcctcttggctctgtggggtcctagaagcagaactaaggcctatggctggctgttcccaggagggaggtttcagcagcacrgggtagacctttctaagagtccaggaaggagtacccagagggagagtggccctttccatgtgtgctgcactttacagtatagaatgctgtctaacctgcatcagcatctttgctttccaccccatgcctgtgaagtggggcagggacaaggcctcctgtagggtcccctgcagtgccaagcttcaggcaacccacatcttaggactctgttgcttcaggccaaattcaggttgcaggttgtgttgtggcccacacagtattttattctatttaatttaattttattttgagacagggcctcatgctgttgcccaggctggagtacagtggtacaataacggctcactgcagccttgagctcctgggctcaagtgagcctcctgcctcagcctcttgagtagctgggactacaagcacgagctaccacacccagctaattaattttttttttttttttgtagagatggggtctcactatgatgcccaggctggtctcaaactcctgggatcaagtgatcctcctgcctcagcctcccaaagtgttgggatcacaggcatgagccacggtgcccggcccacacagtagttttaagaacatggcagtagttgccaacatttaaaaattgagagagatcctataaaattcagacttgtgggtctcctgggagggtaggaagagctggctcaccgacccaccttcccacgtggcaccagcccccgagtggcagctgcccacttccccttggttcctacccacctttcccactgatgttacctgcaagcccctaaggcatctgagtttattttacctgctccaggaggattgggctggggaagacgagatggggaggggacagcgccctctcctggggatgtccccatccacgtggctcaggttgggcatgaggggcagggtcactctccaccccctggttccaggcaggactaactcagccatcccccacacaagcctcgagtttggaatgtctcgggagaaaaagccttcagccccgccatgaccacccgtgctggcctttgcgctcaggaatcttctcctctccccaccttcggctccctcttcggtgaccaagaggctttctcttgctttgcctcatacacctgtgcagccacagtggggagaggcctcttgggaggaggaaataaattccgtagtggttgggaagagccgttctgccctctcctgctctgtgaggtgggccctggctggaggtaagggagacctctttgatgctgggcaaaggactagaggctctaagcttccatgtctccatttgctgggtgagggtaggttggaccatgtgagatgttaggaagagtgtggtggaggccgcaccctgggcttccccctccagggccctccctggacagtcctggccagttctgtgacctgtttagtgatgtccctatcaccatcacccagggagaagcagaaacgaaactgggtgtaacccgaaacggaaccatgccagctgtttcaaaatagcctaggcaggagcctccagagggccgtttgtgcaatatcctggttttctttttctttttgttggttttcatctgccaagggggcagcgctgactgccagagcccacgggactttcctcttccaagttttgggtcatggcacatttggcagcccttggggcggggggccctgctgtcttcaaggtccgagtagtggtctcttgagttggcgtttggtttccttgtggaaatagtgaggcggagcctggccttagcagctgtgggggaccccaagtcctcctgcatgttaggagcggtggggcctcccctggctcctgtcacactgtgcactagctgctcaatgcagggaatggtgaacgtggcctggctctgtcctgtgctgtcaatcaacagtgggtgggtctcagcgagtcactttacccctggaatctcagtttcctcacctgggcaatggggatggcctcaaggaccgctgagctgattcaatgagatgtggaatattaagagccatcctcagtgcctggcacaccctgggcatttggtcccactgggacttttggttgtgtgccgacttgagagagatgatgctttggagaacaacagcattctctcccgaggaggctcggggtgatctgtccttttctctcctggggatgcctgggggtgatctgtgtttttctctctggggaggctcagggtgwtctgtccttttctctcctggggatgctcggggtgatctgtccttttctgtcctggggatgcccgggggtgatctatctttttctctctggggaggctcagagtgatctgtccttttctgtcctggggttgcctgggggtgatctgtctttttctctttggggaggctcagggtgatctgtccttttrtgtcccggggaggctcggggtgatctgtccttttcccagacaggatggggraggaaggggagagtaatggttgtcgtcagagtcacgggttttgggaatgaattttgctgaatatcctccctccctcccagaaaaaaatcccctttagaaaaaagacgttttcccagggtgtccctggatgggttggtggccctgacactagcagggggggtcttgacatccagcctgaggttggcaaatgcctgcttggatgcctggggtgtgaaagtctttgtcctcagagggtggtgttattgactggcaggtctgttccaactctgtcatgaggccacctaagaggcgagacaggccaaggctttcaacaggttggggtgcaggatggggtcccctgcacaaggccacgcctgctccactgtgaagaccatcacagacagtagttgtctatggagcacacatacagggccggcctctcaggccatgacctgtgtcatcacacgtgacccgtgtcatcacacgtgacctgtgccatcacacatgacctgtgccatcatacatggctggtgcccagaagggccccatgcttgctttcatgttctgccatggycatcttgaaattcatagtcactttgaacaagagcctgtgttttcgttttgcactggaccgcaagagtcatgtagccagacccggtcacatgttcattaccttgtgtgatctgagcagtagaggtatctgcccccacttggtagctgagtaaactaaggcttggacatgtgaagtgacctgcccaagggcttcacagcaggagtggggatgggggcagagccacctctgtaactccagagctgtgtccttggcagtggcaatcaggcagaatccctacagagaggggctggcaatggctggctcacctgagaagggggcactggctgctgggcccacacgggtgctggtgaatgctcagtctccccatggcctccgagaggaggccccgatgtgtggtcctctggtcttcctccccagtgcatcttgtcacccagggatggagggagtggcttcatctcctccacctctcccagcctcagtctccctttctgcaccatgggaggattctgggtctccggcgcggtaaagccgccgggccgcgatgctgatgctgaccttccctgcccctcctccagctgttgacctcaggccagcggcagctgctcctgtgtgagacgttgacggagaccgtgtacggtgaccgcgggcagctaattaagtccaaggagcgtcgggtcttcctgctcaacgacatgcttgtctgtgccaacatcaacttcaagtaagtgggcctgggttggagggggcaatcacccctccctggagaccccatcccgccctactccagtctcttggccggccgcactacagtgggaccccatgtgagcttggtttaggcttccaatattcctctcccatccctcttgccctgctctgccactggtccccaacgctgggaagtacctggagcagtcatcgggggcagccctcagcctcgggcacacagctgtccatggtacagagttgtttgttttggaactctgcagttggtgactaaacagtggttttgtccacattgaaattcaagagattcttccttgtgtctaccccagatccctgcggctttaactcaaatctgttttgctctggccagattgcagaatttctcagtgtgagcctttgcctttcccccacagaccggagcatcatcatcggcccagaggagcctggtttgctggttctgggccggggattgtggaaatgcccaaagcccggctgctgggctgtgcctgggagccggagccctggtgtggggtgagggtgaggctttaggccagagcctgaagatgtggcycatcagttgctttaggctcctgggtatcttatgttttactaacacagggagcccacaccatgggtgagacataggagagatctgacattctggggcctggctgcctgaggccacgtgggcctggcactggggcttgggccctgccattctccagcctttctgctttgcccagctcacctgctcgcatcccctgcttggtcctgcaggggaccctgtatcaaatactccctgagaacttcagctgtggtttttctagccaggctcttaggagaacctctgctctcaatatttgacaagactttattttattttattattttttgagatggaatcttgctctgtctcccaggctggagtgcaatggcatgatctcggttcactgcaacctctgcctcctgggtttaagtgattcttctgcctcagcctcccgagtagctgggattataggcatgtgccaccacacctagctaattttttttttaattgtatttttattagagaggggtttcaccatgttggccaggctggtctcaaactcctgacctcaggtgatcggcccgcctcagcctcccaaagtgctgggattacaggcgtaagccaccgtgccccacctcgacaccactttaaaaagcatcacagaagcaatagtatggctaccatcaccgaaatccaggagggaaacaatcacctcagtggaatgtgaatcccagcatagctctcccgcctcccagctgaatcagttctaggccctgtaccgagtcagcttgggccttcctgggtttggccacagagtaggtttggggattttccatggttaccgatcacgagtcctggaaggggacaagcagggctgtttcaggacctgtgcactcattcaccatccacccatttgtccacccgtctatgaatccattgaatgtagtccgagacctggctctgtgccagttcacacctagaatgagatccagcccctgcctccgggagctcagggcctggttggggactcaggcaaggaagcctctgtcacacatgggtctgggcagggcttatggctgacccattcattcatttactcactcactcaatcaaagaaggtaattcttcagtcccgtttatatcctgggcaccgtgtggtgccggcggtatgatgaataccctctctgccttcatgttgctctagcgcaaagtgcaaagtggggtgctagtggcccggttttggggaatcagtttgggtgatttgggctgagtcacttcacttgactgaggatcagtgtcctygtctgggatcatctaagcttcctagcggggctgttgtgagacccagagatgaaggaaggcccgcttctgtccacacctggcctctgatgccctcattccccgcaggaggctgtctctccttctattcccgatgcccagccccatggctggcccccagcggggtcacagcccccagattagccactccattgtaataacaatctccctttccttcttgtcttttttcccaggcctgccaaccacaggtacgtggttcagggggctccggggctctggggctctggggctctggggctctggtgycatgtgattctggatatggggctggggcctgggcgcctggtgcttctaccctggcgagggatccctgctctgcctggcttggttttggtctgaggtcttgcgctggggctgcgtgaagcctggctgagctggtgtggaggagcaatgccctgggccagccctggggcagggtggctgcagcctctccagggccttgtcctctctgttccaacaggggccagctggagatyagcagcctggtgcccctggggcccaagtatgtggtgaagtggaacacggcrctgccccaggtgcaggtggtggaggtgggccaggacggtggcacctatgacaaggacaatgtgctcatccagcactcaggcgccaagaaggcctctgcctcagggcaggctcagagtgagtaccccctctctgtgccctgcgttcgtcaccctcgccctcaccagccacagcctgggctgctcctacccaggcttggccctgtcttggggacccctacataggctgatgggtggcttggccaggaagctcttgctggttttgcagccccaccctggaccttaatgcagagccatggcctcacctgggtgtgcgcaggtgcrtctcccaatccacacactttgctccaccttcacattggctgccacacactctgtcctgctgtgccagctacctggctgctcttcctccctcctcctacctgggccccctccctgtccatcctctgcccatccccagggctgattcttccaaatgcaggtcagatcagtgcacgtcatcccgccccagtggcttcccattgccggtcctgagggtgtaccacctgcctcactcacctccctctgccccttctctctgctgcagccatgccagcccctctgggctcctggatgggccaygctccctcccaccaygccctctccagcctgtgccttttgccaagtactctcctgccatcctgtttttgtctcatctgctcttggctcaaatggcacttcctcagagaagccttttcttatgccctcatgctgggccaggtcgcccctcctgtgctctcgagacctctggtacattttcccctttatgggtgattgatcggttgatgtctctcctctcagcctggctgcagctctgtccaggagcctagggtacggtgggcattaataagtgttccttgaatgcatgcaggatgctaaattgcagcagaaaggaaccctggtgcccgaggcatcttctgtgggtgagaaaggcactggggtttcacttccccctctgtctgctgtctgacccaggaggctgcctcatgggccacccacaattctggaaattctgagggagtgattgcaccacctactcttgccgtctgggtgctggtccgtgacagctgtgcccacttccagatgctgtctctttcctcagctctgctgggtaggaagagtcctctgccccacgtgccttcctcggaggcaccttctgccctggctcaactgcactccctccccgccgcttggggcacagggttcctttctgctggtcatgcggtctagcatccttcatgcactccagggacgcttaggggatccctccttcggtgacaatgatgtgtctgtggccgcattcctcaaaccagagtcacgtactgccagaccccttcgaaaggggaaagaagttcttgtggaacccttcattatattgttattcaaatatatacaaacgcaaaactccctgtaatcaactccttctgcttatagcccttgaagaaccataaaaccaacaccaaatcacaaattgaataaaaataaagctacaaaaccataacattcaaattaacagcattaatgtaatgtgatggatgatgttgttttgctgaaaccaatttgytcacagtgtggatgtggctyaggccctggtagagcaggttcctctgcgctttcgtgcctgtgccacagggtgccctgtggggatctgcatttcccatgagctccccagtttgggtcactgcagagcccctctgatgtgagcacattgtccacatcccaagctcgccatgctctttgcttgttaccaggtgaccattcaggtgccatagtccatggaagccttgatatcaggcagcagagtgtggctttaamctcattccacacaggtgactcagataattatctaaatgaaaaccccaaataaggcttcccctccactcccckggggcttcataagacctcagtgtgcaaaaccacggcctagagaatacagtccaaattcctagcccaggggcctagcgttcaaggccttccccatctggtcctcctggaccctcctgctctatctctacctgccaccccctacccccatctcacccttactccatctgtatcatcactggtgatctgggccccctcaccccatcactgtcccaccacactgatatctttctccccaccacctcctaccacccaccattgttaactgactgcttcctccgccacttgtcctgccaaggtcataagctccggaagaatgaggaccctgtctgtcttgtgtactgctgtctccagtctctagcatggagtctggcacacgataggtcctcaggatgtctttgaacaacttgctgttcatgggctgcctcaagccacagtgcctttgcacacgctcttgtctttctctcctggcagtgcccaccacacttccagccctatgcaggcccctcctctctcccaggcacagcttgctcttggtcttgtggtctcatacagccctttgtacagactgactatggcctggatctcaggtgttagactttactcttgaaaggatctggcttcccagctagtctgggcgctctggtcagggtaggaactggatgttactttctggaactctttcttttttttttgggttggagtcttgctctgtcacccaggctggagtgcagtggcgtgatctcggctcactgcaagctccgcctcccaggttcacgtcattctcctgcctcagcctcctgagtagctggtactacaggtgcccgccaccatgcccggctaatttttttctttgtattttttagtacagacggggtttcaccgtattagccaggatggtctcgatctcctgacctcgtgatctgcctgcctcggcctcccaaagtgctgggattacaggcgtgagccacygcgcccagcctctggatcttttttgttgtgagcagatgcttggcttcttgttagcgccttcacctgtgcctgagttggtctcttctctgcccagataaggtgtacctcggccccccacgcctcttccaggagctgcaggacctgcagaaggacctggccgtggtggagcagatcacgcttctcatyagcacgctgcacggcacctaccaggtacgtggcctggcctgacctytttggcctgagctccccagtgtgggcagtgcctggattcagaaagctgagtagggaggggctcctctcctggcccatrtccccgatgtgctcctagyttctgagctcctgttggcaactgtcgctgctgaagctccatgtccctgcctggaagtctcttttgcggccgctggttcgggcgcatcctctggtttgggttgagtggagcctggctgtggggcctttgtttgttctctgcacagtggccattccgttatgtggcccctcctgggcctctacccartgtggaggggaagctggctgcgacggcatgtccctctcagaggagggctccaggtgggatctgagcccagggctgggaagcctggggcatggcgagttggcctcctgcgtggggctaaatgtgcagcctcagtgaggctccaggacttcttcagtttctcttcctctggggtgctgtgattcctataggatctggtgtggcttttggggagccagtgtgctgtgtggtgacctcattggcctcctgaaccctagaacctgaacatgactgtggctcaagactggtgcctggccctgcagaggctgatgcgggtgaaggaggaagagatccactcggccaacaagtgccgtctcaggctcctgcttcctgggaaacccgacaagtgagaggarggggtcttggagggagggctgctgcctctgctgggcttccagtggagcaggggatccggagagggtacctggagccctcttatttgtcgagatgccatggtgggagtggatatgtaggcatcgtgggccatgtctgggatagcatctggcacgcagtaggtgctcatgaaaagactgtggaatgaatgaatgaattaatgaacagcctggtcatgtcctggataagcctggcccactgttaggatactcagacactctgccattggtcagttccatttgcgctgtgtccttttcagtcacttcagcctatctaggcccccaggccaggccctgggtttcctctctctggacccagcctccccccagcaccaccttagccccagaatgcccaccacaggagctgtgcacagtagaccccaactgaggtttgtggaactgatgacagccatagctgctcggcctggcagagacagggaacgggatctttctggtcctcctgaggctttgtaagttgggtctttttatttccattttacagatgaggaaggtgaggctcagagtttcaggagaggctgaaggccacatcgtgagagacagagctgggtcctgatgaggtctgactctgaagcccaggccagtgcaatgagggggctcaatgcccaggttttggcctccagggtggggtgaaggtggggatagagtgtcacaagcacagtggctgcaaggaagagaaggttggagcactatcatttgaggtaggaccatgggctcagtcccccaggggaccatgtgtaggagtcagcagctttgaatctgccgcctccctgttgagtggcctgtccgtctcccttcctccatctcccttctctctgcctctcattctccacgtgcaccctagaggcttgtgacactgccctgcccacctcccaaagggctgggaaggcccccactgctctgaggtgagaggacagcgtggtgacaacagcaacctctggttgccccaagctggtgcttaacctgattcattcatttcttcattcattcctgtgtccactcagcaaacatttactgagcaactgtcccatgccaggtgctgggaacagacccaagtgagacccattcctccctctagaggcacgtggtcagacatgtaaggtgtctaagacctgtggacagctgaccgctgaccaggtggagtcacagcctgcagaggctctgccgggcacaaagccagaggctcctggagccaggctggggagcgtggctcagccaccctggccaggtacctccctctgggggtcattgtgggcggagggattcctcccccaggggaccgaggctttgccaagccactgacctctttggccacgttttggggatgctctgaccagacctccttgatctccagggcgcgtgggttggaggaagtactacgtgacagctgggggagcctggcccttgtgtgggtactcacacatccactctaacccttctcaccacaggtccggccgccccattagcttcatggtggttttcatcacccccaaccccctgagcaagatttcctgggtcaacaggttacatttggccaaaatcggactccgtgagtatagccccagggagagtgcctcagggggcaggggtgtggaacggggaggtttggggtgagtgagggtacaggatgggtgttcggggtcagcggggggcagggaggcttctgagtgggagggaggtggtgcggtggagaaacagctggggccagagccggaggctctgctttgtgaccctggacaagtcacttcccctctctgagcctcagcttccccatccaggaattgatggaacttgayagaaagtaaattagtggttgccagggacctgagaggagaggataatggagaatgactgctagactgctaggggttttggtggaggtgatgaaaatgttctaaaattagatggtggtgattgctcaactctgtgactacaccaaaaatcagtggcgtgtgcactttaaaaggatgcgttttatggtaactggattgtatctcaataaagctgttacccagaaaaatgatgcaggttggactatactgattctcaaagaccaaagacctcgttactatgtttttcttcctgtgcaccccatggtatgaatacagatacataaatggatatttacatgcacttttctgagtattttttgtgcatctttttcatttcacattcacagtagccttaagagttaggtctgttgagaatctctttttccattgaggattctgaggcccagagatgtgcggggacttgcctgaggtcacacagaaggaaggggcagatctgggccgcagaccctgtgtggcctgactccaaagcccagtctcgatccccatccattctgcttccttggcttggcaagagtctgtctgcagactgcattcattaagttataattactttacttgtccattttttgagttggtgagaggcttatgtcccctccagacagagctattattccctatgatgtactacagttcccatttgccgatgccagccaatagcaggaacgtttttttatttttgtttctggtatgatctttctatagagaagcttacattttcaataggttttaacacatttatggaaggccgggcgcagtggctcacgcctgtaatcccagcactttgggaggctgaggcgggtggatcacaaggtcaggagatcgagaccatcctggctaacatggtgaaaccctgtttctactaaaaatacaaaaaattagcctggcacacgcctgtagtcccagctactcgggaggccaaagcaggagaattgcttgaattccgggagttcgagtttgcggcgagccaagatcatgccactgcactccagcctgggcaacagagccagactccatctcaaaaacaaaacaaaacaaaacaaaacacaacaaaacaaacaaaaagacatttctggaaagaagtcaggacctttggctgggcgtggtggctcgcgcctgtaatcctagcactttgggaggccgaggcgggcagatcacctgaggtcaggagttcgagaccatcctggccaacatggtgaaaccccatctctactaaaaatacaaaaaaattagccagacatggtggcgcatgtctgtagtcccagctactcgagaggttgaggcaggagaatcacttgaacctaggaggcggaggttgcagtgagccaagatcgtgccactgtactccagcctgagtgatagagtgagactccgtcttaaaaaaaaagaaaaaaaaaagaaaaaaaaaagaagttaggacctatgtcactggttttcattaatkgaaaaaactgttgagactctacatagttttgggcatgggggaagaataatgacaaaaacagagagatctctgctctcaaggaacttagatttatgaggggcaggcaggtggacattaaatggggagcaaatctgcaagcaggtgttatgctgtacagggcatagagctgggctggggctgccatctgggggacccctgaggcggggtcctcagaagctgcacaaatatctggtcagagtgatccaggtatggggatagcaagtacaaaggccctgaggtagggacagaaggaagcccagagtggccagcactggcagatgaaggggagggaggtaggtgggtgtgttgcgggcaggttttctgggaagccggggagagccgtatgggatttgttctgggcatgatgggaagctgtgcattatagcattgagagctggatagtgtccygatctgattttcatttaagtgggtcattctggctgctgtggggagagggcatgggaggggcaggtgtggaggtgggagcaggaatggggaggggttgcctgtggaggaacctggaccagaggcttctactcagcccatcccttcttggatccagtgctgatattgctctgacctcagctggatgtttctgggtgaccagaaggcctttggagggtgcagaaagtgttttaagcagaagctgtcctgtccctggcagaagactttgggaatcctggccctcagaaaggctaatgtggcttccctgccccttgggccatgcrctcccctccccaccccatgcatcacttccatcctgagaagtgccygagccccatgttacacctgctttaaaggcagatgaatgtcctgtttgaaccgcatgtgctttgctgcatggggcttggtgctggagggatgggagacggtgattcgggcagccccagctcttggcagcctgtgaagatgctgggctgccttatctccacacagcttcactgcagcaaaagttttaatggaagaagagtcatttgaaatcttatttgaatgcctgkgttcccctggggcttgaataatttgtttcttttattttgccagtattttttttctttttatctgcagtggctggtttgggaggggatgataatatgagcctgttagaaatagaatatgttaaaaacatttattcacaaaggctgttattcctttattttattttctatatcttcctccctccctgactacagtgtgtcaggatcataatctgaagattgagaaaggagagggatgtggtgggggagcctgcgatctgggagaggggatcagctctgccccttggaagggcagggagccctggggaatctggggaccccgttcaaaccccagcatggccaccaccacgccttgtggtcctgggaaaggcagactccatcctgagacccagttttcctatttgtgagttggaatagatctccaagggccctgttgcattctttggcacacaggaaggtttgagaggcagtaaggggtggtcctcagcaccatgggaaatggagctagaccatgtgggttccgttcccagctctgccactgaccagctctgtgatcccagcaaactaactctgagatgccttggattttccaccagaaaacggggaaaatgccagtgccccctgcacagggctctcgtgaaaatgtggggagatggtgcatggaagatgcctagacagccagcccttggcacataggagctgtgagaggggctcctaggtcaaggagtgtctgcatttcagatggggaatggcctttctgaggtcacacgcgatttagtacagggccaggatatcttcctacctctttctaccggttaggctcttgttggtaaaagctccagaacagggctgcagatggaaggtcccagagaaggaagaggtgaggtagggggctccctcatttccctcctgtaccctcccccgccaccacctgctctgctcacaaagctgcattgctgcctcttaccctccccgggcccttggagctcctcccacccatggcccttctcattcccacctctcaaggggacatgggcctggcaggccatggctaatgccaaactcacagggacataaccaggtggcccaaggcagtgagcctgagcgcagggctgggccctcccttgctgcctctcatttggtttagttttccggcccatagtcgtcacactgacgccaayattccttccgggatgactccagctgttgggtcctgagcacagccctggcagagtgtgaagtgtgttctagacctcagcatgtccttgaaccctcactgctgtcccacaggctggtgctgggatctgcccacaccctgcagctggaagggatgggtctcctctccaggagtagggccgagggcgtggccttggagtccgaccctggttttaccccagctgggagactgtggctacttgcttggcctccctggacaccagtggccctctctgtaggggacaggtggttggatgagatgcctgctgaggtccagcccagcctgacatctgtggctgtggccagcagcatctccatggtgctggggaggtgtgagcggtatcttgaaggtggctttaagtttgggaagttcgggaagagcagtaaaggcacgatactgggactgagcccagtaggagtctgggaggcaggtcgggctggagaagcagggctgggcccgcggtgggctcagctgccctcagtaatagcgacagtcagaccatgagcagcgaggacagtgaccaccatggctgctatttccggagtgcctggtgtctgctggtcatgatatatatgatttccagtgctcacaactccagatggttggcgttccttcccccattttctacatgaggccacaggctcagagagggtaagcacttggctccgtgtcacatagtgagttggagactgaggtgggatctgcccgggcccttctagcagatcagaggggattgttctgagggtagcgggggatctgcaaccctggagctgctccctgtgtcccatggggagctctcatgcccagggggtgttggcaaacagagctgggtgctaaataagcccccacttagcgtcaactggaaattgcggttctgcagtcggtgccagttcttaatgtcacttatcccaagcgggctttcaattttcagcgacagcagtcttctaatttggtctccgccactctggttttgtgacgggaacaatggcagtggcagatggggagcaacgactccattttcttgtaacgtccccagtcgcaggcagggaaggcaccatctggaaggagaaggtcagatcattaaaaaaaatacgtatgaataaattgccaggacttgatgggctatgggtgttcggggaggaaagagaggagctgagctctgggcgccctggtgacaggggctagggtggggagatgctcgctcacccagctcctacaggttgtggggtgaggaattgggggtccagaccagagctcttggctggtagaggtgagggtctgcttgattgtaagttccttgagagcagggacaagctctcaaatctggcctatctttatttgctgcccaggggcttgtccaagaggcagcatggcgagcgctggcacactagcagaggctaggagagccgtgctgccccgggacaaggtgcgtcgcaggcaccgtgcaaggcgcccccgtgggttagttccttggcatctggatcttcccctgctttcccctttcctctgctggccagcgtggagtgcggrtagaaggacgtatctcccgtgatggctgtgaggatgcagtgaggcagtgtggaaactgtgaggtgcagggcacrtagaagtgtctgttatggcaacgcgcgtgccctgtgtggtcgtgccctttccctgagggtctcttatgtaggcctttcctccctggtggcagggatcaggtcttacatgactctgtttccagggcccagcagggtagaggaccagacatggaggatgcctctgggcccatttcgggaatgagttcactgctcagtgactcaggccggagggtgtgagcccgccgggtgctggcgccttcacatcatcaagcctgacatttgggaatgtctttcacttctcaaatagcatcctcacctgccacctcattccagctcctcttgctgtgccagcattcaggtgccacctctctcgggcagtgacggcatgagggctgctctcagggtggtccttcctcactcatgtccagcccttctctctgacccggcaggatctctttgatgaaagcgagtcagattaacgttcatgtcgtgggtacatctgacaaacctggaaaatgaggctctgagaaaagagactttttgttcatatccctaaatgtagtgatggtctgtggtgggtccagccctgcgtgggtgggttgggtgaggtgtagaaggaaatagggtgggaggtttcggccttcatagaacactggcatggtgggggagcgcctacctccatgtgcacacacacgcacgcgtgcacacgtgcacatgtgcacacaacgaagaagagccacactggtggaggagcagggagtagctgtgagaggtgtgataccctccaatgggctgagacgacagrtggtggaggccagggcatggagacatgggtggtgcaggcctctctgagaaggagaggagccagccctggggaggtgaggggcagcgttccggacagcgggaacctctgggcccgtcccggcgaggttgctgagcacagtccagcacggtggagccagtggccgagggaggaggctggggagggaagggaccttcgcagctcttccaggagagtttggatcttattctgggctgactgggactccactgatgtttccaagcaggggaacggcgaggccaggtgtaagttttagcaggatgggcctggctgccgagcaaagatgactgtagtgtcagggggccccagtgtggctggcgggaactctccggctgacctggcgcctcctaggggaggggcaggctccggctgcctgcgacagagctactctagcatcaccgtgcccacaggcctctgcgatggagcatcagcgggcgcggttgctgaaggctgcctggtttagtccagagaattcagtcttgggtgtcagatctaggcctgaatctgggtgctgccccctagccatggctgtggcctggccacgttactaaatccctgagtgccagtgtcatcctctgtggagtgaaaataatgattctggctgtgctcagcgattgtgaagactaagccagggcatagacggcggcgctcagtgtggtgcctgatgtgtgggtgcatagtaggtggtgtcttcatcacgctcatccctgctgtgggcttgctggaagggagtcctcatagggagtgtaaagaaggaagggatcctccgcagggagaattcttcaggacagacggtggtttattcctccctccttccttttattcattctttccagccatgttttccgagcactcgctatgtgccttgcagtgtgctgggtgtcaggggacagtggtgaatgagacagtgcagacccccactgactacagctttgatattagagacttatggaaatggaccacggatgattttagatcattatgaaggctgcgaggaaagtaagacagggtctttagagtgattcctgagagaaggggccactgtagtcagggtggtcagggaggacttctcggaggaggggacatgtgagcagagccccgagccatgtaaaggagcctccacagagaacgaggtttagcagatgctctttagcatggtgacctcccgtggtgagtcctgggtctggggtcgggttaggcatctgtacttgtaacgggtccctgggagctttgaggcccagctagggtgggtgaactggaggcaggcggcttcctaatttcagggttgtcttgaaggaagcaggagtgtgattcttctgcatttccatcaccaccatggtcaagtgtgagtgccgcaatggcgacctcctgtcctctgatcgttcatggtctgtctcctactctgcaacagaaattcaaggcaacaggggtctggactctgttcagcatcttaacattttttaaaaacccttttacatctattatttcatttggtcctcacaacaaccacaggacgaaggcatttctagcattcctattttctaggcaaagaaattgaggctcagagagttggggtgactggcacagggttgttcagcggtagggtggtcaagctgggaccttgtttttcaactccctgcctgagaccctggccacggcatcactcctgaggctggatttcatctcagtccggcaggagtagggtggggagtgactggatggggccaggcttctggggcctgcagtggctccctggggcttggagggctcctcatggcccagttggtccttggactctgaccagctctacccacctccttcctcttgctgtaggggaggagaaccagccaggctggctatgcccggatgaggacaagaagagcaaagccccattctggtgcccgatcctggcctgctgcatccctgccttctcctcccgggcactcagcctgcaggtgagtggagcggatcttgctgagccgacctcgaaggtggctgcggctccccctcgcctgggagaaccagagtttccagggagcgcccacagcagggaaggctcaggttccagctgtggcttctaaattcttactgacagatttggtcaagcctttttgttgcttcgggaatcagctttcccaccacaaaaatggaggcgaacgaccactgtgggtcaagtgaatggaaaattccattattttgagataataaacagcaatgatctcatctgttgatggcatggctccagatcatgccgaagcggctgtgccagccactgtgggttgggtgctttgtggttcgccaggcgggagccggctttggcgcagggwttgccctcatcatggaatgctccagcgccatcaggcctcccgtgtattgagcacctgctgtgccccctggttctttcctgctattctcttattttaatatctataagaaccttgcgagtagatgtttctctatccatttcacagataaggaaactaaggctaagacaggtgctatgattttccaaaaaggacatagctagtaagaatttgaaccttgccctgcctgatcacaacacccagggtcttaaccatgaggatgttcagccttcacgggttacctgcccttataccctgtcctagctcgccctccatctagagcaattactgcctcccctttcccagggagatgaggtcatctcagctccagggataggagcaccagttggggacccaggcccagattggtgagccccaagagatgcgccgattgggctgtagactggggatctaaacagctgaaagaacaaatccttgagatatgagttcatttgttcacttgtccattctgcatgcaattttctgagcacctgttgtgtgctagaccctgggaatacagtggtgactaagacatagaaggtcccaacccttatgtagctttgaatcctagcagggagagagagaggcaaaaccccagcaagccaaaggaaatagaaaagagtgaggtgtgtaataaagacatcggggccacagtagatacgtgggtgggctgaggttcagagatggcctcttggaggaggtggcatttaaactgagaactgaatggcgagaaggattcagcccagggatgggaacaatattcccagtagacaaacccacacagagggtgcagcagaaacagtgggggaagccaggcgaggcaggaggagagagggcgggccccgaggttcgctggtgggtgagctggaccacgccagccttgcaggctgggtcagctttggattttgttctcagagcagtaaaaagccttggaaacagatgtttcccaagctagggactagcacaatttgatatatagttygcattttttggatccttctggctggtgtgtgagagtgaattgcagataagaatggataccgggactgagcgtggtggctcatgcctgtaatcccagcactttgggaggctgaggtgggaggktcacttgagtccaggagttcgagaccagcctgggcaacatagtaagatccccatctctacaaaataaaaataaaaaaaaattagccaggtgtgccatgagcctatagtcccagctacttgggaggctgaggtgggaggatcgcttgagcccaggaggttgaggctgcagtgagctgtgattgtaccactgcactccagcctaggggacagagtgagaccctgtctcaaataaataagtaaataatacaaaaggactggatgtcggctgggtgaggtagctcacgtctgtaatcccaggattttgggaggccaaggcaggtggatcacttgaggtcaggagtttgagaccagcctggccaacatggtgaaaccctgtctctaccaaaaatacaaaaattagctgagcttgatggtgcacacctgtagtcctagctactggagaggctgaggtggaaaaaacacttgaacccgggaagcggaggttgcagtgagccgaaatcatgccactgcattccagcctgggtgacagagtaagaccctgtctcaaaaaaaaaaaaaaaaaaaaaaatggacctggagggagcagctcagagctcagctcagggtcctgctgagacgtggcaagacttgatgtgggcggaggccagggctgtgactggagtaaggcgcctttgcctcaggcacaaaatttcagcygatgtcaaaaatctcaataattaagataaatactattttaatgcagtgcgtaaatataatcaaatcagcaaatttttccttgtggtttggccgctctttttgtctcttgatacataaagggccaggattagggtgaggcaagtgagccagggtcgtgcaagtgtagggtgaagttttgtctgtatttaaacttttaaataactattcagtgtggattttttgcattaatattgatttttttaaagttgccttactctctctctmtatatatacatttttgtgactgagtttttggtgcccttttaaattttgtacccaagctaggtgccccagtctatcaccctagtcctggccctggtggaggccgtcggcaagggaggtggacacattggggatgtgttggggtgggacaggcttaactggtgatagatggcgtatgccagatggggggttacctgtgggccctggggccttgggctggaggcagcgaccatggagtagggagtatcagggcccactgtgcctgcggccagcttggccttagcgcatccctgcagaaggctggccctgggtgactttatggtgggcgttggattctcctgtctcccccagggccttgggtctcttgagagcacaggatgcaggctgagccctgacagatcagaccccagtggtggagtcacagaactggccaytgcctccaaggcctccccaaaagaaacccccatccaggtggggagcctctgccacctcgaacctggggaaccagggcccacgaacctcctcagtgmgagctctcagggcccasgaatatgtaggccagaagcatcctcagtcctgctggccccggctcactgtctccttaggagcgccagggctagtggagggaggcgagtgactctctgtggtaaggggcctgtggagctcccagaagccagagcagagcctgcctggctgcactagctaggcctcaaatcgctgtccccctctgcccacaccctaccccaccccaccaccagtccagacaaatgtgccccatcagctgtgtgctggcagcctgatgaaatagggcctgggagtaccaaggccctgtccaattactgcagaagcagatgtgactgtgtgaacctctgcccaggcccccttccagctcaccacgtttccaggtggtcctggggcagggggtgactccagctctggctggcctcatggcgagcagtggcccagactatttgtctagggagggcttgggctgggcagagggasttgctggccacagtgtagacagggtcggcactctgtaccagtggatgaggatgtgttggrttctttccttcaagggatcaggggtgttggggcaggaggcaggagtaggtctcttgtctgtgctgacagtggcccctgcccacgctgggccacaccaaggccttctgactcaagggaatcagttgggagtgtgaaggagcatcagcaggggccacctgccttggattgagtcccaacagtgtgacatcaggaatgctgcctcagctcatggtatcttaaactagggtggtcacagcaccttcctgactgggtcaccttgaggattaaaggatatgatttgggtcaagtgcttagccagttgcatggggtgcgctcaggggtcaagaaacagaagcaaacacctgaggacaccctggtccccaggaaggtgaggacaccggagtctattctgtggcatttctgaacgcctgactrctacggtgtcgaaggttcttcttggacccctggctccatccaagggggaatgctgtctctggaggggtggcaggagggcagggagggttcagcgcaaacccatttccctgatggtcagtctcagagcccacctggggacagggccttggggatggggctgggggtgctgcctgctctgagatgctttaaaactcgagcaccttgggagcctaaggggtgtagcccagacccacagggggtctgtggccaggcttgcttaggccaaagctcacaagctcattgggctgtgtcttgaccttcaccaacctcagccagaactgctgttggccgtgtaccctgtctcctgctcatccttgatggctctgccctcatagccttgctctgatgatgaaatgagctaaggtgtgtgaagtgctagaatatcccatgagaggcccttggtaagccttagtagctgcagggtactgggtacctggccctgggccgggtgctttacactttccctctccagtccccacggccatcctgagagatttcagggtctctgctctgtaggtgaggacctgatttgttcagtaccatccagatggtaaccactgagctggggctggagccgtgttggctgtacctaaagctgcttcccttcacagcttcgtgctcccctcctctcttctgcatagggtgccttgacttcccagtttcctggcacaggcaagacatttaggggctagggccttgcctgtgaaggagaggagccatttgagtattttccaccatcttcgacccggctctgttgactcagctgacatcagggcccactggagttgccatggaaatgcctcagcaggggctgccgtggcctcgtctccaccaagggagcagagagagcatcagcccagcagaaagggcatgcaccctcaactagatgctgccaccaggaagcagagaagacagggagcccagaggccgggcttagcgaagccccctgctctgaatgtgaggacacactttttcagcaggcagaactggggccccagagtgccaaggcctctggtgtgcagccaggcttctggggtaaaattcaaccagaatagaaagagccctgaaccagatgttgaaggtttgaattctagccctcactctgccactaacatgctgtgtgacattgagccaggcacgcctccctctgaccttcaagttggcatctgcgcaatgaggaggctggatgaggtgacctcttagggccctcgcccatggccattagaaattttgttagaatattctaacaatgggtccagggacggctggggccttyagcaccagcagagggcagcagctgcctggaaaagggcccagtggtcggctgcatcctccttccagccaagagcagtctctactctgtcttctccttcagtgtggcccatgagtgggccaggccatttcctagaattgctgtcctggccagagagagggactgaccaggtctagctcaggagacaggcctcagagagaggccacccaacatggggtctgtggcagctgattcaggggggagcaggcggaaggtggttactggtgacagcggtgacaggctgagccctggtttctgtgcgtggccctcacaagccgcccagccctgccactcacctcctctgtggtctagggtagtcacctgccctctgtgaccctcatttccctgtttgtaaaataaggaggggtgggtggctttcaagaaatcttatctgaaagctgctcactttcagagaccctgggctgatacagagcctcttgcaggcctcttctagccggaaggttctaggaaaggaagaacaaatgtragcgtgtaggaactgcctggagaagcaggcactcgtgaagcatgttgctttcctggcccccacccacagggattctaatccagggagagttggatggggcccaggaatctgccaaatattggcatctgggcaccttgatgattaacctcacatgtaccgtctctgtctctgcagcttggggccctggtccacagtcctgtcaactgtcccctgctgggtttctcagcmgtcagcacctcccttccacagggctacctctgggtgagtcacccccctgcccagctgggcattctggcctcaggacaggagtagggagagcggcacctgggagrgggtgctggagacagcagctgcctgcctcatctcatgcagcttcatccaccaaggtcttcctgggcacctctggtgccaggcactgcatttggagttgggaggtgcaacctcatctggggcaacagaaaaccagggagctaawaagagagtgtgccttttgcaaatggtgacagggctgagaaggaagtgaaagggggagctgtgcagaggacctgggtctcaggatcttcacccctggagtcaggaggcagggctggctagtgccctactcatgcagacattccagcccacctttctatccttgggcttcctggcaaagcctcccttgattcaagtgaggtaccctccactatgttccttgtgctgcaaattgtgccctgtcattgctgcttcccttctgagagtgatttgttcctcatcatttcccatgatctagcacatggtatatccatccatccatcatccatccatctatccacccacctatccatctatccatccacccacccacctacctatccatttatccatccaacaagaatatatatttaatccatccatttatttatctgtccatccatccacccacccacccatccattcattcaccgatacatccttccrtctatctgtctatcatctgtccatccatccatccatccatccatccatccatccatccatctatccatccatccatccaacaagaatatattgagtatgtatctatcatatgctagacacagaggtaaaacaatggtcaacacagagaagggcattttaaagggatggagtagatgtttactttatattggttgaaatgcaccctgcagaggaggaaatagaaagctgactgagtatttagtccaccttagctccttacctgatttcctgtgggccctgaagcttatttgttgccatggcagctggggataaatgacctttgtgaaggcaggatgtgtgtgggcaggagaagggatgcttctctcaggggatggggtccttgggaaagcaggggctgaggtcctcctctgctccctcctgtggttcccacctgatggcctctctgggtctctgctcccaggtcgggggcggacaggaaggcgcagggggccaggtggaaatcttttccttgaaccggccctcgccccgcacygtcaagtccttcccactggcagcccctgtgctctgcatggagtatatcccggagctggaggaggaggcggagagcagagacgagagcccgacagttgctgacccctcggccacrgtgcatccaaccatctgcctcgggctccaggatggcaggtgaggggcccggaaggaggggtgagagcagcctctgcagggctgggcagtgggtgggggctgtccctgtagccttccggatctgcctgttgcccaccaacattctctgcccctggtctccaggaaggtgggcaccagagctgcccagtgtgggagccaaagtgtcgggagcggcctgcagtgcagttgcctggctcctcccaggcagaatggctggctcttttgcctccctgagtcctcttcgtgacagaggtgtcagggagggtaccgtcccagaaaaccatggaaaagtgagctcccgcatggtggagctatggcctggccacacagccgaaaggcgtggctgagaggggtcagctccctggggccctctccctaggagggcatgggggcagtgagtgggtgggagtgctcagtgtgtcatgaccgcttctccaacctctccccgcagcatcctcctctacagcagtgtggacactggcacccagtgcctggtgagctgcagragcccaggtctgcagcctgtgctctgcctgcgacacagccccttccacctgctcgctggcctgcaggatgggacccttgctgcttaccctcggaccagcggtgaggactggggggaatgggggaaggggggcagtcctggatgccagctgggtgccagattctctaccaagagaggatacaggaggctgggcaggaatgaattgggaaatctcagtgctgagggcatttggagatccgtgagccccgctggggttcaatgggtggtcccccatatgtgaatacctgctggaatagggtgctcactaccatgtgggcagtggaacctgttgacaggagactgtagtggataagagaggtactcgcaggttggagagacctggcttcccgttcaggctttgcccgatgacagctgtatcccttgttgcgtggcctcccttctttggtgcctgggactcttcatgagaataagggcagtgcccaccactcatgggtcctggagggttagacaactccatgagggcaaagcacagggccaggccaagggctcagtggagtcaagtatttccatctgggttsttttattgagccatccctagcacaggttacgatgtcaggagggcaggagggcagggctaaccgtgtttggactgctgtgctccagggcaggggtaaagtgcttaatgcrtgtgtgttatcttaattctcatgcaccccttgagaatttcctttgctttactgagatgatgctgactggagaccagacgcaccttctccccagccatgtggagtgctgtggtccccatcctctgggcttgttcagccccgatttgatgaagggggctgagtagagagtgtagccagcccccagtcccctggaaggrgcagaggagcctgaagggcccgcagcgtctcttctcccctgccttttccgccagccaggctgtgattgccgcgtcatcacagcctgttacagggttataaacggatatttgtactgagctaatttttttttttttgccacttggcactgtgttggtatttttaattagcttttgataaggcatttatagtttttaattaaagggggaagagggagggaaaaaacccttctcaccgtcagacagagcgtgcatgtgaatgtaaatatgggctcagatctgcggagactcatggggagttctagagcgaccactcccaaccggctcccayggaacactgtgagcccggcctgtgccaccctggcgctctggtccccagcttgggttggctttggcccattccctcttactgctcgattcaccagtttgggcacctgggttggaaggaggtgaggctgccctgacaaggaccacaaatggcagacwtgtagcgtcgcatatcctagaggctggaagcctggggtccgtgtttggatgggtcatgtgccctcagaaggcactagggaagggccttactcccagctgcttcaggtgtttccttgcctgtggcagcagaactccagcctctgcatggtgttttccctggctgtgtgtctgtgtgcaaatttcacttttttatgaggacacaagtcatattggattagggacctgtccctctccagtatgaactcatcttaactaattacatctgcaatgaccttacttcccaaggaggtcatattctgaggtactgggggctgggacctcaacatacagatgaggaggcacagtttaccccaaaacatggggtttggggtccacccattggcttctagtstggggttggagcctgttagtcaggaccaaaagagccactgggaccattgaaccccacgccctcattttctggatgggagcagactgtccagagccccctgactgagctgaacctgcacccagtaccctgcctcccaggctgagctctctgcagatgtgagggggctttggcttgtccaggtagagtggaggacatggggtctgaaggctgagatgttctaccagctttcctgccttgcaaacatgtgtgyaccaaacgcttactgagcacgtactatatgccatggacacagtggtgagcaaaatggacaggccgcctgctctcatggagcttacagtctatagagggagagggaatcggttagtaaacaagcagaagtataagactgtacatgatgccgagggctccgacggaaaggaaagagtgttgtgtgagagcctcactgcccaagtgtggggcaagctgtgctgcaaaggcctccctgaggagggggatcctggggctgagatcttaagaagccaggcaagtggagagttgggggaatggtgttcttggtagagggaacagtatacgcaaaggcccagaggcaggagaatgcttgatttggtgggggaacccggagaggaagccattttgctggacagctggaagaggaagtggcactgggcgtgacccgggggcagacagagctgtttgcgagggctccaacttgtctcagtgtgtcagggagtagagaggcatgttagaggtggccaagcactgggttccctctggctggtagacaggaggggaggcaggttggctggctgggaggctgaggcaccacctgggcaggtgaatttggtggtcacgctctcccagtgaacctactctctgggtgtccagtttggctgtggccaaggaggcccctgagaaggggcttgccttacctggtctccccacccgtacccagtggtatctttcagaggtggcccaagcaggcagctgtgttctcaggacctgctacatggtatgtggtgggcaggattcacccccatcaccttccacctggattacatgcggccaggtcttgaatcatccacctggtccgtgaccagctgtgggactggcatcagcttggccctcatccagattcactgaggccttagatacccctcagatacccccacccatcccagcagcagagycagggcttggaactgcacccgcatcaacctcgcaggctctgtatcaacctcagaacccaccatagtggccctggtggtgtggagggtccagggattgtgaaaatctagacccctcatcttcgtctagaagcaggtactccatgaaatatttgctggtgtttgaagtgacatgttcactgtcctgccgggttaggctgagaccaagactggcattcctgctaaaactggcattcctggccatgctttggcttattggagaaggacaggaccagacacatataggtctgtaggacagaacccacagaaccagcagctgagagtagactgtccaggctccagggtgaccaggccacgtggaggaatggactggcagagctggagtggcctcagagtcccacctgcagctgagagacagggaaactgaggccaagagcaatgtggccatggcagtcactctgctgtcctcaggagcatctgcttgttctcattcattcattcactccttcatttgctcaagaagccagtgcccctgaggtgtcaggcatgcagcagggtgctggggcccggagctgagacagccggccactgtccttgctggcgtgctacctgggttctcccctgcctctgagaaggcacaagggcattgccacgccttgggtggggatgcgggactatccctggttgggcgctggggctgtggttcggagtccccccttgaggaggcagatggcataatgggtaagggatgggttgggcatcaggctgccgggattgagtcctcactgtgagagcttgggcctttcctttgcccctctaatcctcagtttcctcacccgtgaaatgrgggtgtggacagccccacttcatagaatggttgtgaagggtagacatggcaattcccacgagtgccgcgacacagcctggaggattggcacctcccacgtgtccctttatcacagtcatcatcatcacagtcgctatttactgtcaccaggcaggggctgccctttgggcccctctcagccgtgatgactttcactctgggacctgctctctggctccagcccaatctcgacccctgagggagacccaggggctttctccactgctggctgggggaggagggatgccagcctcctgaaggtgcctttgctgagacagggccttcatctccctggcgctggccacaagagctggtgccaggcccagaagaatgggctgtcatacaggggcaggcttgtgcgtgtgggtctgttttccagaatatgtgcgtgctttcccacagccactggagggtaaggtgaggagggggtggaaagggcggggctcccatcaggcaggggcggctctcaccagagctcacagcaattgggtttaggatctcagaatcacagtgtgtgagagctggaaataatctcagaggacagagttttgtcctcatggtgcagataggaaaactgagtcccagcaaggggaagtctcttgttcaggatcccaccatgggccctctactcagggactcctgtccagtgtcccttatgagcttttttctgagacagagtttcactctgtcacccaggctggagtgcagtggcactccactgcaaccttggcctcccgggttcaagtgattctcctgcctcagcctcccgagtagctgggattacaggcgcacaccaccacacccagctaatttttgtatttttaatagagaaggggtttcaccatgttggctaggctggtctcgaactcccaacctcaggtgatccggccgccccggcctcccaaagtgttgggattacaggcgtgagccaccgtacccggcctttatgagttttttgatctatcagtattagcattattaaatttgatcacagttcatcattctgccctggagtcgacttcttagaggatttctggagactcccagcaaatgcaggaatggcattcatgcagtccttagggttttagaccctagctcctaccctaggcttccacagcgaggctctgttccaggggagtggatgcaagggctccggtggctatcactgttggatagagccccactttccagttttgggggggtgttttctcagcatccctagctgctttttccctgggaggggtcccagcccccatctcagccatagcagcctaattagactccagcttccagccacgaacactactcacctctggccactggggggcgctcaaagccttgcattttcttggctccagcctcctgctgtggaccagcatccctggcggagccctggccgccttcgggtcactcgcccctcctggacaccaggcccagctgcagaggccttcagaaacctgagagggcagtggggttggagaagcaggccaggcccagagtcagacagagccgagttcaaaacccgtctggcctgtcaccccttgggtgtctttgtgcaaggccttagctccatgggtcgccgttgtcacgttggttaagtgaagtcaacacttgcttccacacactgttgtgttgtggcaaatggcatcaaacagtaagagccacggacacagactcctctgtagctgagtgaattggggtagttatttaaactcrctgtgtctcggttgtctccgttatgaacagggataataatagtatctaccacacatkcttgttgggagttaaggaaataattcaaggaaggagggcctggtgtgcggacacagaacgctgcgtaacaaccgctgtcaagaccctgactgtgtgcccagataaatattcttgcatattgtattgactccctgcaacatccggagaagggcaggcgtggttatcatgcccagtgtgcagataagggaaactraggtccagagaggcgaagcccccgtccaagttcacacagaagttctgaggccgaggactgccctgctctgcctgcttcccttggtgctcacgctggctggccgggcagagcgctctgtgtgcctggaggtcgaggggagtccctgttcccctgcttctttgcggagcttggattctgcccattttaagtagggcataagggcagaaggggaacctgttttatagatgggaaagaggtggggagggagggaaaactgggcctggcagagcatggggtaggccagggtatggtagggaaggatggggagggrgtgggagtctagtttggctcttgtgaccacaccccagcagtggcttccatcacgtaccctggggcccttccggctttggagacagctgtgccccatcgtgccaccaagcagctggctcagaggggaagggtctgcctgtgatgggctgctctgtactcttaccagggacccagtggagggcaggtggggtagcagggctctgacaagctcacagctagctgtgtcctgccttctagtcccccgccactgctgcctgtctctccagagcatgccatggcccaggctgctccaggctgggacccagcttcctcttcaacccccctttcccacctggcaccctgacaagacagggcagccaccggggttctgtgtggcatcaggtgtgacttctgagaagaaacaatcttggcgcgcgccgcttggatgccggagaaaatggttcttgggtgcgctgatcatcccaggggaggggaggaccttgcttgggccaggctcctaggtctgtttggttttcagggatggccgactggggattcattgcctctcagaacatcctctgtatcaggcacggtggctcatgcctgtaatcccagaactttgggaggccgaggtgggtggatcacttgaggtcaggagttcaagaccagcctggccaacatggcaaaaccccgtgtctactaaaaatacaaaaaattaactgggtgtggtggcgggcgcctataatctcagctacttcggaggctgaggcaagagaatcgctggaacccggggaggcagaggttgcagtgagccaagactatgccactgcaatccagcctgggagacagagtgagattctgtctcaaagaaaaaaaaaaaaacaaaaaaaaaccaccctccacctcacctggcagcagtggtgtttctggaagagaaagagatcttggtaaatttgacagaagtgccttggagtcggccagaagattcatgagaaatcaagattcagtctagataagctacagcatcagaaaagtcctcagagacaatcttgtcagctccccaccccattttacagatggggaaactgaggcctcgtgaagggtagagatgtgctcaaggtccttagcaagttagtagtagcagaaccagggccagaccccaagtctcccgattccgggtccaggacactttccaccatatcatgctgcctcttctgagaagcctccctggatttcccctggtgcagagttagttccttccatctcagcagttctcaaggcccttgtgcacrcctgctcatttgtgcttggcgtgtcatgtgataactgttgattaacctgttggttgctctgaccagtggggcttcctagagggygagacctgtgtctgattcctttctgtcttcccagcacccagtgcatggcatgggtggagtaggtgcttactgcatgtgtgcggaatgaatgaatgggagagagggaaagagagagagaggcagggaagggaagggggaaagagaatggagggaggaaggaagggacgaatctgagagtaggggtggctgggtgtgggacatgaatggtgggagtcggaggcagatggggacagccaccacccagctgatggagagagaaaggccctggagagcggggagagggtgtggggggccctgctgagccccctgctgctggcctgcgttcccaggagacctgcttgccgctcctggcccctgacctgcctcccctctctccctgcaggaggtgtcctgtgggacctggagagccctcccgtgtgcctgactgtggggcccgggcctgtccgcaccctgttgagcctggaggatgccgtgtgggccagctgtgggccccgggtcactgtcctggaagccaccaccctgcagcctcaggtactgcactatcctttggcttgtggccctggaggcctgccttccttttgctgaccctttcttatgtccaccccggcaccgctttcagctcccagtggcattccarggatcgattgggcagagtttgtccggaagcagagggggcccaaggtccctattgggcctgacctcttcctctgccacacatcgccaaggctaccaagaacagaaagtgcccagctgcactgcactgtggcctggatcctgagttgtgtcggttgctgcctgtggaagtgggattggggtccctgtccttggactggtacccaggacttgtacccacagagcccgggcaatgctgagggtgtggccagggtggatgcagccatccgctgggctcttcaaaccacatggagggagaggctgcctgggtcctgccttgccctggttccagcactgcccatgccttggcccccaggatgagggactggtctggggggctcrtccctggctcagcctaggcccgtgcctgtctctgaccaatagcactgcccgctcaccttcacacctgcagtccatcctgggcgggagactcagcatggttccccaagaggtattttggtgatatttgatttgtttggattatcgattgcaatgagtcgccacctggcctggagtggagctctcccagggcgctccctcatgaggggcagtcttcattcgcctgcctagttctctctcatgcagctgtaaatcagctgctcaacagcctggcagagacactaagtggagtcctgggatcttaagagcacagatgatcagggctgggctccagatgacacaactctcatttgacaaagggggaaactgaggcacggggccttatggatgagctctgagactgggggctgagtctgggggatgtggtccgcccctttccctggcttgcttttctggtgttgtagcagcacagaggtgttgtcgttggagccggacctaccagaccgtctttcagttctgccacttacatctgggcgcctctgtgctggctcccgtgggagcacgaggcttccagtctgtaatgggaataagtgtcccgttcctggaatccttttccttactgtatcagtcagggttgtccagaggaacagaaccaatggaacgtatgtgagtgtgtgtttgcgcaagtatatgtatacacacgtatatagaaagagacttattataaagagtcggctcatggggtgatggaggctgtgaagccccagcatctgtggacagcaagctggagacccaggcgagctgccggcatagttcagtgtgaatacggaggcctgggaacctgtgagccggtggtgtgccttccagttcaaaagctgggagacctgagaccccaaaagagctgatgcttcagtgtgattctgaaggcaggaaagaaccagtggaaggtagtcaggcagggagcgaattctcccctcccagccttttccattcaggcttcagcagattgggtgaggcccacccacactgggaaggccatgtgcatgactaarcctaccattcagatgctaatctcatctggagacaccctcacagacacactcagagccacgtttaaccaaatatctgggctcctcgtggctcagtcaagttgacacataaaattaaccatctctcatggagtgagatgatgcttggaagccatggtacctggccagttgccagcccaggagataattgatcagcagctcttcctgggtgctgggaaggggaggtggagttacccagcccagctccttagacagaagggagaggcagtgccatgtgcaggaccagtgggtgagcttttgctcttttgaggagcaggggcctgggggctgatggtgactcttgggctgggcacccttcatgggcagcatgagctccaacctcatctcctggactcatgccaggacctggcagtgaggacctttaacctcactggtgctactgggctgggccaagggacagtgagacaccaacaggagggaaactcctgccttagcactccyggttcctcggtcccctttctcccccaagaacagctggagcaactgcagctgcagactcccttcccagcccctggttcatgctgggggcttccctgctatccccccagcccacctcacctcatcccttcccagcccctggttcatgctgggggcttcctgctctaccccaagcccaccccaccccctcccttcccagcccctggttcacgctgggggcttccctgctatcaccccagcccaccccaccccatctctttcctccaagggccttgcacttccttggccttctgagaggaaggtgagcgaggagcactagctttcccaggccctttcgggtcctctgacccatctgggtctcaagccaggaaggacatgtctgaccccttggcctgcctctcccagtagcccccaagtgtctgagcactgtcctcacagcaggtctgactgctctgcaagcggtctcctgcagaccccctagcacagcgtctgactcagcccaggagtatactggtggacaggtgctcggcctgtaggcctagtgtgctgggcgcccattcagggcagtggtgtgaggaggaaaggaggcccagcctgctctgggggtctccaatctgctgggggagacccagcccttggggcaaccttcagtctgatgtggaagacacagcctgtctttggaggtgggggcttcagtctgtggagagagacacagcctgcccttggagggcctccagtctaacggaggaggcacagcctgccctttgagggcctctagtctgatgagggagacccagtccctgttctcaatattggggggagtggggcccgagacaggaagaagccgagaacagagaaagaatgggatgggagggtgcaggccctcagccccctgttggtcagaggacattctctcagtgctgccagtaggagaattggggcacaccaggtaggaggcagctcaggaaacaggaggcagggtaaactgagaggggtttccaaggaagaatcttttaatgaaagggtctggagggaggggaagccagaaattacaggcaggggcctgcgagagcagagaagtggctgccggctgctggcaggggaggtgtgagtggcrcggccccagggcacagagctgcccctgtgagctgggcctgtggggctcctcccaggctcttcaggcagctcaggagcacttgagacttcaggagtgggtaggactggggaggcgtcattgaagacagcagcccttgcctgtgtcccggccacttccaactccgggcagctggcaccctacccccttggaggtgtgcagttggagagcaggctgcttcagacgggaccgtagctgtgcccctgccaagctatgcaaccttgcataagtcatggagccttcctgggcctcagttacttcatctgtaaaatggaatgaaaacagtaccagtggggagttagcaggaggacaaaccgagaacattcaagcgaaagggccgtttcacacggtcttggcacgtggcgagggcagggtgaacattatttgctgtcattgtaataatttacctatcttaaatccgcattgctgtatatgtcgtttatttggaaaatcaagctgctcccggggtcggtgttgtcagtgggtgtggggcatcgagcccacactgcaggtctgccatcctctcgcctcactggaagacagccttcctcctgccgacagctgtccaggagcatgggayggatggccaagggaaggacaggggcccgggtcaggccctgcctggctctcacctgttcttgccccttgccagccgtagtgcagtcaactcccagcccacagagctcagctctggcgtgaccatccctggggccccaatggccaccaggctacagcacgaggctgtgatgatttaagattagttctggaccagctgctgtaaagaaggggatcaatatggcctttcacctgctttgcacacctcgggggcatcaggagggctgttggctggagggaggcgagatggaggaaggggtggccagggagcctctgcagcaggggccagagggagcacacgcccccatgtgcagccagggaaatggaaaagtttctgttcgctgcgcggtgcgggcagcttgccttcagtacacacaaccattcggcacagtaacaaggtgatcgctatgcgtatttaataagccatgctcctgctgcttggaatacaggggaagccggctccaccttggcgctggagatctggaaatggctccgtctggttgctgctaacgactgcttgacctgctcctgggctgcccggctccacgctcaccacagtggccactgcatggccagccaggcctgggggagccgcctggagccggggctgctgctgctctctcactggctgtggtctcgtatgtgtgcctagggctcagcatctgtgggctgtgcctcgcgtgtgatgtctgcagcagaatgcctgccttcagaggaagggcattccttgctggcagccatgtggcagaatctgccccaggcttgagaaaaccccctatggggtttgagattcttagagccgttcaatgctccaagccaggagacccaggcatgtgctttggctgaggttgtggctagcatggcccaggaccaaatgtgaaaacacaggggcttaatctaggactgtgttacctctaaggggctttttctgactcctcccaccctcrggaagtaaaccaatgtatactgagcgattcctttggaccagaaatgagttttgcgctttacctataggatctcatttaatcctcaaatcacgctttgagatgaatacgattattcccactttacagatgaggaaacagaggcacagagaggttaagtaacttgcccaaggtcacacagctagaagaggcagggttgggatttgaacacaggcattctgagtcttaacccctgtgcttaacccacccaccttggtgggcagaagtctcagtttccttggggtgcctgggccccccaaagctttctgtctgcgtcagatgtaactcccaggagctcctcttgtttccatgagcacgccttccgggccgaggactgtgttgtgttcatctttgtttccacagtgcctggatcactggcatctagcaggggctcccaattccaggctctctgtatgaggtgctggaggcacagaaatgagcaaggtgggctcagcagtccaggagctcggagtccagtgtgcagagacagagctgggactgtcagcttccgcccagtgtcatgagaccagggacagggaaagcccaggggaggcgggatcccagaggaggcgagaggggtgccagacccagctggacgcaggacaggagcaggagacagttgtctggaggccaggatccccgagctcggctatgcgggtgagttggtgtgtgactatgaaggaagaggggaagtgatgttctggccagaagaaagcaccgcgagccacgcctaggccagaggcagcccgcaagtggccagaaggcctccaagggtggggcgcctgagctgaagactgcctccctgaggcccacatggcctggactctgcgccttgtccagctggtccctgctgggctgccttgacctgttttgtgccaccatcccctgcagagctggcacccgcggtctgtctctgggttttacgcttgcccaccaactgcttgttcagctccttgatcccagcagaggcagaagcgaggcctgttaaataataatgtcgctcaccggggcccgtgtcaacaccgcgtcctccgcgttcatgatctagatcgcaccgccttcaaagtctaatccagtcgtttggagttcattttaaccgattgctggagggggaagctggctgtgggatgattgttgcatcttaatttaaaaaaacttattgggaacaggctgatagcaggcctgcggcacatgaggtgtgctcggctgcatggagggccagtgccctgcaaggctgctccctgacaaggtgtgagctggcgtctctgccaccctggcttgtgggaggacaacagtagtgacagcgtggggcgttggggacccggctgggctatgaatacacattatgctattggatctccgcaacgctgaggagtgacccgctgggcccattttacagatggggatgtggactagaagccaggccctttggcttgcagtgtgcagccatgctggccccttcccaccaccaggccttcacctctgttgttccctctgcctggagcactgttcccctcctgtgtggctcttctttagcttgggtctcggcttaactgccgcctcctcagtgaagccaccctgactgctccagccgagtcatccctaccccttcatggtctcagcacatcacccggctttattgccttcagagtgttggtcactttctgcaattatctccttgagtgcagttgtccgtctgcaccggcgcctcactgccttgttaaccagtgagtcccagggccgggcacggcgcagcctctcagccagttaggggtgagtgtgccggcaccttcctccgccacggcggagccgcctgtgcagggcggtcgcagggccctcgcaggactctgcaggaaggtgagattcggggggttaggcattctttctgcgctggggcagttagggaagtgtcctgggaagaactgtgccttcaaggaagtagggcagggagtcccctcccaagagaagggagggaggaattcgcagaaggggcttgtccagagggtctgtggccagtggggatagtccctgcctggatggcagccggggacagatggacaacagtgtcactcaagggtgagaaccctgcctggacctgcacccgcaccagccttgtggtgtttctatggcaacccccttcccccaagcagattttcagcctccctggtgcagttgcaagaagcacaggcctgggtccttcctggaaagtgctggaactcagggcaagtggcgtcagcatttggaccccaggcctggttcctgccttgaggggctgtggtggggttaactggggcagcccctcccccattagacccgggcttcccatccttggagaagcctgtctggaccatttcacctcctacatacaccacagctacatgctgacatcctggggccggttatgggattaaccagactgaagctgagtagggtgggactgggcctggctggctcccattgttaccatcctatccccatggcccaaggccaggcctgacgcagagcaggtgctcagtaaagggtggttaaggccagaagcccctcagggagatgggctstgtctgtaatgtttccccaagtggggggtgggggcattgcagagcagctgaccgaggcttggttttaaccggcttcggagcatgaaggtgcttcctgaagcgcgtgcggtcagcaatctgctctgcatctgatgcctcctgccggtacctctgcactggcctctcataccggctctcatgctttttgtccctaagcaggacagagaagaaacttctctgggctcctgaacaccaacagccccttgatttcccctgcccaccccccgccccagccgccttccccacccttaattttcatgtttagtgcctaaacttagtttgcatgtattagctgttgtaaatctatcataygagtgtgatgcggcatgaataatgcatcactgggctgtattagttttctgtctcctatcttatttatgacatgaaacgggtgggaatttgcaaaagagaaattcaggcgcarggcttcttgggtaatggtatgcaaattggcgtgagggtgaaaagatgcaccaggccctcccagcgcccaggagctgccgaggaggagcgcctggtgtctgggccactgccagagcatgcagggtctcgcgtcctatcactgcatggagtcggctctgctcggcagtttgtcttaattttttttgttaatgtgtgtgtcattgtggttgtcaccctgttatgttttttaaattaaaagttggcaagcaaaacttgagaaatggattttctaaagattgtggagacttcccaggaggctccgacaagaacaagttcacaaggaagatgagtgttttccagcatcaggaaggcttgaagttagatgttcagaaggactccctttcaggaagtttgtgargcatgggaggtaggggtgggtttgggaccccatagggccttcttatgtggagggtcagaaataagttggctggttgcaaactcgggcctggagggggtgaagagcatctcaaggcatgtcttgtggggcagtagatggctgagggtcaggcctccaggcccctctctcctcacctggaggagctcagatctttcctgtgtctagcacttggattccccccaaccagaagatttaggtgatgaaaagatttcatgattttaaaaagaagttggtcgctgatggctcagggaacaggcttggtgaagcctgacctggagcaggagggaacctggaggaaaaagggaaccggtacagggaaggcggatgaacagacatcgtggagaggacatatgggacgggaggtgaggaaggggagctggcacggcaggggcagtcctgtccttgtgagccaccccccagtcttagctggtagcagccagcccccgatcctcgcctcccctccactctgtgtgtctcttccacatccccctcccctctgagcccggcagcagggagagggggagggcagatgcccaaggggcagctgcccagtccttttggaacttggcaaggaacaaatagagccatggacatggatccgctgaatgtcagctgctaggctgagggcttaatgcagtggaggtcaggccctgggtgtaattagggaggctccctccctgggtggttgggaagaatgaatgaggtcacatgtgcagaggrtgtaggctagtgcctaatgcacactcaggcagagtggccgctacgcaatggtcctctgtgagcctggcagcggggyagcagggaaggtccacaggaggcaacctctgcaggaggcattcccggctgcccctgcatgccttgtctgagtgggcttggatggtggtcagtgtgggctcaggggctgggttggctggccttcccactgatggcctcagtttccttcctgtaaaatgggggataattatagaacctgccccaggactaagcagctccgtgtacatgcaggtcccagggctgtgcctggtgggaggaagcaccacgtgtcagttgttgtgtcattgtggtcacaggacttgctcagggtgactgggaccacacactcgttggtggagccaggatctcagggtgcctctgattctgaagcccccacctggtctgccgtcctctgccccatcagccccgtgttccattgggtcttgtgggtgcgtatgtccgcaccatcctccctccagatggcaaaatatctgtgagcagggccagtgtcttatcctctctgtattgtcctgcartgcaagtacaggcrttgacttggcttctctctctcctttgctttctttctccccaaaatctccccttttttcccacgccagctcttcccttctgcctgaccctgagccttccagggctccagttacccctgggacccttggtccatggtgtttacatgactagtgggccctgattggggctgctgaccacaggtgaagaccgggatcttggctcctcccaggtacctggggagagaagcgagcttcatagagtgggtggtgacaccagcccagtgacagcacaggtcctgcagagcaggtgccccaatgagggagtctcacccacaggagaggatgcgggtcagccgcatacacgtgcccagcygtgaggcagacacacctgccactgatccgaggagcccaggaaggaacccaggaggggagcgagagaggggagtgagagcggggtgggccaggctctctggagggcatttagcgggagggcccctgagaagcgtgagctgatgcctgtgcatgcctgtgagagggtgggaaactggtcagttatattaacatartcacgtgctgcatagtgactttcagtcaacaacagaccacacatattatgatggtcctatacgattacaatacagtattttactgtaccttttctatgtttagatatgttcagattcacaaataccattgtgttacagtcgcctgcagtgttcagtaccgtctcatgctgtacgggtatgaggcctaggagcaacaggctgtacagcatgacttaggtgtgcagtcagctttaccgcctagatctgtgtaaggtcactctatgatcacatgacaaaattgcctaatgatgcctttctcagaacggcattattcctgtcgttaagcaacacgtggctgtatcatataagttcttgactgtggcttgagtcttttgggcaatgtccagttgggagctgggggtctgatcaagcctggaaaccccaactctcccactccccctccccagccctacctgttctgggttggtcccagctttgtgttggtcgcatcaattctgacctttcttgcccaacaccgcccagcagtcttggatgtggatttacatgtggaaacagaaccacccttccctgcagttctcacagcctatgtgggaagcagggcaaccgccttggctgagccatcccaccctgtggcctccccacctccccgcactgtcaccaaggggaacttagagtctcagcctcaagatgttggtgatgccccctctggctaagcacgggcaaatgggtgctgagcagatactgtgcacgtatgggtgcaggtgtgggtgtaggtgtgggtgcaggtgtgggtacaggtgtgtgtgcaggtgtgtgtgtataggtgtgtgggtacaggtttgtgtgcatgtgtgggtgcaggtatgggtgcaggtgtgcgtgcagatgtgtgtgcaggtgtggatgcagggatgtgtgcaggtgtgggtacaggtttgtgtgcaagtgtggggataggtttgtgtgcaggtgttggtgcaggcatgggtgcaggtgtgggtgcacatgtggtacaggtgtgttcaagtgtaggtgcaggcctgtgtgcaggtgtgggtgcaggtgtgttcaggtgtaggtacaggcatgagtgcaggtatgggtgcaggtgtgttcaggtgtaggtacaggcatgggtgcaggtgtgggtacaggtgtgtgttcaggtgtgggtgcaggtgtgggtacaggtgtgggtgcaggtgtaggtgcaggcatgggtaaaggtttgtgtgcaagtgtgggtacaggtttgtgtgcagtcatgggtacaggtgtgtgtacaggtgtgtgtgcaagtgtgggtgcaggtgtgtgcaggtgtgggtgcaggtgtggatgcaggtatgtgtgcaggtatggatgcaggtgtaggtgcaggcatgggtgcaggtgtaggtgcaggcatgggtgcgggtgtaggtgcaggtgtacgtgcaggcatgggtgcaggcgtgggtgcaggtgtaggtgcaggtgtaggtgcaggcgtgggtgcaggtgtgggtacaggtgtaggtgcaggcataggtgcaggtgtgggtacaggtgtatgttcatgtgtgggtgcaggcgtgggtgcaggtgtgggtgcaggtgtagttgcaggtgtgggtgaggtgtagatgcaggtgtgggtacaggtgtatgttcacgtgtgggtgcaggcgtgggtgcaggtgtgggtgcaggtgtgggtgaggtgtagatgcaggtgtgggtacaggtgtatgttcatgtgtaggtgcaggcatgggtgcaggtgtgggtgcaggtgtggggtggtggagggccaggtgagttgtctggattccaccattcaatatcatgcaggcgaggcctgcaggctccatgtggctcccctatgcagagctcagagcagagcagggcagccacagccagtgcctggggacgctttctgggcctcatgctgaggcttgactgctatgaggcagacgtgatagaacaaagctcctatcacatctgaccctgcatcagaactatccaggttgcctgtggcccaaagtcaaggccccccaggctgcacttggtcgatatcccctgggttccccttctccagccactggacaggtcccagtcccctaaaggctctgcctgagcactctgttcccccaggcctttgcacccactgctctccctgctgggactctcaggctgtcttctgattgggcagaatcttcgtggtcactctgacttcctgcccctttctccatggagcccaactgcctccactagttctcctctgggctcccttagtcctcactccctcctccatcgcactctctgcatcgggccgtaaacaggactctgggcatctccctggccgtgctgtgtcctcagggcccggcaggcatggacgctccatgaggtttgctgagtgagctagcaggaccaaggaaaggagatgggcagaggcagtcgcttgcctgcgatcagcagggcataggaaatccctttacgtcaggtgaggagccgataggagttttgactcctactgtgtgccgggggctcagccagggacctgattttgccttcagtgcttcactttctagatgttaaatgaatccagagaaacaaccctgactgcacctgctcacctgcaccctcgtgcacgcacaggcgttctttcttctgccttacctctgtctgtctgtctctctttcagcactcactcgtctcttcctccctggtggtctggtttgcacgctcactctctgctgatctcagcttctaactctgtatcggtgtctccttygatcggtgccgccccggctcttccaggccttctggcccagggtgggcactggctggagctttagtccctgtgcttggcactgggttccagcagcagcccctgccctcatggacctgcctctctgatatgggcatggtaggggagggagatcagggggggagagaccaccaccatccacttaatctgtattaagactcatgggtcccagaggctgctttgagctctccattagcagcaacttgagtcatcttacggcagctctgtgcagtaggtactattaatattatcacacccactttaaaatggaagaaaccaaggcaggaagtggtggggtcaggagctgaaccctgtaggtctgcctccgggcctgtgggtttattgtttcttgcaaatagcgaacagataacaagacaatcccaggccacggtgaatgtcatgcagacccaggctgggcgccatcactgcctgcactggtcactcccctgctgggcctccctgtcctctctgactagaggctcggtggtccctccttcctcatgggggctgcgggtgagctgagctgagctgagctgagctgtgggcagcccagcacgtgcaggagccggaagatgcctggccccctctctatggctcagtcttcaccgggtccccagggtggtgggcaggcacaggcactagctcagccctggcacctgcttgtacagggcaaggttggagtagctgccaagggtaagactcgcagcaaaggtggttgctggccccaggtgacccaggtggctggctgcccaaccctccgtcctaaagtgtcgatgctggagaagaaacactaggctggctgtcataattgaagaaaacaaaaggaaattaaataggactaatgaggagaatatcaatagcccatacttcaagatgctttttctattccacttcctccagaatagccaggtgcactgatagatttcagggtttttttttttttttttttgagatggagttttgttcttgttgaacaggctagagtgcaatggcgtgatctcggctcactgcaacatctgcctcccaggttcaggcgactctccggtctcagcctcccaagtagctgggattacaggcatgcgccaccacccctggctaattttgtatttttagtagagatgaggtttcaccacgttggccaggctggttttgaacccctgacctcaggtgatctgcccacctcagcttcccaaagtgctgggattacaggcatgagccaccgcacccggctggatttcagattagttttgtttttaaaggcaaaattttggcacagccaggtcaggacagcgttctctgcagtggcactttctgtatgccttggtctgggtttttgggttgacaccaacatctgtgtccaccttcttgtgtgcttagtaacaagtaggccttactgtaggaattgttaactttttcggaggtaggcaagggtgatttatagacctcttggaaatgctagtaaaaatagttaacgatctttctagaaagacacaccaaaaataccaaattttgtacaatcaattccaaaatggattgttaaaggaaatttggggtctggccaccagtcttggagctggcaggacgtccatcgctccatcccttgcaggctcccatgatggccctgagctaggagagtccagcatccagtgaagtctctgctccaaaggatgacctcacacccaccttacagatgaatgaacagagtcccagagaccttaaccagtttgctgggaagaggtggactggtcgttgcacccggagcctccctgagaaatgcgtcaggcagggcagatctgctcctggtgcacaacctcttggcctcaaccaggtcagactctgagggcaggagtgttggggaatcagacagagctcacagagagggatccatccatggcttggaggctgagtattggcactggagtcccgttagggtgaccaagtgtcttggtttgcccaggattgaggaatttcctgggtttggggcttccagtgccgcagcctggacagtcctgagcaaaccgggtaggactggtcaccctaggtttgaatttggctttcctcccatgtcctaagcagcgcgactttgcacatcatttagcctgtcagtttgtttcctcagcggtamagtgttgataagaatgagataaagacagggaagggagttgtgctaattgcctgtagaagatggcccttccacatgctcagtgcagccgtgcagagcggacgtgaccccgggtctgaattcgcagccctgccctttgctggcggggtggccctgcacaggtcatttcttgtgccctagctatgggatgaggatggaatggtggcacccacctgccaggtgtctgtggggattaaagggaggcagagtaggtgaggtgcttgcaggtgatcgtgggtgatctctgggcccacgactgtgtctcccagggccagctcggtggtgactgggccgggaatgggtggcacagccccttcatgctcacattcagctctggtgctcagcgttgagagtcccccatgagaccctcggaggacagcatgtgagcttggagcgaggtgcacgcttctgccccgccttgccccaccctgcccctgcccctgccctgccctgcccctgcccatctgggccacccrgggttggttcgctctcttttcatagagtctccgtgaggtgggacgctgcgcgcacagtgcccagtcaggcattggaaagtcctgacacacggtgggtacctgtaaagtagaagccccaccagcatcctgctgtttcctcaggagctggcagcccctgagagcccctgtgcccagcgagccttccggccccttggcgacatctcagctctaatgactttgagtgctgagctgctcaccctgggaatttatggaaaccatgcacagaagcgtcacctggaggcacataaatattgtaggactggaggttgggctgtgtcagcactatttggagcagtatcacccacctgaaactgactgtgtgggcgcctgtagcgggtggatggggggctgcagggaggggctccgtgggcaggctcaggacacacrggtttgtctcagctcacctgggttcattccaggtcacagtgcgccaatgctctccctggaatcctcaccgtgccccagaggcgtgttctctttttgtccccgtgtacagatgacagaggagactgagtcactgggtagtggggatctgggagctggaggaggcgggcacaacccctcccctccaactgccagctttttttttttttttttaaattactttgccttttctcccataactttttttttttttggagacggagtttcactctgttgctcaggctgaattgcagtggcgtgatctcggctcactgcaatttctgcctcccgggttcaagcgattctcctgcttcagcctcccaagtagctgggattacaagtgcccaccaccatgcccagataagttttgtaattttagtagagacatgttggccaggctggtcttgaactgctgacctcaagtgatccacccatcttagcctcccaaagtgctgggattacaggcgtgagccactacgcctggtcccccataactttttactttgaaaaatttcaractacaggaaaggtgagagaataatacaatacacagatattcttcacccaggtaactgttaacatgttgctacaatcttcccccatattatacatgcacagagacatacacccacttttaaaaaagtcagttgcaggcatcattaccctttacccctaaatacttcggcatgtctcttcaacgtaactgcatggcatatcacacccaggaatttaggtctatgcactgatgctatctaaatactgtccaggtacaggttttcccagttgtccccaaaatatctttcagagctactcccccaaatgccatccaggatccagcctgaaatcacaggcagcctttggttttcatgtctcttaagtctccttttaatctagaataatccctttgcttttttgttttcttcatgatattgactttgttgacaagtccaagccagcgtctcatagaagttccacagtctggaattgcctggttatttcctcccaatgagctgccagtgttcggccaggtgctgtggggctgggggtcaggggagccctacacctcccacagcagtcctcggggaggaagaagagcagctggccccgtcctgatcacttggttagggtagcgtcggctggatctctccttctaaaggtgctggtttccctttgtgattactcagtcacctttgggtgattcttggagactgtgtgaatatccagttcctccacaaactttccccctggggctttgtcatccatgggtgatccttggtgattgctaattcaccattgtctaattctgccttgccttctgcattgactagttgtcactagttacagagattcacctgaccccactccacaccctgcccttactatcactacaaattcctagatttaaaaaaaaaaaatccagcgtgctctaatcaggaccatcattattatttttgatgttcacattgtcttgaatttggccagcggggaccccttcgtgttggctcctgggtcctttggacacatccccattgttctttgagcccttccttgcttttcatctgtgagaagttctaggcatttctccagggcaccctggctagagtcactgccttcaggctctttcagtggacagggccagggaagaactctcgagttggggttcgttttgatacctctgatttagatttgagatcctggagtctaccctcgtctctcccattccacaccggactctcttctctctgtgcaaaccctggttcccaataacatcagtgtatctcagtcccaccacataggttcagaatcactgtgcctgccccaccacctccaagcctgccaaggaagttgaggtttcccttgcagatcattttgtccttcagcagggaccaggggtgtacagttggaatgccatgatcctgagctacttgaatgggttcttttctatgcggatgtgactgtgttccaataaagcttcatttaccaaaactggtgcaggctggttgtagcctgaggggcattgtttgcagacggctgctctagtgtataaacctaacagcacggtttctggtgcagggtgagcgctcacccagtaaatagctgtgtctggataatggaggctgagggggcaggaagcactgggcattcctggtggtgggtgggcaggtggcctttttcagggataagggggctagaggcctcttagagagtaggacagcccctgaccccaccaaccccacacttctgggcctcccagaccagccaaggatgagggcacaggtctggaggtgcttggcctgggattggggtgctgggtgagcagggtttcaccctttyctggttgggaggagagcagagtttgatgagctgacagcctcccctggcaatgaattctgagctctctcagggtacgtggataccttgtgtttggaaaatgaaatgagctgcatggcctggcagcagcaagaccagtgagcagtgagggcttcccccctgctctcaccagggtgctcactgccccctgctctcaccggggtgctcactgccccctgctctcaccgcggtgctcactgccccctgctctcaccgtggtgctcactgccccctgctctcaccggggtgctcactgccccctgctctcacccgggtgctcactgccccctgctctcacccgggtgctcactgccccctgctctcaccggggtgctcactgccccctgctctcacccgggtgctcactgccccctgctctcaccggggtgctcactgccccctgctctcaccggggtgctcactgccccctgctctcaccggggtgctcactgcctcctgctctcacccgggtgctcactgccccctgctctcacttgggtgccaggctcagtccctcagccccctctgggacccgtgatcctggcatgtctctctggctccacctactccctgccctgtgggcccaggaggctcaggcaggactccaggctcgtggtgtgagaaggggacccaggagcccagaggtagctgagacatgccgggctggggctggggctrgggctggggctggaggtgctgtgctgttctccctattcattcctgccctttcccccgccsgcctccccgctttgggctcagcaggtttgcacaagccttctgcwaagccctctgggcctggagacagacttgttatgccactggagaaatgagcctggatttccaccaccgacttctcttttaattagattctgacagcagcacacagggttggctggctgcagattcaggtgcagctttccttggtcccaggcctctgggtttcagtgcgcttggctttttcggaggctgaaaatacttctgacctttcttcgggagtcgagcggcaggctggctgcacgcgtgtgagcatgcagatacctctctcagtgtgtgcatgtttgtgcatccgtgagcaaggagctgygtgctgtgttttggaaaagcctgcagacaaagcatgttgggtctcactgactgtcctgctaccccatccattcgccccactgctcgccgacagcaggtgctgaaggggtccccttggcctcactgtcctcatctgtgatttgggctgatgctgcctcagctggcttttcccagcaaggcctcatgggaggtttccttcctcctggattcctcctacaggctggtttggcaaaacaaaatcattctgcatgtttccttgaaggaacatacatcgcaggaagagagaactgaaagccaggacggcccgggctgtgggcagcagatatgggcggagggctagagagatgggggcatkgtctctcccctacacagcatggactactaaacctgactttgcacaggctgtgaggaggcgtggcctcctcccaaaaatcagaggctctgagcctcttgcacctgggccttctctgagggccgggagtgggtggctaagaaaagaggaagagacccccgatacctctggagcccttagcctgagcccccaatctgagacaggagacagttcgcttcctctgagcatgcccagcttgatacaagattctgtccttgctcttggggggcccccacccaatggagacaccgcacccctgcctttggtgaactttcggtctgaggaaactacagcttctgctctgggggcatccccctggtcaggggtgggctgtgcagtagaacccctgttccaagagcagcctgaccctggggagaggaaccacactgctgtctcttctcccctcccctcccctcctctggggagcctggccttkcctgctacccctgcctcccttgctactcgcagctcagccatcagggactggctcagaaaaagcaatttccttggacagctcacagtcttgccctcctggtccccacactctgatcaggaatgagcccggagctcactggcttagctccgcatggagacccccgcccctcacaagcttccttaactcagtgggaaaccgcttagtgatttgagctgggaaggagctggggccatcctccagggcaaaagaagctgagtcctgttcctccctctccacttgctaagcccacgcgaggtcttcgggggctggacaaagaagccagccttccccacactgttgtcagactgagcttctttaaaagtaaaactgactctgtcacttaccagctcaaccccctccagtgggcaaataaaatctaaactgttccccatggattccaaggtggcctggtgcaatctggccctacctgctctggcctgtcccattgctgtgccccccaccacgggtccctctgcttctcattcctgcctccgggcctttgcactgctgtgccctttgcctagaatgctcttccccctcctcccaatcattgaggggctgtttcctccccattattcaggtctctcactaaatgtcacctcctagagacaccttccctgaccccagtcttaawggctttcagtattttttctgtgcagtgcttctcactatctgatgtaatctttctttgttttaattgcctcctgtcctgagaacgtttgccccacaagagtgggtcttgcagtcatcacgacatttccagcacttacacccacaccagacacatagtagggactcaagaacatctgctgaataaatgagaccctactaggcactgggcctgtgccaagctctcctcacccaggtacctgtaatcctcatagcagcgtgtacttacaattgaggaaactgaggcctgggcctgtgaagctgccaaggaagtcagatttaatagcaggttggatctcaaataaatgccccgtccaggatcctcctgcagtcttgggcttcctcccaggacaaattctttatggaaaaaggagaaaagccagaaaactggaaaagaggaaaatcatcccgtcctgctcctggagtaagcctcagggtgcagctcttcctcccctgtcccgcttcttcccccagcttttggtgtgtttgttttgttttgttttttttctttctttctttctttctttctttcttttttttttgcattttctgtagcattcacatttttctgtgtctgtcatgcagtgtctgtaagtgtgagtttaaatgcagggaggacagtacagagctggatacacagagttacctgactgtccccatggcttggggatttgggttgtttctagtctgctgtgcctgagttagtgacatctgagtgttgtagatagaattcaagtgtccatccattcatttttttgaccaaattttactgtgctgggccctgtgccaagcaggtgacaggcactaaagggcatgaggcccaggctctgtccttggagtccacagtcttatgtgggaagtggccaagtagaaccacagaatggtgtaggtattccaggctagacagcagagcacgccattcagaaggaagtggctggtccgtggcggggtggggcctgcctcctggactgaggacgccactctgaagtggagtcttcagatgttggaggaggacagttsgggggggcagtgcgtgctgtgtgcaagtcatggccagggcaggggtgcggctgtgtggtacatcttgagcattggctggcctgaaacgtagggagcccacaaggaagggcaggagtgggggcagcactggggccccgaatgctgagctaaggaacttggactttctcctgcagtggatgggaagcttgatcatttgtatcttcttttttaaaaaagtttttatttgttttaagatcaaaatggtacatatacttgcaagaaaaaaaaaaaaagcatggagtggtttatcctgaaaggctcgtccacactccacatctcagtcctgctttttggaagagaawgcttttcacctgttctttttttaatccacctggcactttcctcaggacccaaacttgttcactctgctgcttcttgatgtatcaattttgggacatcacctgttgtctccttgctgtgaatgatgaggatttggcccatattacccccgttccttccccggtcattctctcrgttgcctttgtcactttaaatcatttacataaaccacaacttctttcatgattttcggctccatctttcccttccgtaaggtaaagctctgaggggccactgggaccatgcctggtcctgtctgctcgtgagtgagcgtgtgcatgtctttcctgctcctcactcggtgatatcatgctggtagtttgcaactggccacgttagaatgtttacaccacggaaattggcaaacsctgcaaaccaggattccctgccagttgttaaactttggccaacacagcacagctgggcttctaagattccagttgttaaactttggccaacctcatagctgggcttctaatgttccctgagtagcttgagcttttgaagaatgtgagaatggctggcccaggggtgggggcttgtagggaggctcagctggcaggcccagccagtatcgacactcctccctttgtgccacagcaaagcttcgaggcgcaccaggacgaggcagtgagcgtgacacacatggtgaaggcgggcagcggcgtctggatggccttctcctccggcacctccatccgcctcttccacactgagaccctggagcatctgcaagagatcaacatcgccaccaggaccaccttcctcctgccaggtgaggctgcctcgggcacgggggagcrgacagtcacagagcaccttccacggccaggtagtggtgtgacctgggcagcccatcccattttccctcatcagccctgaaaactggggctttaatttggggcactccccaggaagtggtggggttgggattcacacctaggactgtcatctcaaagcccctgcctgtcactgtgcccagccaccgcatcacagcagcctggggcgctcaggaaatggcccccagcccactggaccctccaaagtcaggcagctgctaaggaaaggccaagctgggcaggaacccaggcctttcattctgccccactgcccaggttgaccaaacacccaattctgcctcaaatgccctgcaggatgaggtgatgggaaagtgagaaagccaacgggtggtctctgtccttggagttttttctgagaaaggcaaattcccctcttgggccttctagtctgtgggtttggatggcatctgctgtggctggggcccctcctgcgtagctgtgtgtagatgaagtggacaggattggtggtggaggggaatggcggcgaaggattaaggctggagctcaccaaatgccccccaaggcctccatggaattggctctcagcctttcgttgccatctgctgctcaagatgcaggcaccatgcccatcctcaccccagctggcttcagagcagaccacggggccagcaggcatcagctaaccttgcttccctccttggcccagcttcccccagagagactgacctgcggccagtgtgggagggtgcagtggctctgtcttgtcccagtgccccaggcagggctgggttcagcagctgggagagccaaagggccctcgggccagggaaacacagcccgtgtggcaggtgggggcctggagctgattgtcacaggacctggcagatgggccatggcagaggctgggagtggccatatgcccagcagggttgagcatcctgtcttctggggccatactgagggcaggcatgttagccagcactgcaggagccttagggacctctgcctaccccaggggcccggtccctaactccctcccgaggccctggaaatcaccctggtttctgcttccctctagccagtcacgatggtccttgagtctgaactgatcacacggggatggtggttactaacaacacagtccacggcagtcacaatggtgtaataactgccaccctgcccgggcctgaggtgatgaggccccaagtgcttatgtgcaggatctcatttcaccctaaccctgcgagctggggattrtccccacattacagatgcagacactgagattggttcagcaggccgggcgtcttgctcgtggtcatgcagtagaccagaggcaggaccacagtcacatcaggccggactcagtccagcatcctactgtatgtaatggagaaagagagttggcttgaggcctggcttggccaacacacagtatcagacaagtcccttaatctcccggagcccctcatccctctgtaagatgggatgtaggtcccagctcagggactgttatgaggataaatgctggtgggctgggaaggtggctgtcctgggccggcagggtggcaggtgcccgatgagactgaacccttcactcacgttctcctggggtgtgtgagaggcttgatgggacctgtgtttgggttgcctccttccccctctctccctccctccctgcctccttccttccttccttgtttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttagtggaacaatgaagaaatggataatctcatgggcttttaaaaatctttggaatctcgtcttgtctgcgcagaggagagtgagagagagtcaagctgatcaagtggtgggaggcaggatgtgtggacagacctggctgtagttagaacagccactcctgcctgtacaaccctgactttactgtgtttcacatgcaccttcacgcccgttgtcttacttactctttgcagttaccctttaaggaaggaagggcattcgttgttatgatgatgatttgagggccaggtaaactggggctcaggaggtgaaatgactggtctgctatcgcagtgctgatatggacagagccaggagcagccccacggactctcgttagagcttcctcacacttactgtgtagccttgggcggttgtgtccctgtcctgggcctcagtttccccattcatataacaaagggctgagatttgagtcagcttggccatgctgggtggggtacaccagagcctggagccagaattcctcctggaatccctcccctgtcttccagctctgactgggagcactcagagcaccagcttcccatcctcggtccctaccccgcagggcaggtgtaggtgttgtgtgagacagtgtgaggacagtgcccacagtccccrtctcaagccagcagcggtccatgatggtgacattttgccgtcatcgtctttacggcatacccgccctgcatctcctgcgagggctccttgcccctcctaagaccctccaggtcagtgtgccattcctgtcgcatcagctgcatcagtgcagacagaggtgaccgctctyttggcagacctccctgaggctgaaccctggagaaggctggatgtaggccgaggttccagagtgtggggtttcccgaagkttccctcttccctcaggcctgaactttcccaatcagtaacccagtggagcctggggccctgccagaccagttcctcctgacccctcatatctgagagtggctccctgagctccaagctgagccagagccagccccagccaccatgctggggaccagagcgtggggggcagctgcagatccaccccacgttgtgcctttgcagaagcgcaacacagcaggattcttaagttctttattagagatatttttaaaaggcttttaagtatttttttcttcccccacaccagcaaatgaaataattgcataattagtaataaatttgttcctacactaagtgtggatttttttagtgtgtgttaacaatttatygcacttccttcccctgacccctttcttccactcgcrtactcgactggtattaatgcattttttaacctaaactccctcctccttttaaccagacaggtcattaataaaatgttctccaagagcctgagctttttaaagttgtatatctccagatagatggcttgggtgagttgaacactgcygcattaagtctctgtgataaaatatttattcaccattagaattttttttttctttcggactgtttgtgaagtgtcttgctcttttccttgaggtggagggggagggggaaggccccagaatgaggtctgcagatgaagccatttctcaattccgrcatctctttcggtttcttgcttgccttcctcccatttgtcggttttgccgtccagtgggggctgggaggatgcaggggcagcaggaaatggtctcctgccggtctccatgccctgggggtcttggagagggaggcgatgaggcttgtggaatgaaaaattcaccactgtcccctctcttggcttaattgttcttgtgggtttatggctctgatggagctgatcttaagacattagcgtccagatccttttaataatcataaacattatcctaatagcctctatttattgattgtatactatgggctaagagctgtgctcaattgtgtatatatattatatgtatatatatatgtgtgtatatatttaatatttctaataattataaaattgagcamggcaggtttgtagtactcattgatggatgagagaaatgatttgtccaagttttctcctttccttcatccatccatctgtccatccatccatccatttactcattcactcacagatacttcttgagagtctaccatgagccaaggtacttggccaggagttggggagttaaccatgagcacacagataagtcactgccctcacaaagcttgtcataagtaaacaaatagcaaaataaggtcatcacagaccttgaccagggctaagaagagaagtcagctgttgaaaggggctcatggcctgagcctcccatgttggccaactccaggagggctgggggcctgaccctggaccggaggctgccatcatagttctgagccttcacttttggaatggatttaggtgtgggaaatagtcccagctccacagacacccaggtactgtttgtgaaatagcccctgttggccaaggctgtaagtcactagtgggctttttttttcagcctagtttgcatttccacattgcagggacgctatgaatgtgattttttgagtttgcatcatgttgccagactcgaatcccaccgcctgcttgatagctccattcgggtgtgtctaatttgtgtctcagaccacacatccaaccaggagctctgggcttcaacccccaaaccggctcctttgccatcccaggccatggcactgctatgcacccagctgctccaggcagaggagcctcagtgctatcctgggttccttcctctgctccacctctgctcccctctcccagcagctctgtcgctctgctccaaacaggtctaaaacaggttgggctctcctcacctcactgccgccgcccttcccacctgggcagctgcgggagcccctgctgggctccttgctcctcccactcccaccctccacaactgtagctagaacgttccactcaaatcacgtcacgctactcccctgcctaggccttccggtagcttttcactgcagccagaattatgagccccagtcctggccctgacccatcccctcttctgaccatctggagtctgccttctgtgccccaggtgcactggcttcactctgctcggcggactggatgagctcattcctgtcacagggcctttgcatgccctgtctcctgggccttggctcaggtcttggtgtggccacctccgccttgtcacccrgcagcctcacgcctgcctccctatccttccaggaagtagagggaggcctgaagacccgggaatcctccamtggctctgccctgtcgccctgtttcaatcctctgcctggtgtttacatcccttgtttctgtttttgtttcctgtatctcctctctacacctctgtgtctaatacagtagccattattacaatgaaagaaaataacacattcagtccctcagtgccactagctatatttccagtgctcggaagccacatgtggctgatggctgtcaaattggacagcacggtagggaacatgtccatcatcaaagaaagttctagagtgtctgctccttaagacaggactctatgtacatggtcccagctgtgcccccagcacctagtgtggggtctgccatgcagtrggcatctgggaggtaaatggattggtgatgggatggcacactgtgttaggcaatgctgggtgtaccccgagtcggtaacctgccttttggggtgaragagccacaccatttctctctgtgcctgcactgcagaggaagcacatacacccacatgtatggagttgaagtgtcatgcccaaggagggagaggtgatggaagcactgggcagtggtgagcagcagacctcaactccaccccaccctgcactcaccaggtgggggacctctttgagccttaacatccgtgcctggaaaatggggccggcatttgtgtcttgcatacrtcttggctgttgcaagscttgtgtcagatgagagcaggtatacgagtgctttggaaactccaaagctgtgttttttcaaatgtgatccatggaccagaagcagcagaaagtggraaccttctggaatgcagcctaagcctctcccagagggcagcaggatcagggcaagaaggagacagccctttagaaaggcagctgcccagtgaagcctaaggaagtgtggcagcgccgtccaccctgtgtgtgacatggtggagggtctgtccctgagccggcagcctgtaccccacgcctctcagccccctcagaaagcctcctgccccctgcactcccagcctctcccttgtgcccattcccattgctagaattgttggcaacagtgcagcagcagcgatgacagcaggtagcgcccattttgccatgtgcaggcacggggttgttttacgttcattcatttaacccaatggasagtatctgtgttccaaacatcaaaaagggacagtaaaaatacggtcctataggactgccattgtatacatggtctgttgttgactgaaaggtcattatgtgacatgtgactgtattatccttggccccttttacaagtgaggacaccatggcccagaggagtttaggatgggccccaggtcatgtagctggagagtggcagagccaaggtgtgaatcccgcacctggctctggagccctgttctcagccaccgtgctgggcagcccacacctggcatcctctctgttaggagcaggggcctgcccccacgccctctctgacattgctattcttgctaaaatgaagagacagagctgaggggagagctaaaaagaatgaatctggactggcatcagaaacatgctgcttcccaccagcgagttttgtgcttcactcttgggcccagggcctgcagggtgtgctgtgacctcatctgaagaagcacccacacgggcaggccctgaggggctgcagcagagccacctcgatgcctctygagccccacccggccctacttatgccttccatctgcaccaacaccgatgagaagcttgcacctccccagtcttccctggttttgctcgtagctggctggctggatccctgcatggattgcccttggacaaccctttgtgccggatgacctggccgccgtgtattgagagcgcacacagaccaggcgctgtgcctgtggtgttcccccaatgcatccgyatrgcagccccactttacacaggcggaaactgaggctggttaggggagtgctcagctgcaggacctcgtggccagaccccaggcaggtcagcctccaaagccccagctcttccccaccccaccgcccaacttcttgctggtttcaggggaggagcccgctgtgccaggccctcatctcgtggtggtacccagagcccatgctgtctccccaggagggcactgctcagccgccctctctttctgcaggccagaagcacttgtgtgtcaccagcctcctgatctgccagggtctgctctgggtgggcactgaccagggtgtcatcgtcctgctgcccgtgcctcggctggaaggcatccccaagatcacaggtgaggctttgggagctggtgttggcaggaccagggggtcagctgcaggtggccagtggggcttggcggggagggtgtattaygccctcatyggtatagggatggggttccagtctccagcttcctctcatctcaggtggcatggtggccagtagaactgaatcgtcctggccccagtctcccacctttctgagtgtcagtttcctaatctggcagatggacacaagagtggcttggggcctggctgagacacctgcctaatggcaggggctccactggccctttctgctkcttcccatagcagtttcaagatgtccaggctccagagaaagaaataactgagtgcttctggggccaggcccggcctgctcgtggggtccatgtgcaaatgaatgtgttcacatagatcagaggaaggtctgctctgatctgcactactgggcccaggacaacaagggcaggatcagagaagacccccacacttggatgcctggagctccgggtccccctccaccaccctgagaatgatgactgtggtcttttccagcaagggagcagggccaataggaagccctgggggtgggctggctccctgcgcagacctcaagtccttctgataaagaagaattgctttggctgggcgcggtggctcacacctgtaatcctagcactttgggaggccgaggtgggtggattgcctgagctcaggagttygagaccagcctgggcaacacagtgaaaccccatctctactaaaaaataaaaaaaaataaaaataaaaaattagctgggcatggcggtgtgcgcctgtaatcccagttacttgggaagctgaggcaagagaatttcttgaacccgggaggtggaggttgcagtgagccgagattgcgccattgcactccagcctgggggacagagtgagacaccatctcaaaaaaaaaaaaaaaaagttgcttctaaattctgagattttctattttcaaggtttcatcaaatagggcattttgtccatccagggggcatttgtggagggtctatttccaggtagaatcctgggatgcagggatgaaatcgggcagagaccctgctctcaacaagctgatggtctcctgggggtcatcatagctcgggtgacaggtgctgggatgagggtgctccrggggctggggacacagagactggggcgagcagctccccatgcatgaattcaggagggattcacagtgaggagtgtgagctgggccttgctgaaagagttgcagaatcaagtagacaggaaaggatttctaggcagaggagctgcttggcaaaggctcaggaaattcttggaatttcayrctgaggctcccccgtgtggtgtataaggtggtttctgttccrctcccctgaggaagttgtgcaggagcacgggatagccagagcctgtggccttcgggggaggtgccaacatagacagaagtgacccccccaaatacccacccagaatgttctccaggagagagactcaggtgcttcycttaatgcgctgggcctttgggcccctttctctctcgccccattttctgcagggaaaggcatggtctcactcaaygggcactgtgggcctgtggccttcctggctgtggctaycagcatcctggcccctgacatcctgcggagtgaccaggaggaggctgaggggccccgggctgaggaggacaagccagacgggcaggcacacgagcccatgcccgayagccacgtgggccgagagctgacccgcaagaagggcatcctcttgcagtaccgcctgcgctccaccgcacacctcccgggcccgctgctctccatgcgggagccggcgcctgctgatggcgcagctttggagcacagcgaggaggacggctccatttacgagatggccgacgaccccgacrtctgggtgcgcagccggccctgcgcccgcgacgcccaccgcaaggagatttgctctgtggccatcatctccggcgggcagggctaccgcaactttggcagcgctctgggcagcagtgggaggcaggccccgtgtggggagacggacagcaccctcctcatctggcaggtgcccttgatgctatagcrcctcccctctcccctcagagggcacagctgcaggcctgaccaaggccacgcccggctctcgtgctctaggacctgcacgggacttgtggatgggcctggactctccagaaactacttgggccagagcaaaggaaaacctcttgttttaaaaaaatttttttcagagtgttttggggaggagttttagggcttggggagagggaggacacatctggaggaaatggccttctttttaaaagcaaaaaacacaaaacctcacaactgcctggcaagcccagtatcacttgtttgggccctagcgggactccaaggcagccacaygcccctcctggaagggtgtgtgcgtgtgagtgtgtgcgagtgtgtgggctggtgtgtgaatatctataaataagtatatatggtgtatattatatgtgtataaataaagtctgtacatattggagctctgggagatgctggaataaaagacaagagttacatctggacttggattgaggttttgttgtggttttttaaagcatgatgggaaagagatagagagagcagctattggtagagagggtttattcgggacccaggagccactcttaggcttggtgggagggtggagctgctacgggaatcagctctagaacttcacagtccaatctggtcaccattagccacaggtggctaattaattttcaaattaatgaaaaatcaaacattcaatctctcagtcaccgtagccacatttcagatgtggcttgagtggtgagtggtgaaggatgagacggcacagatatgaccatttctactatagaagaaagctcacttctgctccagaaggggctctgggagcttcttttgtgaatatgttttggaaaaaagactggttcaccccaggtctggagtagcatgggggcagaaggccttggtgtctaacagtgcaagccagaagcgaggggaagatgaggggcttctctgcaggctggcagccatgtcccaggacttggggtcagagggaggacagggtgggcttcaggtgaggtccatcagctgcaggagcagagcccaggctgcaggtgggatgggcrggtggggctgcctctggccctggctcctctcttctgtcgcagttcgtcctcagatttctagagctgcttgcaggaaagaaaatcaaaaccaaaagccgccacccaaaagggaagtgtttcctccatctctccaccctctacctctctgtcatctgtctacccaccacccaccggtacttgcattgagatctttccactgaagttctgggaacccagtggaaaagccaccaaggagtggacattccagccgggttctaacctcatgataggttctcgcccactagagaagtcattcattcattcgttttgcaaaccccttgagttcctgctatttgctgggcactgggctatgtggacaagactgcagccgtccatgcccacaggaagtgcatgttgtagcggggaaggcaagcataaacaccagcgagcgaaggcttggggagatcgagggtgctgcggaggaggaagggggatagaggagcagcccgtgctcaggtggagggtggacagaggttggctattcccagagggaggtagccagtgtgggtccccaggaaggggagaaaggaagctggtccagaggaaccagtacacctgaaggtctggctcctacactgactacggctcagacatgtccacctcctttgggcctcaggatcccattttgtatcaaaagaaccatcactgccctgtccacctctcttggaagagaataaagtacgctagttccatttttattgcacaagtgggttattgaataaatactctctctggatgggactcccagggggtgtgtttatctcatcaatcaaatgtcaaccaagacttcctgagacagagaccagtgagtcgaggctgcctgggacaaggagtaagcctggactctagggtctggcaggcctgtgatcaagtccagcaccaccaaaacgcgtctgtgtggctcccagcacgtccctccgtggctcccagcacgtccctccatttccatatctctagaacagaggggatgatgtgtcacagagttcaaggtaccagaaccacagaaagcatctggaacagccctccggtggcatttttggtgatggttccttatatcctcgctccaaacgatttgaggccagtggttcttactgaggagtctcctctggtgctggagctggcatctgggatctccgtgggcctgttagatcctagacctacagatcgctcagctaaaagggacctgggagatcgaatggagcccgttaaatcacgtcacggagaaaacgactgactttgctacttcagtgaaattatcacatcagtcaccagctcatctcccatgcctccgacaacagagcgagggagggtcgggggcgccgcgaatggctcctgagacccactgaggacgtgcatcrcatgtgagtggaggcctggccttagatattgataagagtaataatacccagagcgctccgggtgcctgagctcctttcgtcggtacaactgctctctgaggctgcttttgtttgcctcgttttgtaggtgaggggtctgaggctcagggatctaagcaacctgcctaggaagcctcagagcctaaaagtcaggcccgggactgtggtctgtctgccaccaagacggctcttaactaccagactacttgccccccagagcaaaactctggagacaaacagagcagagttgccttaacaggcaagtgccttaatctgtgtctcagggagaccctgccatgggaacggaccatcattcattcagtattcattgaacgccgattacgtgcctggacccgttttcaagtagacactgggtagggcgtagtgaaaaagacaaatcccaggcacacctcgttgtccattctactggcagggtcaggagggaacagaccgggagaaaaatatgtcagatgatatttgtgctctggagaagggggatgggaagggctggggagggggctcatgatgtcaaagagggtggtcaagaggcctcactgaggagatgacgtccgagctaagacctgaaggtggagcagacatcgggtggtagaacatttcgggctgagggcaagtgcaggagcaaagtgtgggggcaggagtgtggctggagcaggtgcgggcgggggaggggaggcagtgggcagtgggaaatcactggagggtttcgagcagaagaatgacactgtctgtctgatgttttcaaacaatcacgtttggctgctaaattaagaataatccatggagagggggacagcagtgtgggagccaggagtccccttgttgagagctgttgcagtcagccaggtttgcaaggtggggggcagcaatagagagcggtcagcttccgggtggattctgatgtcccagagcccactgggtttgcagatagatgggctgggaaggaaagagaggagtcaagcatgcctctgaggtctggcctggcgactggaaggtcagagctgccagcttccctggcagggtggctgtgaggggcagcttttccacaggaagagcgggaatggggtttggatcggctacatttaagttgcttttgagcatccgagcagagacgtagggaggacagttgactgtgtgaatttggagtcagcagagaggtccatgccaggggtgcctgagcctggatgcagcctccaagggagcagagtagacggaggaggtgtgaggacagagtccagggaaggccagtgtcgggaggtccaggagctgatcaggaagcacgggggaggctgagatgcccggatgaaggtggaagamcggaagggcagggtgagggttggaaggggagggggtgatctgtgctgaatgctgctgaggttaaggaggagcctgaggcctaccttggatttagccacacggaggccttctgtgcccttacgagaggtatgtgggcagaagtggtggcggggaagcctgaggatgcggagggagggtctgggagaggagcatgtgagcagcggggtcctgggtggttctcaggccccagtgattcggtggagggaaggaggggccgtgacagatgccccagccatgcaagccacagctcagagggcccagagtttatcagtcatgggccttcatccccttgcccttgcccaagggggagaatcactttctctacccctggtgagcaggccgaggctgcagacaagcccagttatcaggaggcagctgtgagccaggccggtctcccagcaggaatcctgagcagcggctgattgagaatctccggctggtgacaggttgccccaaccccaccccgtggggagcccagcctgccatgctgggttactgccaaaggcctctgttcctgtctctgtgctcaggcctggggaggtcaaggcctgacatccccatccctcagatggaggtgggggttgttctctgggcacttctggccccgagacatggactccaaaggtgggagggaagcagaggctgtcctcatccagcatctgagcagtccccttccttggagcctgactgcctgtggtggggggcacagaaatggccctctcactttgttccgatgactgaccttactgtagtttggacaccccatagcagaaaactctaattcttttttttttttgagacggagtctcactctcgcccaggctggagtgcagtggcgccatcttggctcactgcaacctcctcccgagttcaagcaattctcctacctcagcctcccaagtagctggggttacaggtgctggccaccacacccggctaatttttgtgtttttagtagagacagggtttttccatgttggccaggctggtcttgaactcctgacctcaggtgatccacccacctcagcctctcaaagtgctgggattacaggtatgagccactgtgcctggcctctaattcttcattaaaggtgacatagtcatttctggagcttaagctgcttcttggggctaacacagtctatttggggtgaactgacagtcttttaggcctatctccttccctttccttcccttctgtcccccgcctggcatatgaacccgggggacactaataggatgcagtggtaataactagggtgcaggtgtctgcacagtggcagaggcattggagatgtccctactctctattctggcttcttttggtctccatgcccttaggtcccctgccatggtggtcaggctggcatccttggtgtcaggctggcatcatcagtgctgcctgtctctggtcttgggcacctcaccttctgtaccccccaaccctatctcagtcccccttaacctttccacacccccaccagcctccacccccaggacactcacagacctgtgtaccccagacccctcctctgccctgctatccccaccctggggggcatgtcggggatcagacccctgcccgtgggctctcgtgctcccttcaacctttctgattgactcctagaggccaggtgagtccaacctcaggcaggtccctccagtccatcccgttgccgacttgctgcttacaaagggatttcctaacgagaaagctgcccttcggcctgtaggagctgtgtgctcaggcgctgagctctgttcttgctttgtaaaaggaagcagagcctgagacaaggattttgattcaggtcgtttatttgggaggggagaccagggaacccygatgggggcataaaatggggaagagaaggcagccagtgccgggggaggtattgaacatgttactaagtgggtacctcgggctcaagtctgctgaggggctctgggagacggtgcagagctttctcctccgacccccaccagctgggtgcctggctgagctgcccctggaggcgtgagtccctgtcagttctgtctgcttccttgttagccagagaggggactaaggtggagagagccggcaggcttgcctgtgcgctatagcaagtgcccatagcaagctgtggcttttatcattgaaaattttttccatcccaacaaagccagactttcaagaggacagtcttgctgtggacacaaagatgtggaatttggaactcaaagctggttgtttgttctaggttatatccccctgtctcagctcacgccgttctaacaaaacaccacttgccaggcgtcttaaacaacaaacaattattctcacagttcggcaggctggaagtgcaagagcaaggagctgggggattcagtgtctgggaggctcctcccaggtggcaggcagctgcttttttgtagtgtcctcacgtggcagagagtgtaagctctggtctctctttcacctttttttttttttttttttttgagacggagtcttgctctgtcacccaggctggagtgcagtggtgcgaacccggctcactgcaacctctgcctcttgggttcaagcaattcttctgtctcagcctcctgagtagctg

SEQ ID NO: 12233 - DNA, 57139 bp, Homo sapiens
gggcaacaagagcgaaactctgtctcaaaaaaaaaaaaaaaaaaaaaaaggtgggggggcatattctctatgtagggtgtgtggcctacccctctgcttaagaacattataatgaagcttttactttaaatgttaaatgttcaaatgaaatgctacagaatattttaatgagttttgagtgagtgcccaggacagcacttctgtgaccccttaggacccataatggtatctagggtgatgctttgtctgaaagtcaagggtcaatccaaagttcttcacttaaccaggggcattctctctgaacctcagtctaacaaatggggccaaccatgcactcttgtcccttcctcctgggatggctgtatggatcaggggagatgaagcacaggaaaacactttgaaaagagctctacatctagcagaggctgtattgaggggaggttgagggctgaatgctgtgaacttagctgtgcactggggctggaaatgggaagtggctgaggccttttttttaagctgggtgctccctataacaccagctaccttttattgggtacctatttgccataggttttaygtcaatatctcatttaatttaatccccaggctgaccccactgaagcatgatgggaaattacatacagacctgaagtcatgggtgcaaagagaaggcactggtgcatgaaaataagagggaggagaggaattcaaacttcggaggtcttcccttgggtggtggtgggtggggtggggggtagaaggcaatacctaatttgcccagaatgtcagtaatgtgtgaaattatgttcattcatccgtttttcatttattcaacaaacatttattgaatacctattatgttgagacacaggacaagtgctatgtgagatttatttttccttgtatggtttctgccctccagaaatttacaaatcctatctgccttgcagatactatcaaccaacctatctacttttcttccctccctccctcccatctcccttctatctatccctcctagaccttgttccagacagggactaggaagcttgaaaggactatttccacaactttgggatcaggccaacttcagtttgatttcatctctgtcactaaggggagagccaggtgaccttagatgttatatcacctctctgggactgttaccatcttctgtataaaacagggatacttatggcggctacttcacaggcctcttgaattacatgattttatatatatatatatatttatttatttatttatttatatattatttatatatatatttatatatttatatatttatatatatataaaatcaagcactagaacagtgcctgacacatactatggacactgttatctaatcctcatagcaatcatttcactgaggacaaactgaggcagaaggaagtgaagttgcttgtccaaggcctcaggcagtcaccctcaaagctgacgttctttagtaacttggccaaccatgtgaccccattttacaggtaggaatgggatagagcatctacagctagcattatggcgttaagtgctcaataaatgatagtaattttaattgcaaaatcaaaatgagatcagatagctgagctcgctgctgagagcctgcaagccagacagcccccctgcaagccagacagcmcccccgtctccattcctgtgcctcccaggggatcactgggcaaggactcagtcttcactctcttcatccctgcccttgtcccaggaaggatagggacacaatggccatttgtcaatgggaaattattttggtttaatgacatttaaactggggctttgtatagaatttctaattacaaaagcagtgcaagttcaatgtagcccgtttgggggaagacggagaaaagattgaaatcctggtatttcagtgcccacagagaagcactgttgacatgtgggtatatattctttcaatatttgaatataggtcaacagatttgcattaagagttctggataattagaaagcattcaagtgttagaaaaggacggctgtcagcaaggtcctcatgttcagcagcgcatgtcccgtctggtaaatggtgccrtcattgttcagtacacaactttcacagacacacagaggagccctggctctcagtgctcacttacagtggccctaacttttactcctccccaacatgccaaggagaagtgtcatactctttgggaacagtggcttctgcacaggcatgatcgtggaaaggaggggagggatgaaggactgtgcagtcctccaagagggcagatcagaacgtctggagaaagaacatcagtaatctagaaaagcaaatcaagatgattttaatagggaactccccccttatagtgattcactaatctgttcttatagagggaaattgagactctgagaggagagaatttactcagtcacacaataagtagccagaggtcaggcagaacttgagcgcagggcactccctaacttagtccagtcctgcaagaatggaatcagaaagatgtgggttcaaatctcaattctttaacttattagcttttgttttgttgttgttgttgttgacattatctgtttgcacaggctgagtgcagtggcgcgatcttggttcactgcaacctccgcctcccaggttcaagcaatcctcctgcctcagcctcccaagtagttgggattacaggtgtatgccaccatgcccagctaatttttgtttttttagtagagacggggtttcaccgtgttggccaggctggtctcgaactcctgatctcaagtgatctgcctgccttggcctcccaaagtgctggtattattggcatgagccaccgcacccagctaacttttgacttccaacaaatcatttaacctccgagtctgtttcttcacttgtgaaataaggttaatatcttcctcattagatttaaatgagaattaaggggggaaaaaaaggcttttctaacaagtattgagtgctagatgccaggtacagataatgcacttcacacgcattatcttttaatcctcacaataaccccataagggaggaatacaatttttatatacactttacaggtgaggaaactgaggctcaaagagctgtagccacttgcccgacatcatgtagctagttgggctgagatttgaaaggaggcctgtgagtctcagaacaatactatcctaacacataggtaagtcttagcacagtgcttgcaaaatacaaacgctaactaaacagcagccctcattatttaytgtcattattgtggatataattattatgttacaagtaattggctggtctctgtttatgtttttttaaactttgttttttttttttttttggaatagctgttctgttttaaatctcctctgcagaggaaccaagagctgtgctgatccatgaaggggaagtaggtgccagccttgctcagccccacaggagcaggaagggggcagcagcaaagcacggggagtgtctctttaaaggcctggcatctctgggttgttgggatgaaggcctagaaagcacttgtacctcctgcctgggaggtataattcctactgaggggcctggtgaccttgcaaactggctcatggcgttcctgcctacctagcccagaccaccggtccttctatcccatccgggacacttctgtagccttcctgtgtgtggagacgtagaaaccctctgccctgtgatttgggtctctgctgatctctgaagatgggtgcgggtgatgaaagaggcaaaacctagaggcagagggagaggacccatttttaaaaccccagcgagcacagacacgccacctggaatcccagcctcccctgagcccagtcagcatgagtcaccccacagcccttcacctgtgggttgcaacacggttgacagaaactccacagccttccatgaggtgggcagacaggtacatacagaggagtgtgccatcctttggactgcaataagctttgcagttacagttggcaccaaatagcccttcagccaccaataagctctgtgaagtggttgggcacccaggctctgctctcggattaaatcccagctctagctctaccactgcctagctctgcagcttgagtagtttacttcagtattctgtacctcagtttcctcatctataaaatgggggtatcaaaaatgtctatctcccagggttgctgtaaggattaggcgacacaatgtatgcaaaggcgcacaatgcccggtgcctgtggtatatgaagcacctactaggtgccagacactggagattccacagtgagcgacacaaagtctttgctcttatggaatttacattccagaggaaggggagaaagacaataaacgattagaaaaatatcataggtcatattacattgtatcataagtcataagggctctgcagagaacaaaaagtagtgtgatccagagtgattgaatgtctactttattaacaagggtgactgaagagggctgctctgaggaggtggctttattagcaattatttactattatttattagggtcccctgggcttcccccaacacagcctccagggagaaaccaatctctgagagttctcaaacccagtaccccctctccagagccctgaccccaccccaagagggctcctttgaattctgactttaccctgaaaaacctccataaattggcaggggtagctgaaacctcacttgccgttcccagagaagagagagaggagtgggccaagttgaggtttccaggaagacacagcaaagagataatttgccaaaaggggaagggtgggggaggggagaatagaaagagagagagggaaaaaaagatgccaagatctctggcttagatttaatttcaaactaatcctggaagaagctctttaaaaagctcttacattctcctgtttgtgtttgtggatattctggggtttaccaagcttgttctttatagtagacagctcacagcaattactccacaattacttcatctgacaggcattgaatttctcccaagttcccaatacagaacgaagcacttggagcctgtgaaatgaccagctggctgaggcttcagaggagccttcaacttttctatcccttctgtgctgaccagaggtatgtggcttgcccacacccccttcacacycaataaaagcctgttctcctttactcccycaccccctgccaccaacacacaccccccagattgtaaactcctttagaacagtaacccctgttttttctggcctcagtttctccagaacccagagtagggtctggcacacaacgggtgctcaatgaatgtctactgaattgaggccactgacttcagcccaaggggcagccagacttggagtgagatgactgcagattggatctgggctgggacctcgctagctgtgcccttgggcaaggcactttgcctctctggcctccatttcctccctcatctgtaaaatatgtgttgaagaggaagggggaagcgataataaatctaccacggtaggttactttaagaaccaaaagaagtcacttgagtaactgcaaaagattattcaaaaatattaccttaaaggggaaactgaaaaaaagggaacttatacaaagatctacctgggaaaagttgctctctcctttgagaattccccagtggtacagaaggagggggcaaagaaatttgggggtggggatgtttctgggtatctgggacaatgactagaaacaggaatcaagttttcctttaagccaagttatctgtttgtccctgtacttttcctctagttatcttgcttctttccaacattttcttctccatccctcctccctcatctccaccccccaccccctcaccaaggaaggaattggccagctccacccagccagtcccccatagctccgccctcctcggcgggctaagagttaacagctgcacctgttgagktatacctccagtcgccggcacctgtacctgtagccaatcagcgccagcgctgctgggaacctacctgtcagcaaaatctcgacacccaaacctcaacataaatcaaacactttcccgggcagagaatgtctgtgtcaggcaagaattagagacaagcggtcagcagagcctcagtgctgatcgtcggagcttgggagcaggaagatgtcgaatgaacttgagtgagtaaacatcggtggatacctgccgctctcagagcgtggaggctggatggggtttcctggagggggaagagcggggaggccggcaccgggattcacagagcaatttgtaagggtaaatgaatgggctgacgatcttactttggcgtgtcaaggcaagccccagtctcaagctagaggtgagtgtttccctgggaaaatagtttttctcattctctttgctgagcagtttcgagccaggcagggaaacacaagactgaaactgtgaaggtttctggcaccactttttgatcctctgaaggggccttggaaatcagacraccccaatcccatcgaggctttctatcttcttgccaaaaggaacttctttaaggtagttctaagagctgtcttaggcagagagttgggtttctctaaagggacttgtttgctgggttggaacagtcccaagtgggaaggttacagtgtggtggttaagcatgtgtactctttgtagtgggcttgacctaagttcaaatccaggctctgtccctgggtgatctcagacaagacattcaatttttctgggcttcattttcctcatctggaaaatgggtacaagaatgctttgtagaattctggaaagagttaagtgtgataaatgctgtaaaatgcttagcataaagctatggtctgaagatgcgttcagtaaaatgtggttcctctcattcagaggcagttctaaggctggggaagatgagaagtgatttttggtaggtcacctcttttggctgggaggatgcatgtgccttcctgcccacatctgagatttaagatcctgactgactgatgctgatcttcaccatgatgtccttcttggggtccagaccttagagaaggtagggtgaggctgggatctgggctgctttagattgggttcagggagctggcaggagaagccagaatcctttaaacacaggctctccttttcctgccaccctcagaggtgagtgggcagaggcaaggattgtaccatcttttttctaactgctcctcaacagacttttaagaacttgaagatctgtgggcagacagcagtgctaggtcctgactgcagaccggattctatgttctagctagcccttcagctcttcatgttcacagcacaatcacttgggttaacaggcacatttcttttgaatgaatttcccggggttgacaatgtattgacaattggaccgcaatgagaataagagcaggagcattggtactgacacctgggttcaagtcccagctctagcacttatagctgtgtgatgttgagcaagtcccttaatcctcatctgtaaatagtggccaacagtagtatccacctcatggggttgttagaggatttgacaattttagaatagtgattgcttttaaggctggtggagaacacaccagtaacaccattgtcatttcatgtagaactaaccaatcaatgagcattcccaaacctcttgctatttttccatactttgaacgcgcaaaaaaatcttgacatgtgtctccatcccacttaaatttgctggctaaaactgcggaggctacagacagaatctattcattactgcacgttagggggtatgtgttctgaagctgggttacttgaacagaaaggtttcttgcttttctcctccctaatggtttggatttgaagtcagatccgctgacagttgaggcttctcagtttggggtggggtgagggaagccagttgcctgctgagtaattgcaggcggactccaagccaccatttgagattacagtggcagagcctgggggctcagctgcccctactggtaaggggagggcacccggcgcttggcttgcaagttctgagctgctgttgcttctgcggcctcgacattctcctaaaaagtgccaagttaagaggactggccatagcttacagcttgggccctcatggaatggccaactctggccaggccttgatatagtggcaaaagtgggacttgcctgtcactctaaattctgccacttaccaacagcaggatcctggtgaatttgtttgtcctccctgaccctcagtctgctcatctgtctgtaacacctacctggcaggaacaactgtgagctcccaaatgtggaccagagctccatccgcgcccgcccggtggccaggccccgggtgtaaggcggcacttcgaaggctggtctctgagaagcatggaggccccggcggtgtagttagaaaccagctggaggtggctggcgggtgctgagcgccgggcctttcatgtggtcgcagcgctctgggtgcctggagcccgcagccctgggcagccccgggctaccgcagggcgcaagggatcctgggctgcggccgagggcgccggaagtcgccgccgaccgcctgggtctcgcaggaaaacagccggcgcccgcgagctgcccagcgtcgggttttcctgaaggtgcgtcggggcccccggggagctggagccgcaggcgacctccccggtgacctgttgttcccctctggagggccggccggcgctccaggcaggccccgttgacagcccaggaagggagagtttcgccgcaaaggggcttggcacacagtaggtctaaggcaccgaggcaggagcgtcccccgcggcctcgctccctgctctctgggccccaccgctgccgcctggagtctcccctcagcctcgcagagacgcgactcggttgggggaaggggactagaaccgtcgcagtcctgaccgcggccgccgccgccgttctatctgatctccaggagcgccggctccagactgcctggagcgctgaaagagttaatcaggaacgcctccccgctgtggttttgtggtcgaaaccatgattgccaggagcaaatttttgtcgtgcacgaggtgtgttattaaaagtcggagctacgctgctgctgaatgaaaagttaaaagccctctttgagttcgggctgtaaaactggcggactgggccgagaggcttgagccaaccctaacggcggcggcccgggcggcgcgggggtcctgcggctccgccagctgctgggagcgggcaggctgcgcagtcccagcagtgagtggccgcagccaggcggtcggcagagctcccactgacccaccggaggagtgaagagggaaaacggggctgaaacccagatgggatcatccagctttctcttacgttagaacaaaaatgacagccaacatttatggagcgctgactccgcatctgacattgtgtcgagtgcttgataaatacacgctcttctttaaaccctcccaacaaactaatgcgggatgggagtgtaaatgcagttttgccgaagaggggacccagacytggttcaggcttgcccaaggtctcacggaagcactgggatcttaaccgggtcttagccgagcagccataggccaccccgcttcctctgtgcttagcctctgaaaagaagacagaggagatgtgccaaactgttaagagtggttatttctgagcagaagaatgtggatgaattccattcttcctatttttctgtaggttctacatgttatatatttgttgtattttacaaacctatgttacctttggagtcgttaaggggaagagagggagtcattattttgaaagagaacacctagaacagtgttctcaaactgtggtccgtggaccatcatcatcatcatcatcacctgggaactagttaaaaatgcaaattctcagccccaccctagacctactgaatcagaaactgggggtatggctcagcgttatgtgttttcacaggccctccaggtgattctgatgcgtgtccaagttgtaaaactgttggcctagaagaccaggcagaggactgggaagcaggaggttcccaaatccactactgacctgcagtgtagttgctgagtcagcaggctgagagcttagttccaagatcacacctgtgttttaagcccagctctgccacctatagattgggtgacttggatgagctccttaacctaagtgtcagtttttgcccatgtaaaatgatgataaaaatacccacctcacaaggcatgtatgagaataaaaaggcacaaggcctgactctatgaaataattgagttcctttccctctcttgccttccctcccctctctggaactcagctttcctatctaaaatgccgcaaataatcctggctggctgcctccccctctctattccttttgcctcctaaaaaggttagaacaactgacctagtgaaagtcttgaagggaaattatctctccgttatttgatggtatttctctaggcttttccaggaggtcagcaagaattgggaactttcaagggcagggaccgaaaggggacagaacagtgtagccacatgaatggcagtggccttcaccttttttgtcctcagcacccagtacgtggccatttacagagtaatcctcagtgaatgtttgttgagtgaatcagtgagtgaataaatgaagggatgtggcacccccgggtttacaggtggatttcaacttctttcacacctcagttgaacaatagatggggggagaaaaggaaaattagacaagacaccaagaggagaatatagcatgaaagaaaaattcccatacagggaagaatttttaaaatagcagaaactcactttcttctctaattaggaaagggcacctagataatttacatgcaactaaaagtgtctgctgcagcctgaccaccgtcaacttgcccacctgggtcctgacgatgaagctggtagtgcgtgttcctcttaagtggaaatctccaagcatcaggatgattctgccagctaggaagagatatcccgattcataggctggaaaaggctgtgaattgtgcagtttgctggggactaccccacaaagtattagtaataataataaaagtagttcacattgttatgtgctggcactatgctgatcgctttacctgcattacctcattgcatcttccaacagtaatacttcacaaagttgtaaaaaacaaagacaatgactagaagttgttagccagcacccggtacttggtaatccctcaatgaacggtagctctcatagcaattctgtgaggttagcattctcattgcctcacattttgcaggtaagaaaacaggcacagagatgtcaggttgcttgcttaaagtcacccagtaagtagcagagctggacctggaacccaggtctgcaaagctctgggcccactcccataacgatgagttcatactgcctcatgcaaactggagtcattacagagccatgccctacactctgccatttccccattgaggcccccaaatgagcccccagcccatgtgacgaggcacatttcacaatctgtacacccagaaaaccagatgggccactggcaggcacgagaaccctggggcgcccctgtcgtgcccagggaacatcgtgtgtggggctgactggaaaatgattcctctgtgagcagttgtgtcagggcctccctgtgggtgattagagagtgattgatcactgttaatgaggttgggtggctcatggcaggatttagcaagtcattgggagtatctgggtgtcaacacccagctcaggcggcccctggaactcttccttctctggctgaagggaagtggggtctagcctgctggatctgtcctgtgccacacaccttctttggtggagcttgagaccacctcctttggtgttgggttttcttcccaccttctggaaagttgagtgagtactttcttttctgtagcttaactactgagtcccatcctgcygtatgctgcatgtccttaggcaggtgcctctctggaactagacctctgaggtctgtctgcatcctaaattgctaggattctaacagaaggaaatgataccaaaagttctcaactgatggctgagacagcatttccttggtcttattgggggttttaagtagctcagccagaaagcagtgggcattttgactcagaagagacttgttgggatgaaaccccactttaccactctagactttcaccatcctggtgcccagaatgaggcatgttggagccatgaaggctgaggctgactgggcatggagcagctggcaccacacccctgttgtgccgagtgccagtgaactggggaaaggtcccatcccctcctcccagagcactggccccggcaatttgcacttcctcacagactggacgggaggcctcaagaagtgaggcctatcaggtagacccctgagctcctctctcttgatcttgttgcctgctctctcctaaatggaggagaagccagacggggagactctgaggaggcggctctgtgaaggttctggatgctgggagccagagacctcagttctaggcctgatgccttgaggtacaagctcagtggccttaggcaagccagtggccctctccatggctcagtttttcctcaaatgaggacagtcataacttccctccctacctgacaggggcgttgtaagatcagaggtgatgacagatgtatgagaagcacattgaaaaatataacactatgcaaatgtgagggattatcaaatcttggatttcctccttagtgggctggctttccttaaaacaaggtggcatatgcaaagtacctggctcacacctggcacacagtaggcggacaagctctgggagctgtgccaggctgatgcctttgatcttgcctttcctttgatctggaaggtccaaggtcctcccaactcatctccattctccctcttcccctccacccctcttctcctccacccctcttctcctccacccctcttctcctccacccctattcccctccacccctcttcccctccacccctcttcttaaccaacatccgtcactcccttgggttcaggcaggtcagaagtcctcttgtttctttttcttcatagctctcttcacccatctaatgttaactgtttgtttttgtggtcatgtaggtcttactgccactaaaatgcaacctccgtgtcggcagggatgacctcgttatcttattctcccaggacaggttctggcacatagtagttacttgataaatatttgttaaaaatgagggatggatggttacgtggatggatgccacccaggtttattgctttttaaatctctcctacatcccttcttggaaagtagtagttttttccctcttgagaaagtgctagccatagagttcccaggccagaccctaggagtcctggcttcactcattcagtaccctgcaacaggtcacctaacatctctattgtatatttcctggtctgtaaagtagggataataacacatcatgtatgttgggaggctctatgagataatggaagttgggcaaggtgttattacactatctcttttgtttcttttgaacagaaccccattcacagacaggaggcttgtgggaggatgaaaatttaagaacctcaggcagagtatcccctttactcccatttggaggttctgggatgatgatggtgatgatggttattattaactgagcaattattctctggcaggctctaggttaaacacatttcctaccttaatgtacttaattctcctaacaacccatgagatgaaccctactgtaaagtagccacccctattgactctccattatcttactatgttaattttcttcatagcacttattactaactaaaaataactaatttacctacttgtttatggtctrtcttccccaattagattgtaagttccatggaagcagagtcttatctgtctcattttagttgattcccagtgctcagaagagtccctgactggcacactggcacatagaagacactcaatagacccatttaacagatgaggaaatagaagggctaagtgccttacccaaggacatgtagttaacaaacccatacactgtgaccctggtgctgcctccttctatgtgctgcaggttcaggtgtgctgtgtctggtagagatctgatggcaggctatccatggcaggtcttccctcctccctcattttccttttcactttctgatagtttagttcagtcttggacaaggacaccaacagagagtttgtggaggccccagggaagctgacctcataggttgggagtcccctggtttcccttctttcttctggccctatcacccatgagtaggactcactccttcttagaactcttttcacattgatccagtatcagctcctgggacaacttatttttttccccctctctcacctactggctcctcaatccttatttgtaatctttaagagaccagagagccaaaagttcttggattttaggattcaacacacaagtcaatactaaccttattcattaagactttctagaagccaaattcttagttctagaacatgaggttattggtggcaggagcaggcatgggaaccagggcattgggactcccagcccctgaccagaaactcttccagtcatcatcttgccgccttcctcctgccttgtgtgggtrggaaattcctttctgccttgcaacagagaattagttcaatgtattttgagaagggaaatttccagaataggaaaggcatctagaaaagagactagcacagggcttgaatgctttactgtgtagtccgacagctccaagttcaagctgagcctccatcacttattggctgagtgaccttgagcaggtgatgtcacctatttgagtctcaatttccccttctataaaaggagatgataattcctatctctcagggctgttgtgtggagtagatgagatgacacacaaaaacagatggcactatgtttgccagtggtaagtgtttaaagtacagaagctgctgtttatcaaggaatcagactttgggataccaacaagatagattggagaccttataggccaagagacccacccaggtgaatagcagacattgtctgttcttttgtttcggtgtcactttatcgttgtcttctaaaatttatcttttttaaagggtaaggtaactcacagcatcaaagctgataatggtcaacccctagagtcagcagattggggctccaggcccagacctgccactgacttgcagagtaaccatgtcttctaccactttgcaaccccttgatgtcttgccccaagctgacctggaacacagtgatggcttgcatgaattacacacttgttttgtgccagtcagagttttaagcattttcttgtgctgatgcgttatcctcatgatattatttggtgggtgcttttattagactcgtttacaaatgaggaacagtgctaagcactggtggtccctgttgayccagggggtgggatcagtcaggcatttccctgcttttcccatgcctcgttggttgggagtttccattagctccgggctgggcagacagtgagggtggccaccctggacttgctcagtaaattcttctaaaccccaggcccaggaagcaatgaggaggggcctcttctcacctctccttgaggccccttgatttatagcaacagaaactcagggtgtgcctcccgctctccgcacccctagaacaggaaagtttctgtcatttctctttcctgcgtgacagctccacctcccttcctctcagagcccagctcctcacaccttggggcctggtgggatgggagacactgtcctggatgaagccgctgggagagctgccgcctcctgtatgctgaggtatggcctggcctgctgttcccactgcagtctgaggatatgggccctagtggcctggcagcaggagggtacttcatgcacctgattacaggggtctctgcccacccactagtctgccactgtgccacagttttaccacaaacacatttttctgctgtgataaagactgcacccctgcatcaacggaaaagcagtgtggctgcgtggcaagtgtgtgcctttgtgctcgataaggctgagttgaaatcctggttgtctcacggaccagctggatgatcttggacattttctcgttctctgcaagactcaggttcctttatcttaacagacgaagcaaatgatccttaccttgtagtgtccttgtaagaagcacggcctaaygaacagagaacattcatatgcattatcgtaaatggcagctggcattgttcttaggtccctaacatgggagattctgcctggcccatgtagaaagggaggcactgggaaaccaggagaccagccagtgcccacttcatctctggggctctctcttcatagcctggaccaccccatcttcatacactctttgctctaaattgaacacaactagaacttttctgcttctatgcctttgtttgtggttaagagcatgtgcaataaccagtgattcttcaaaatgtggtccccagactaccagaatcagcagcaccagggaaatcgctagaaatgtacattctcagccacccagagccagtgaatcagacactccaggggtggggcccaacaatctrtgtgtttttaaattaattttaaaataatggacatataataattgtacatatttatagagtacagtgtgagatttcagtgyacctttacattgtataatgaccaaatcaggataattgccatatttatcactttaaatatttatcatttctttgggatgataacattaaaaatctactcttctagatatcctgaagtatacactacattgttctttgctgtagtcaccctgctgtgaaagcgatctatgttttaacaagccttccaagtcattctcatgcagctaaagtttgagracattattctgtaccattgcatcaccctgaaggagcttgaatcccctctgggccactcacttactgggaccttggacaactctcaacttatctgagcttcagtttcctccactgtataataggaataataatagtatctgccttgcagggttgtttcaagtaacatggtaatttatgaaatgtgcttagctagtgcctaacgcatggccagtgttcaataaagagtagctattatttttccattcttatttttctgttaggtccctgctccttccccacattgctgagtgaaataatccccagtgctgagtttccccaactaaaatgtctgcctgctccagaaagcctttyctgatctctttcctttgagcccttgtggcttgtctcttgagcgagataatgccttgtatttgtccaagcttctcagcaccagtacccgggtccttcctgcctctgtgtgccctgcagccttcaactccagttcctggcttctgagcaactgctcaaaactctacaataaaattggcctgaaatgccatttcccagaccaggttctgcctaagggcttcctcgccctggctctctctgtcatagaccacgctttctcccagacttgaaatgatctacgccttctgtgcctttcacagtcttgaggacaacttcttcagtagaactcatgatgggttatctggaaattttattcgtatcacattgcagcttatcattggcatttcccattcattacacgaattctctttgaataagtacgcactatgaaagtattttattgaatccactctgtagtcttgaagatcaggatgatggccttcatgctgtggaagagggaactaaggcccaggtcaacagcttctacatggcaacatttggaatcgatccagctccagagtttgtgtccattctgctgccccacactgcctaatggtggcagaagaggcagtttcatgttttcaaagctaataactctgaattcctgggcgttggcctgcggctgcccrttcacggaccttcctctgggatagcctaaatttgactctccttacttgcattcagtttcaggtctgtgcggctgctaaagaacgacccagtcaacttgcagaaattctcttacactagtgaggatgaggcctggaagacgtacctagaaaacccgttgacagctgccacaaaggccatgatgagagtcaatggagatgatgasagtgttgcggccttgagcttcctctatgattactacatggtacgtctacccsctctggacatgccccgttttgactgaatgggtgtcttcacttcaggcctcatggctcagcagcccaccatgaccaccccagcccctcatctctgggcctttgcacaatgctgttccctctgcctggcaccctccctttcccatggctaacccctactctcaacttggggtctcagcttaaatgtcacttcattcattcactggagaggaggctttcttgtctgggtgccctcagcaaccaccatcgtcgtccttgatgccatcaagaatgcttagaggcttgctgtttacacatttatttcttccatcttctgcacgagactaagctcctagaggatcattactgagtcttcagcacaccatacagcctgccacacagtctgtgacacgtgttgaccaagtggacagtgcctgacccactcgttgcctggtccaagcacattctgtgacagcaacactctcataccccaccatcttctttttgcccctgtcctcggatcttacgtttccctgtcatcccaacctacctggtacagccccaccacctggagtatacctcctactctttaacccattcccttccttcggggccttcccaaggcccaccttctcttagaagccatctgccacctcatctccctctcctgagggtcttactgtctttcctactccagctgccattatgtcttttactgttctctaactacttctagggtcttggccttgtctctgagaggctgtcagctcctgagaataggaattaggtcctcccatatctgataagtaggggttggaccagtcaggaatcacgagggtataacacatgacacaacccccctcccacctccagtgcgtgtgctagacattgctaatggattgcagcctgcattctcatgaagggcacaggaggctgcagaatctttgtcaatgtagtaatccaggtaggccctacttatctgtctgaattgtcacaagacagcaaactgacttgctgtccctgggctgggtaactgctccaagaaactttcctagattgggggatgggggcacacagctagccaattattgagaaacttgaagatttaaagccaccttgtacagaagacctcaaacttactagcccaagaagtgttttatccactctacctcaagaataaaggcaaattctttgtttgaactgagaggccaagtgggttccagataggagaaagcccaaaactatcctctggctttggttctccttctggagtggtctggttaccctacctccctcctccccggcagactggtggcatccagagagtgttcagcccaggtcgayggaagaggagtttgaatggctgccttggcttggggccatggtaggagccagaattctagatctaggttcaaactgcagcctgggatttataggttgaggatcgaccatcagatacaatccaactccttgtccccttggcaagaagccattccagggccagtatggtagaagagaggctctgaaggtgacattgataatactggttttagcgaagtacagtgtctcagtgagatacacctgccctggcctccccattccagagcactctggattcagagcagccccctggacagtgatgacatggtctgatggtgtggaaggagcaccaagtcgggaatttgagacctagtcctgccacaaatctggcttcgggtaatatagtgctaaaggcaactgcttaccatttcttattgaatgtccaccactgtgtcaggcactttccttcatactctcttggggtgattaagagtacaggctttggaggctatgctgggttggggtcctggttctagctgtatcagccttagagacaaatgcattagaatgttctaagatataacaatattataattatactcatgaaaggtcacatttatatagtgctctccatgtgctaggtgctattctgagtgttcaaagtgaccccctgagtttggtattatatgatgatctctgtacagatgaggatatgaggaatggagaggttaagggacttgtgtaaggtcacacagctagtatgtggtaggtctaggaactgaccccaagaaagctggattcagagtctatgcttgtaagtactaagacaatagagtctctctgagcccccatttcctcatccatagaatggtgatgatactagtagacatctcagagtgactgtgaggattaagagatgagaaggcacttagtacaatgcctagcccatatgaagtactctattaaaaaagggagtattttttattaacaaatattcataatcccctttaagtaggtattataaccactcacttgacatatgaagaaactgagtctcagagaggtgtagtcatttatccaaagtcacagtgcactttcaagtggcatttctaggacttacgccaggcctgcctgactccaaatttcatgctccttaactatcaagcttgaggttcttcttcccactccctgacttggggctcagactaatcatagctagagctccagccagtgggaaggactggagggttttctagtgagcaagtgtattagtctgttctcacgctgctaataaagacatacccaggactgggtaatttttaaaggaaagaggtttaattgactcacagttcagcatggccagggaggcgtcaggaaacttaaatcatggaggaaggggaagcaaacacatccttcttcacatggcggcagcaaggaaaagtcccgagcgaaagggagaaagccctcttataaaataatcagatacgatgagaactcactgtcacgagaacagcagcatgggagtaaccacccccatcatgcaattacctcccactcccatgtgattatgggaactacgattcaagatgagatttgggtggggacacagccgaaccatatcaccaaagttactcccctgcctggccaaagctgcaggaggggattgaggctcctaccagcagaagcttagccatgcataaatccttcctttctctcttctcagggtcccaaggagaagcggatattgtcctccagcactgggggcaggaatgaccaaggaaagaggtgaggcttgccaacaccctctgcctctttgcccttccccacctccacctggagcctcttccacacaggtttgacttatccattaggcacaggaggcacagtgctgagggcccacaacacattttgggattcatgataatgttttcatttattttaaaattaaaagaaaaaaatcaatataatccaacttggattatattcatctttataccattgtacttactaaagatattttwaaatgttttggaagaggccagtgaaggcagagcctagggctcttgaaagtcctaatgaaactcagcttgaaaacacacacacacacacacacacacacacacacacacacacacacacacagacacacaccccagatgcctataggccatgtgggctggagtttactgaaaacaaacttcaaagccttagtaatagaaaagccctggggacagcttttctttctcagcttcaaaaccctctcccctgaagacccacagcctctgggagagggagacctgtgttgggggagggagacctgtgttgggggagggacatctgggttcccatacttcttcccctggcattagtgccccagggcattgatgttcctttcctttagaaagcggcccaggccatgcttaagactagatgggcactggaaagaccttgtccctctttctccactttctccttcctggccaatcaggtgacttctcacaaatgaccctgtagggcctctgctgggaagccttttgaaaaattcaaacaggcattgcagctcatctcataacccagcctgggcctgcagctggctcagggccagtcccctccactgccaggaacagtgggtttgggtacatggggacctttctcaaaactaatttttttttttttttttgagacggagtctcgctctgttgcccaggctggagtgcagtggcgcggtcttggctcactgcaagctccgtctcccgggttcaagccattcttctgcctcagcctcccgagcagctgggactacaggctcccgccacctcgcccggctaatattttgtatttttagtagagatggggtttcaccatattagccaggatggtctcgatctcctgacctcgtgatccgcccgcctcggcctccctaagagctgggattacaggcgtgagccaccgcgccctgccactcaaaactaatttttaaaaatatcattagctcttctgattacaaaagcaacaccagtctcttgcaaaagattcaaactcttcagaaatgtataaagtaaaaaaaaaattcctataatcctgtacccctctcccgcttaacagtttggggtacatccttccagatcttttcctaaacatgtgttaattgtactcagagatacacgtttcttccaccctccccactttgtacacaccccgctagggttgactcaatacagttgttttgaagtagggacgttttgacacagagacatttgactttggctaaaaataaacgattaaactttcagggttttttttttttttaataagtactgtaatggataaaacagatgttgctcccttaaccctgagcctgtgcttggttccattctcagcacctccctgctcatccctgtggccaattgggctgctacagtgtcttatttcgtgcatgctggatggacctaaacattacactggatcaaaggccagtgtgtcagttgccttgcactctagccaaagacccccctttacccccagagagaagtacactcagccccttttctttctccccaggtactaccatggcatggaatatgagacggacctcactccccttgaaagccccacacacctcatgaaattcctgacagagaacgtgtctggaaccccagagtacccagatttgctcaagaagaataacctgatgagcttggagggggccttgcccacccctggcaaggcagctcccctccctgcaggccccagcaagctggaggccggctctgyggacagctacctgttacccaccactgayatgtatgataatggctccctcaactccttgtttgagagcattcatggggtgccgcccacacagcgctggcagccagacagcaccttcaaagatgacccacaggaggtgagggcgcatccccgctcccctatagcatagatatgtgtgtgcatatacagaatgagagaagatagtgaacagatcagagctttggaatccatgggggaaagcatcctagagctgagacgggattgccatgtactattgtccaagttgtacactgtacaacctgcatagctgtaatgcacagccctgggctgaggcttcccagagtgaatgtgagcatttattctcttggggctgtgtttctctgcagtcgatgctcttcccagatatcctgaaaacctccccggaacccccatgtccagaggactaccccagcctcaaaaggtaacttggtctccctggaccctcagacacctgggcagtgggcaggaggctgcagacagagccccacactgtccccagagcatagcaggcacaatcaattaatgagaagtgggggatgaaggcagatagatagagggagacagaatgattcccacatcctgtccccgggctgtgatagggagctcagaacttgtaccttatcagaaaactgaggttcttttatccttagttttccctggttttgtcacccctcaaggttctctctaattttyattgggccctcattattcagcaggactgtggctcaacaaagccattaaataraacccccaaattgaggaaactggggcccaaggaagtaaggttattttccaaggtcaaacagcaagtctgtaacatagcctcaggcttcctgccccactgccctctaggagacttcctgcctgggagcccagcctcactgtcctctccctcctccctgcagtgactttgaatacaccctgggctcccccaaagccatccacatcaagtcaggcgagtcacccatggcctacctcaacaaaggccagttctaccccgtcaccctgcggaccccagsaggtggcaaaggccttgccttgtcctccaacaaagtcaaggtgcgttggcctggagcagcttcagaaggggtggaatggggcaagatatacctcctccttgggctagccacggaccctggggaaaggctgtttgataatagcccattgccacagggttggggaaactgaggcaaaagggcaggccattggaaccaggctctaggaagaggccgggagtgactgtgaccaactgtgcttgcagagtgtggtgatggttgtcttcgacaatgagaaggtcccagtagagcagctgcgcttctggaagcactggcattcccggcaacccactgccaagcagcgggtcattgacgtgggtgagagccttctcaagcctccattccagctcccctctctctccccacccccgcatcaatcaggcctttttcttactcasccctgtttccctacctggctctgacctctgtctccaggtcaaacaccgtggggtttgcaaggatttgcatctgttgactagaagttgtggcgtcttttctgtattgctttgggataaacagggccctggggaccctagcagtgtgagataaataggctcctgcgatgctggcctgtttgtctccatcaggaggctgatgaagacacaaatgcacaagataaggtgcaggcagcaggttcggaaggcctgaggcacagcacaggacgttcagcttttgggagctgggcgggggaaaggctccctgtgggggccacctggtccccatccctagccctgaaacaagtgggaggcacagcccgccctcaagtcttcagcttctggctcccttactcccttcctggctgtgtgatctatgtcacctcaccttcctgagcctcagtttgttcaactctcaaatgggctgaggccagctgccttgcctgcttacaatgctgatttcagcttagcagctatgtgccctggggaacatgatacacacgggactgtttaatgacttgtccgagaggctggatagcatagcagtgaggagcatgggttcaggagccagacagatctgagcttcagcccctattctgccttttattagctgagtgaccttagccaagtaaccaaacctctctgagcttcgttttcctcatatgtaaactgaatactcaaagcatagttgtgaaggatgaactgagggcttagcatattgtaagtgttgaagaaatggcacttgctagtcctactacttttgctactgctcttactccccctattactgttgttattaccatactgctgctgctgcttcatctgggagaagtcccaaatcacagccctggtgaaaagtataacctctacccccaacatgatgagactatttggcaaagcttgggattccctctggggctttgggcagatctgcttctcaggctggacctgttttcccatctgtaatccagggcacaggaatcccttttcctccctggattgaagtgtggttcttgggggagagaatgtatgcccctgccaagagtgaggcccagttttgtyttktttttttttgagacagagtctcgctctctcaccyaggctagagtgcagtggcgcgatctcggytcactgcaacctccgccttccaggtttacttaggccattctcctgcctcagcctcccgagtagctgagactacaggcgcctgccaccatgcccagctaattttttgtatttttagtagaaacagggtttcaccatgttagccaggatggtctccatctcctgaccttgtgatccccctgcctcggcctcccaaagtgctgggattacaggcgtgagaaaccacgcccggccgagtgaggcccagtttttaatgcctccctcctcaagtggtcccagatcccttccttcctgattctccttctggtctcctgtggtttcagctgactgcaaagaaaacttcaacactgtggagcacattgaggaggtggcctataatgcactgtcctttgtgtggaacgtgaatgaagaggccaaggtcagtgctgagggcagtggctgggatgggactgggctgcctggaagtccctattctggggtagaggctttcttgcacctaggatagtgtcatttgctccgacgagggcactcatggaggaggcaggatgcagtgtagtatggaagcttgggctttggagccaggcaggctgggtccgcatcccacccttccacctattggtccaaagtgtgactttggaccagtgccttagtccctctgagcctaagttgttttgactataaaataggagtggcatcatagtaccaactggtaggttgtagtgaggagcaggtgagataagtaaaaggtggagcacacgcctggcccaaaagtggcaactgttgatattactccagtccacccatttactagatgggaaaactgagccttttgcatggtcacacagcaagccactgggggcacccacgtttcctgacttcttggccagcgcagaatgtcgcatgcaggagaaatgcgaaggagtccggtgaatgagggctcgaatcccagttatctcacttctctgagcctgtaaaaatgagaacagtaacctgcctgctaggattggagtgcagagcccacaagatcatgcatgtctacaaaccggagaggcctgagagatggagcctctggtgatgttttcatgccagtagttaagccrttaagattcttccagccttagtgcttgagcccagccgcgggcttgccatgtgckcatgggcctcgctgtgtcttggtttgctgtttagagagccagcatggtggagaggcactagtgtgggagtcaggagctgagcaccttcggcctgtcccttcccctccctggaccaggcttacctcactcagcagggtcaggtccagctcatctcaggggcatttctggcctggagaggctggggagctaacccctgcctccctgcctgcctccagggatggccaggctgcctggagaagatggaggtgcaggagctcagaaaacacaaagggagcacaaaggcagggattattattattcagactggcaccgggctggaggaggagctggggccttgggttcagggagtggggagtttcgtgggaagggagagatgggtttcggtggggattttctcacagccttttaagcccccaggcttgggtctttctcagrtgcgagctgggcgggggctgcatgagggcagagctggctgagggggaggtatgtctggcatgtgcctgggggcctggtctgcacagccagggaaagaagggggtctgctcagacacacccccccacatcctgtttgcatcagggtcatttccaaaggaaatgttccaaagaccaggggccagcctgcgtcggggggaccggggttcccatggagccccagaggaggacaatcaccaggtgaccttgccagggtttgccccgctgagactgaccccaggygwccatcagttgggcataggctttgggatgagacttccagctgtccctctcatggcaacggttataacatatcaagcctacacaccccacagccacacaagataggtttcattatcctcattctgcagacaaggaaaccgaggctcagtgaggtgaaaggatttgtctgaagccgtatatggctagtgagcggcagagcccagcttcctgcagcagrtgtgggcggcccctcctccaggctcactttgttatgccccacgcctgactccctaggggaacggcagcaattatagccctgctcagagcatctgtttccccggctgtaagatggggtgactaggatgctcccttgctgtatgtggggtgggatcaaatcagctgaaagaacctctcactagagggtcctgctatggctggagtgggtggttggggtggagaggggctgtgtctctgggccagcaggaaagtggtctccttgtgctggggacaggggactcagcccttttccacctccttgtcctgagttgcagaaaaacgaggctctggatcttaagctcctataggactcttgacatcccccccagtctccaccccttgggctgcccttggcagtctagcggaaactgtaccaacagcggtgaaaagcctgggctgtgagtctgggttcaaacccctgctgcaccacacactgccygtgtcacctckggaaagttgccccacctctctgagcattggcttccccatctgtgaaagaggagtgctgatgtttgccttctaggggcctagtgaggcttaagggtgagcagcaggcacacagaaagctagaaatacaggatcactgtgggacggtggggctggccacctgggcaggccacttacccagcggccccctctgtctccaggtgttcatcggcgtaaactgtctgagcacagacttttcctcacaaaagggggtgaagggtgtscccctgaacctgcagattgacacctatgactgtggcttgggcactgagcgcctggtacaccgtgctgtctgccagatcaagatcttctgtgacaaggtggctggactgggcagaccctatactgggtcccggggaggtagaagggccaaaccctgacccgtgcgtcctcctagcttctctgggttgtctgtctctctctgtttttctatcccttctcctccttcccctctcctcctccacccccactcctccatctctctgtctctctgagtttcttcttttctgtcttctgtctgtccgcctctctcatggcctgtagtgacctcaggcaagcagggccaggccccactggccaggctgggccaggtaagtgctggtaccttcccatttcctggtcttgttctggaaaaaagaaggaccagaagcttggcccatatttaagatgcaaagcagcagctgtgaaagtagctagcccctcccaggcccttggtgaccctctctccttctcccctgcagggagctgagaggaagatgcgcgatgacgagcggaagcagttccggaggaaggtcaagtgccctgactccagcaacagtggtcagtggggatccagrgcctgggtgggctcggctggcgtgaaggggagaaggagaccagaggtgggagggacttgagtggagggacctcggggcacattggcttccttctcccatcaggcgtcaagggctgcctgctgtcgggcttcaggggcaatgagacgacctaccttcggccagagactgacctggagacgccacccgtgctgttcatccccaatgtgcacttctccagcctgcagcgctctggaggggtgaggccagggctggggtctcgggaaggagccgagagagggtcctggctcctaggtggggcctgccttagcacagaccagtggggagcagcctgcccctcagccagtttcaagacctttattgaatcataggggtttaaacatgtatatatggtcctatagcttcagtgacctattgtattgaagagaagaatgttatgaagaaacagatttcgtaaccattaaaacgttcatgcttagggcacacaaagaggaggcttctgatatctgaccccaaayttgattgcagcccyatggaattctcacggcagcacttgtggtgctcactgtgtgccaggtgcggctctgagcgcttcccaggcatcaccgtccttacccttctctacagccctgggaagtcaataataatgtctccctggatctgtggggtagaaatggaggcacagagaagttaagaaacctcctgagattgcacagctagtaagtggcagagccaggatctggactgaggcacctgttcagaatccacacctttccccactagctgctccgcctctcaagcagccgggactgagygcctggcagccaggagtgggctgggttccctgttacagctgtcctccgagagactgcacctacccccttttccaggcacggtcccacaacaattcaatggcagggtcaagaccccagagcctgtctcctagtgcgcttccatactggagagtctgagcatttccttcctttargggtacagctccgcactgtttcttcaggaatatttatacaaatggaccttggtgtacaaggcatgtttagtgtattgacttaggacaatgaggtgtagacagtggcgctgagaagagcggccagtgctgacagagcttggcacaggcgcagagcactgtctgtgyccctcctctctttgccatcttgggagctgcgctgtggccccgcagcacaggcggctgtgtgaacctgttctctcttggctctcctcactctctcaccaactagaggccctcagtaaggagatgaccactcagggtgaaggcccctgtggctaggttgacagtcaacctgtgggggttgagggtgggccagtctccacacctgtgagcctgggagaggggaagcccagggcaatagccaacagagagcctgagtttgaaccctgactctgcctcctgccgggcgtgtcatctctagagctctctgctctctctaggcctcagcttcttacctcacaagactgactgatgcctgccccacaccgcacagtgccaggcacactgtagggtccaagaagagggcctctggccaggcttagtggcacacacctgtaatcccagctacttgggaagctgaggccgcaggattgcttcagcccaggaggtcgaggctgcagtgagctgtgatggtgggactgcactccagcctgggagactctttccccccagaaaaaaaaaaaaaaaaaaaaaaaaaaaaagccctgttgcccttgctcccttggccctcagctccaactgcctagttaccggccgcaggaccatctgcaattcccagcccttctgggcatgctggggcccaggtggggctcagtgtgactctgctctgacaacatggctttagcacctcctgtgtgttcattgagtccttgacccatccagctcgggctgggtgattcctttccactcaacatctcaggtcacttaagggcacttgtctgagcagaatgggctagaaaggcattgtaacagtattctccccayctcccaccaaaaatattcctcccagagagcctccagcagccaggggctcctctcattttcctgcgtgtgatggaaaatgtctttttcacttcattgcaggcagccccctcggcaggacccagcagctccaacaggtatggagagaaacaaccacacgcctccctccacacctgtgcaccctccacacctgtgccccctccacacctgtgcctccgccacacctgtgccccctctacacctgtgccccctccacacctgtgcccctccacacctgtgtcccctccacacctgtgccccctccacacctgtgccccctccatacctgtgccccctctacacctgtgcccctccacacctgtgccccctttacacctgtgcccctccacacctgtgccccctctacacctgtgccccctccacacctgtgccccctctacacctgtgccccctctacacctgtgccccctccacacctgtgcgcctccacacctgtgccccctccacacctgtgccccctccacacctgtgcccctccacacctgtgcctccgccacacctgtaccccctctacacctgtgccctctgtaccatgcccactgtaccatgcccattgcccccagcctgcttttctccctgttccttgcaagctagggtgtggggccagaggaggaagccaccagcttctgcccccagcccccaagctagatccatgcttctttctcactgaaactgcctgggtttttatgggtttgttttatgtgaaaagtcggcgaatctctggcgagacacccgcttgtaaaaagggaaaggaaaagagtctgtggtggtgcagattcagagagaagagggaagctgtgctggaggcttaggggatgaaaaccctccatctccttccccaacacacccccactggggggcctagctggggccggcaccccttgacactttggcctaggaagggcctttgtgtccttccctctgtcagtcacagccttagtgccctgagcagtcccttcacctctctgagcctcagcctacacatttgtcagatgaggaaaacagcctcgagagggtgaggagggcggtgtggatatggaatcttcgtaagtgggaaagcactttatgaagatcatttgctgttatgatcagtttcttccctatgaacaaaatgtacttttcacttggtgctttcaccccaaattatgtcacttgtcacctcacaacagcctcagagttaggcaagcagggttattgccytgctttatggatgcggaaactgaggctcagagaagtgaagtgccttctagctgtgaaagtcaccgcagcaggactggaccccaagcctgtcttactccaaagcccccagtccttccacccccccaccccgcctcacatctgacctgayttcttttaaaaaggaacgatgatgatgacgatgagtccacatttattgaggccctcctgtgcgtcacagtgttctaagcgcagtgagcatggtctcctgtggcctcacatccctctatgaagtattgctatcattgctttctcatcatcccattttatacatggggtcactgatgggctaagggactcacccaggtcacacacctagtgcgtggcagggctgggattcaaacccaggcagtccaactccagacctgctgctttacccccactgtccctctgctttgcatccacccttgtgttttcttccccatttctagggcccctggaggcccagcagggtccttgagcctctaggggtccccaagtttctcacaagctcccccactgccatccccacaggctgcctctgaagcgtacctgctcgcccttcactgaggagtttgagcctctgccctccaagcaggccaaggaaggcgaccttcagagaggtgacctcccgccctcctcatttactcaccaggcccaccccagctcccacctccctcatgggctttcccaaagcctccttggggtggggcacgaggcgctgccttaccccttggarctaggtttaggttaagacttgggggtgggggtaasgagggaacctcaggctgcttggagagaccaccacaggactggcggcttctgtctcctgacctcgtgtggacgtgggagtcctgggcagctggcatagtcagcaggctgattatgctgggcgagtcccccctctcccactttttctgatggggagtgggagaagggtggggttttgatgtctggctttcttgctttgaccctctaaatctgttacttccttggggtggggaacaagcccaaacctctgggggctgtagctggccatcaggaagaaaccaactagcagctaagctcaaaagcttccagcagccatgaatcgagctttgcgtggcacctcgtgtttccagacactgccatcaattcccacaatgactctacgaaacagcggacagagcctccattttacatgcaaataaaatcaggctccgtgatgttaaaatcacgtttgcaaggtcacctggctggcaggtagtagagcaggggttcagacacccccacataagcacagcttaagagggtgcatgggaatctgcagagccggccaaagggcctcccagctgggcaaagacccgcagcagaagtcratcttcaagtaacgttttcagattccccagcccctgagatgatcctgttcacattatcttccttgcactcaagctggcccttgcttttcagttctgctgtatgtgcggagggagactgaggaggtgtttgacgcgctcatgttgaagaccccagacctgaaggggctgaggaatgcggtaagctgcctgtggaccccgccccccatggcagaccccctctaggctcctgtccccactcctcaccacgcagttctgatttcccacaggagggaaccttggcatgccggtggcctacccgtcccaccctgtccagggggcctgaggggccctgccggtgggggtgtgcctctgcgatgttatctcccagccagaaccctgactccaccctgggagtcgcacacaccataaatcctccttgatctgatggctgctgtctgacaggccagggttttttgttggctttgcaaacctgtttctgttttaatgggaatggaacccaaaaaggccaggccccagagacgctctctttttctttcccagggggcctcattctgcctgcttgtggttggctgggggccgctggctggggtagctgaaggcaatgtctgtgcaaggagaccttccccagccccccacaccaccagagagtgggcaaaacagcccagtcctgaataaaacccatagccagctttgtggctccaccaaaaactaagcaaacacagcgtccaccagggtcagctgtggctgaaggtggaaccactcggaaaagccagatggtgtcaagatttcaggctggcggagtgaaaatggcatcaaatagtaacgctagctgacctttgttgaaggcccactatgtgccaggcagttggtcagacatgccgcctgcactggctcatcatgtgcccttaacaaccctgaaaagtgggtactattcgtatctcctcatttcccgcaaggacacagcctccgagaggtcaggtgacttgccagggttactcagctccaggtgacagagccgggatgccagcccaggctctcctcatgctactcggctgcttgttctctttacgcaccgtcagccctgctcggcatcagccccaggaagctgggctcacaaaagaccattaatgtcacctaaatatagactcagaggctttgggttggacaataccttaaagggtcagctccccatctagtgcctgcactccctctctccagcagcgcttccaagctggtgcccacttttgacccgtgtacctccaggaatggagagtttactacctgtggggcagcccatggtgtctttgtccaatttgtccaattgatggtgagagagttcctgagttcttccttagattgacttgagatcttcttcctggtagctttcagtcacatcatcattaaaagaaatagtcgtctaagaactctcttgccaggaggaatctctgttagggtagagaataactgagaagctgaacctgatcctttttctaaaatgcccagagaggatgacctccacctgaaacccaggacctgaggtttgctgcagcttctaggcagctagtactaatcaacaccgacgtcttacagagctktttccctgggacaggcactgggctgagccctttacacaatcgtctcagttcgtgtgcagaaccacagtgtgtgtacatcctattactatgcccattttacaagtgaggaaaccgaggctcagagaagtaagagtggcctgttcgaagttctgcacgtccaggtggtgcagctgggaccagactggatgtgcctgccccagaggaaacttcagaagctctggggagacaggctgacactggctgtgtgatctcaggcaggtcactcaacaagcctctgacccacagtctcctcatgcagggaagtaagttccaacattttcggatgtgatggagtcagttaacctggggtctaggccttgggcgcgtggcttatgctgtttgagctccgcatgctcgcccaacaaatgggcttaataattccggcctaaaagggggagatgtctgggctttcccctgtcccagcagggcaagcagcatcttcattgctctgcttctgaaaaaaacaacactgaccgcttattcagggctcagtacgcgccaggagctgtcttaagtgtttaatgtggatcaatccacttaattcttccagcaaccctctgaggtgggcactgttcctgtctccacaggtagcttgcacgaggccagccagctggtacatgggtgcaccctcagcactaggacagtttcaatatctcatgggcaagttcagggaaatgstagatgctcttcaggatatttttcagccactaaaaatgctgcttgacaagtgtttgttgtgacataggaaggcttatactaggatgataagtaaaaagatatataaaaccatgtggaacctaaaaacatttatacacacaaccgtacgtacacatgaccaaaagatgggaagatgcacacccagatgttaatggtgtctatctctgagaaacaggattatagatgattgtaattttcttcttcatatttgcccacaatatgcatatgttttacttttgtaatcaggaagtaaaaaaagtgatggcataaaagacttgtataaatctagcgtgggcagcaggcaatgaatcacctgtcttttccttccagatctctgagaagtatgggttccctgaagagaacatttacaaagtctacaagaaatgcaagcgagggtgagtgcctagttcaccctcccccagctggttgctcagtgctgagcaatgtttgtacttggcctttgtggaggggctgaggggatgtggagttggggtggagagctccccagccaggccaaagccactggtcacctctccatctgcagagaccagacatgggtcacaactgggaaggatgggagtgggagacaagtggaagggttgttacatatakgacctcctgggtggggtggagggagaagtggagggtcatgtgtcagaagacccaggttcaaggccactgggaaaccaagccatttgattataaagataatgattatagtgaccaccatccccttgagcactcactatgtgtcagacacgaggctaagcacacactacttaactctcacaaccatactaagaggtaaataccatagtcctcatttgacagataaggaaactgaggctcagaggtaataagcagtgttcaggggcaggagaagtggatcaaaggcatgaggcaggcaggcccaacaaagttgttactgacagagccgtaggcaggaagggagtggctggcgatgagtctggaaaaggagttgtgattgggagtcattttgagggaatccagccagggatgctccacaggcctcctccatctttgctagacagactaggccaggaataaagctgtaccctccagggggcaggcagtgcctggctgcctaccatgggctcctgggcaccagagtacctttgttgtctgctcagaagatcccttgggaaagggaggyagggtcacatggtaactgtcctccagacatcagtcccctggtcagagctagtgagcctgtcctctgcagcccttcctgagtaggtgacttcaccagcctggcatagggcccccagacagtgaggaattgtcattgctgttgccagcccagaggccccagaaccagagccctgggaaatgcactcctagcccctctgcccacagctccaatctgatcctcttgctgtggatagtctaactcgagcgacatttgctagtagccccttggaggtgctcagccacttgccccgtggctactgcaagtggatcttcctttgtagaagactttgcaaagcgaggcaagttttgtactcaagctgaatccccatctcatcaggcctaggggcctggccgccttcctcacaggcccagccctgcctgccttcctcctccttggttccttcctagccttccatagaaggctgagggtgggggaaggtgtccatccctgcagcccctgggaagggggtttttttttggttttagctgcatgcatgtctagagtttttcgtgtgtcttttttttccaagtttcggtttccatctgagtctcacatgctctgtagagtgaaatccacttcacggcaaagggcaggctctgctttccccagacaagcccagccccactctcccttcagctccagtgcccatgccccctggctccagccccacctgtggcaggcctcccttaccaatcccactccaggccaggctgtgtgattgcatgggggggtgggagggtggggtgtgtgtacaaggatgttccccagccccactggctgagttgccagaggcttccccttaagccccagccagctattgaaatcataattctaaaaccttcyatttatggggcacttcctacatgccaggcactgggctgcatcactcccaagcatcatctcgttgaccctttgagctgggtatcattatctctgtttgtacgtatggggaaactgaggtctgcagtagttacaaggtcatgagttaggaactggcagaagcatcttggacttctaaagcctgtacaggcatccactctgttatcctgcctcctgcttgttcctctaatcactacgcaatgtgcaaataaaggatgcagccaggctggccagtttatttgcccagcaccatagccagggcatcactcagcagcccttcacaggcaccccacacacccccacggccgtgaaaacatcagccccaggactgtctgaaatgtctgaatgacagtgttccccaaaatagatcttaggagaggagaggccaggctcatcttctgcctccctctgagtcctcatgtgagaaacaggaaattctgatcaaaggcctggtttattttcataaaaccctcccgaaagtcctctggatgaaggtggatagagtcagctttacaggccccactaagtgctgcaaagatgagcaaatacattgtttttgctggcagctggccaggggtttaatgtgactcaggactgaagacagctagaaggtggcaagtaacaagaggcccacatttggtgacagtggtactgcctctcaggggcccgctgtcattaacttttgagaagaggggtctgtgggcccatctggaagccctcttgtgcaggtgtgagcaggtgtgagcttggcagatgtgagcaggtgtgagctcagggcgctggaaggccctgctagggagtgggacggatccagccttccagctggtacatatcagttacttcacagtgcctggcacctagaagcacgcaatcaatggcagacaaaacaaccctgattttgaaaaaggacccacccctctgcccagttctggtctcccctggtctgtttccgacctcccgtgcccaaagagccctctgtgaaatgaaggaactccaggcaggacccaagaaaggggagcctatgattacacattggcagtcagcgctcaaaccactgacagcccaagcctggaccttcttcctgagagcggcagggagagacaactggatgtgggccatgccttcgggtccatgttgtctccattgccctcggggggtcctcgtgcctgccgctcctgcgccacttcaaagaactctcccatagccctggattttgccttccttctatctgctgcttcttaacttgtatttatagggctttgtttccttctaaaaatgatacagtagaaagagaaaaggttcaaatcccagccctgccatctatgaactgtgtgaccttagacaaataactttgtttctttgaacctcagcttccccatttatgaactggggtaatatgaggattcatcctcccagtccctactagattcaaaactcctggaaggcaggaactaggtctaattcatctccatatggtccttgtttttgagcaaagccctgcacatggaaaggcctcagtgaatataggggatgaatgggaagatgacggcaggtgggcaggtggatggaggatggtggatgggtgggggtgtgggtagatggtgcatgagtgggtagatggacgagtagatgccaggtaggtgtgtgtgtgggtgtgtagtagagggtagatgggggtgtgtatgggtgggtagatggtggatgggggtgtggttgggtgggtggatgatggatggggagtgtgtgtatgtgaatgaatggtggatggtgaatgtgtgggtggatatacccaactccattacatgctcagaagacagcagggaaggggcaaggagaaggttgatgtgatcagctcaagtcacatcttggtgggtccttcatcaggagcagcttctagagggctgctctttctttggcataaacaatggctctgactccctgcaggggcccacagccatgaagattccgtctctctcaggttgacccaggtccttgcctggagaatatggggagagagtgggcctagcccctcaagtctatcggacaatcctcctgagatttcagcttcctgggaatggaactgggaggggcttgtgtggcacctgcctctggctcaggcatgcctgagggacacatcctagcctcttgttgaacccaacccaccacccctccggggcttgaactcacacttcatgtccgagtcctcaatatggtgactaagggagcactgcgtctcccccagatctacatactagttgcttgagtgtccatcctcgggtgtaccaggagagaggcaatccggygcagtagctgtgagtgtgggggccagcaggcctgggttgggttgtggctcggcyactgggcattgtgcagtaaaggagactgtgactccctcacctcgtggggttgttgtgaggatcagagggaaggtttgtgaggtgcctaaaatgtggcaggtacccactgggtatgacccatcactcatcctggtcactcagaaggcctgaaaacagggcgcctgctgtgttccaaccacatcccctcttccattccagaatcttagtcaacatggacaacaacatcattcagcattacagcaaccacgtygccttcctgctggacatgggggagctggacggcaaaattcagatcatccttaaggagctgtaaggcctctcgagcatccaaaccctcacgacctgcaaggggccagcagggacgtggccccacgccacacacaacctctccacatgcctcagcgctgttacttgaatgccttccctgagggaagaggcccttgagtcacagacccacagacgtcagggccagggagagacctagggggtcccctggcctggatccccatggtatgcttgaatctgctccctgaacttcctgccagtgcctccccgtaccccaaaacaatgtcaccatggttaccacctacccagaagactgttccctcctcccaagacccttgtctgcagtggtgctcctgcaggctgcccgttaagatggtggcggsacacgctccctcccgcagcaccacgccagctggtgcggcccccactctctgtcttccttcaacttcagacaaaggatttctcaacctttggtcagttaacttgaaaactcttgattttcagtgcaaatgacttttaaaagacactatattggagtctctttctcagacttcctcagcgcaggatgtaaatagcactaacgatcgactggaacaaagtgaccgctgtgtaaaactactgccttgccactcactgttgtatacatttcttatttacgattttcatttgttatatatatatataaatataytgtatatatatgcaacattttatatttttcatggatatgtttttatcatttcaaaaaatgtgtatttcacatttcttggactttttttagctgttattcagtgatgcattttgtatactcacgtggtatttagtaataaaaatctatctatgtattacgtcacattacttcacatgctgctctcgttccttttgggagagtctgctggaaagagatggctacattggtcggggcctcgctcctctttctcccttcgctctggctctgtgcggagaacgggttgccctggacttgaaggatgctggsacgtgcagggcaccggtggagcagaggtgccccctctggaaggcagcagattcctgatgcccagatgtttgtgtttgaatgttacagcctcaggatcattgactctgcagagaaagtcctgggaagggtgtagaatgagcttgaagaggacctcacagctgaggccatcaggcagcacccaaggctgggagccacatgacctgagtcttgtgccagctctgcgcctactctctaggccaagccacgttccctgcagccagctcctacagctcacagaagcaattgcaggtatctcttcccaactctgaaggagtgtggtcatgttggcacattgaaatcagccatggtgacagtcagaaattgacaaatgctacaaatcaaggcctttattttccttagagaacaaatcacagattcaggcttgctttcttttcatttatctttttttttttttttttcttgcgatggagcctcgctttgtcacccaggctggagtgcagtggcatgatcttggctcactgcaacctccgcctcccgggttcaagcgattctcctgcctcagcctcctgagtagctgggactacaggtgcctgacaccacgcttggctaatttttgtatttttagtagagacggggtttcaccatattggccaggctggtctcgaactcctgaccttgtgatccactcgcctcagcctcccaaagtgctgggattacaggcgtgagccactgcacctggccagtttttgtctcttttagatcagttcctccattgcctcatttatctttttttttgtttttttgagacggagtctggctctgtcgcccaggctggagtggagtggcacgatctcgactcgctgcaagctccgcctcccgggttcacgccattctgcctcagcctcctgagtagctgggattacacgtgcccaccaccatgcccggctaattttttgtatttttagtaaagatggggtttcaccgtgttagccaggatggtctcgatctcctgacatcatgatccacccacctcggcctcccaaagtgctgggattacaggcgtgagccaccgtgtccggccacatttatcttttttaagctgccaagttgaagtgggtctttcttcctttgggagagcagacttaccagccactgctacctgtagccctcagtttctttggctataaaatgcaggtcatgatctctgttggttgtttgtaattatcatcttcagagcctcagggctcactggtgggtctccaaggccactacaatgcgaggaaggggctgcagcagtccctgcgtaccctccctaactccatcactgcagctctgcttctctccacttaaatatttgggtttctcgtaaacatctgtctgagtaaaactttttttaaaaaggtgtgaaaaccatgatccctctaagaacctcccagcgctgacagtctgtggtcctaattcccaagcccctacctagagtcaaggctatgggcaggtgagtctctagcctaaggcacaaaaattaaggggtacccaaaagctcaataagcaagataaataagtttaatgcaatatttttaaaattaaggccccccccccaaaaaaaaatccatggtgaacaaaacatcacagttttaaagacaggattcgtattactgatgtttccttttgcctcgggttcccattaggcttgcctgcccctgtgggagggacccagtggggcacccaragttgctctgcccaggcgaggcctcactgtggctgtgacgcacccttgatgtcagaacgaggtgatgtgtgaaggttaaatgacagaggagtgtggaaccacagccatgctgtaggtgctccaggtgctctgcgtgtacaaagttcccacctcctgaacttcccacccagctcccctcccagagccagttaggaagctggaaggtggcgcttctcaacctacacctatcattggaatcacctgggtggctcctgcctccccactgcccagaccccaccctggaggagttaaatcagcatttgtgggtgggccccaggcctcagtactttttaaagtccccaggtgattacagtgtgcagtcaaggctgagaaccacttctctggagaggccacagttgtacaggccttggaggctttgtaacctctcggtatctggcrgggttaatgtacagaaagactaaacagcgtcagtcaaagcctgctgggagatcagaaaaggagcctggcagctccccacccaccgcgaatctgtgcagcctccaccaaaaccactagggcacatttctttttccctccacatagagagacgaaagctatcaggcctagacaggccatgtggactccatggaagggcctgtaagccttgagaaaattcagtcccgccagcagagaaagtcagggaaaagcgcagcccccgggcccggccactgccattccaagatgatctcccactccaaagagaaaaaggtctaaaaggagtaaagagaggtctttccaaacaggtggtcactttagaaaggaagctgtggactggtggaaaaagcatcacctgcctgcaggtagctttcgcccagtagacataccgtaagtgagtgaggtcagaaagggacaaatgagaaaggcaggagtgagggaatgaatgaatgtgtaaatgaatgaaggaatgaaacagggaagggtggggcttccaggcttggccaccttcagggtggactgatcctccttgaagtctgcgcttcaggagtcccttcagtctgcggcagggagtcrtgccggaaggcagcctggatgggtgcgtggggaagcagccagggggctctgtccactcctcccttctgctcaggaagccactggagtctgtggggctggggtgaagtctccagggagcaatgtctccagctcaagacaaaggcaatggcagcagtccggctaggatrccaggccagagtggtagagccaccccccaagttgtcagctgccacactcatgatcggtctcctcctgaggaatgtcctggggacgctgggcagggtgggctggtggctggagttctccttgaccttgtgtgacatccctacagaaccgggatccatttcttgtcctcgttgtagaggaaggactgctttcctggaagctctggcttgtacgtagctgtgaggggacagagaggcggaggcattaagagagaaaaggcccattgctgcagtctctggcattctacctcagagctggaaaggcctggggacccctgtgccagcccctgtatcttacacgtggggagacagagaggaaggaactggcccgaggttatttggctcttaactggcccaggggaagtcaaactctgacttcctgccttctttaattcttttcaacttctttaacagaacaaaatttacaaaactattttctatgaaattcgaaaagaaattgagtaaagcaatattcttaaagaagcaaggtgttagcttcatggggtcttgttttgatctagttcaggggtttccataaaagcagaagccatgacaattgcggacatggttctmtaggagatgagcagggcttgggaactgtagccccaggtgaccagaaactcatgttgatactgacttggttaatgagggtcccgtgcacagcctctctgttcctatacttggaaagccgctcaggggagcccatggtagtccaggtatacctgagtttactggaagctgagcaggcagatgccggcacgtgcacgtgcccaggaaacccctcgcagaagcccaccttggcaygggtgatcagagcggcaggagctgcctgtctctgtgtgccaggtgcctagcaccacatacggcatggaaaagtcattcgggcaatgcttccagaggatgtggtagagcagggtcaaagcaggatccctgcctatgccctaccctctctggagctcaccccttgtatggagcatttgcatgtttgcaatgctgagttctcctcgactgactagatgagccccagatcaaacctctacagccttgctggtgtgattatcaccacatttgcaaggccaaagctaggagaatgaccttctcctggcccagtctgccttatgttagtctcacctgtgagtatggagctgacggcatctccccacctgactgtggcctctgggggcaaacctggggcccaggtcatcttggctccctcgcacgggagcatcgtcaacactcacagaaaggctgggtgtaaccaagctggcagtcatcacagctctgccttcatcctcccatgccacctgccacacatgtcagtccccagtgccaccagctttggccatggtcaggctgtggtaatagcgaaagcgctctatagagagctacaaataggtcaggaagcacagaggccgcccactggactgagtccctcatgatattagctcccaggtagatcccagatgtaacaggggatccctacttatgcttgcctgtaaaaagagtgtggcgctagaaggttcaaaagagctgctccgttggacagtccctggttaatttcatgaacaaacaaggcataaatggggaaacacctggcactgcccgccacgaactcgctgcggacctgtggcccacctgctctccagggcttcctcagctgtaaaataacctggccacactagaccagtagtttaaatatttttaagaaaaagaacttttctggctgggcacagtggctcacgcctgtaatcccagcactctgggaggccaagacgggcagaccagttgaggtcaggagttcgagaccagcctagccaacatagcgaacccctgtctgtctctgctaaaaatacaaaaagtagctgggtgtggtggcatgtacctgtaattccagctacttgggaggctgaggcatgagaattgcctgaacctgggaggcggaagttgtgagccaagaccgcactactgcactccagcctgggcgatacagcgagactccgtctcaaaaaaataaaagtaaaaaaaattaataataataaagaaaaagaacttttctgacactctgacaaaagctatggcctcctttcccagaaaataatgtctatatgtgccaattcttcagccaagtgcagagtcacagaccccttcaagactatctttgaatcttttagatgttcatggtcctcagtatgaatccctggcctggaccatctctaagagccctttcaccttaaaaaacaaaacatttttgtactgtgaaaatgtgaactgataatgcttccaaatctaccctcatccctgtaacctatttgggaaacaacctataaatcaatggcatttgatgacccaagaatgacaaacagttccagaagatttggtttttacaatyatttaaaacaatcctctgacctgggccaggcaggcctgrctgaggcggcgccgctgtccaccggctggtattggacacgaatgatgcactagagatgaaatgcttgcgggggcctaagtagtccacgatctcatactgaccaggacctgggaaaggtggcttcggaggcagaggcgaaggctgagcagagaagttcaggatggggtttttcctttgggaaagataaaaygggaagatgtcactaaggcagtctagtggggaaggcacagtttctagacacagccaagacctgcacagcagcaagctgtctggaagaggactggtcacggcacyggggcagagccctagctccactggtagtgagctggggacccctggatctgtttcttcatctgcacatggcaatcatgatgggacctactttgaggtcagggttgtcaggataaatgagatgacgyacctaaaacacagtactcaggataggcctggcacacagtgagagctcagtgtgcattgctggagatgtggagctaaccagaaatggcaggccgtgtatatctcatgtgccaactctgattgattggtagtgcctggctggagttctgtgaaaaaaactgaggcctcatatggactcaatgggaagaggccttagtgacccacttgtgatgcctgccatggtcagggaagagaaagaagcatcccacattccacagatttgccatcccaagaccagcaggtctttagaggccactgtaacattgacattccagaatcctactaaatatcrtcctggggaggcaggaggcaggagtggaaaagcaccgggctggaaatcaagagactctgcataaccctttaccactcacaccgccattgttttcaagtctgtcttcccctccttccagaaagggagtctatcttttatctctgatattgagacatgaaatgaaagaccggacctgtacttgagtcctagcttggtcactaactcattctgggcctcagtttccccatctgtaaaaggaaggggttggacaagatgacctctgaggtcccttcctgctgtgacctttcatcaggccttgattcaaagttccactgggttgtcagagacttctgcgcttgttacaggaatcatgctactctcccaaccatgtaatagaagggccgcctccttctggctcacacccaaggcttcttctaaaaggcttctcaccaaaaggggagaggaggttctccgcactgaatggccaagggagccttccccagcttcccccagcactcaatgaccaagggagccagcccatccaagcaaaggaggggacttgggattcctggccactggggcactactgcactttagccaacaacttcttaaacacagagagcttgaggggacccaagtgatgtcttcttcaacctccttagttttctaaaaatgttggtgtccggagagacaaagtaaccgatccagttataggcacctttgtaggaatgctggcatagaactcaagtgtttggcacctagcaatatggagaaagcatgatggcggaggggactgagtttaagggtcacacacaaacctgaggctgaattctagtcatgccacttactggctgtaagacaaggcccctgatttctctatagcttagcgtcagtatacacagcattgcaaggaacaatgacactaactttataaaggagttacaatgaacagagaaaaggtatgtaaagcacctagtagagcaccagcacatagtaggtgctcaataaaggtagttgttattcttctgatgatccctgtgtcagcatcaatgtgtgctgcttggtgacagacaggcaactgagcctcgtaaaagactgacagggcccttccaccccagagtcatgctgaggcaggggacacccccctggtcagagaggacactgaaagccatcataaatgtgcttgggctcacatcttgtggtggaggagcagctggcgtggatgcttatatttagaacaaaggtacccacagggaaaggggggacatgctgcctccctgtttgctatgaatctgcatggaagaactggttacagggtgtaatcaacaacctctccccttataaataaaagctggcttctccttgttctggcttgtggctcccccttcaaaacacctccagacatttgatgagtttgtggctggcatcatggagagacaggtttgattcctggaaattacagctggaacaaatcaaccattatatgaggtcaccccatcactggtctgggtcactccaagcccaagattcccaccctgttctttgagaaaaccatgaggtgtctgctttcttagccaaggacagcctgcagaaggctggagcacgctgagttaatgactcaccagtgttcttggcaagatgggttagagaggtttcttgtcttccactccttcagtatgcccaggagaggctcagaaccttcagcctagcactatggatctttcatgagcaccagccatgtgtgggattctgggccaggcatgcttgggaatccaggcagttctgtactaagacacggacttgagtgtccttaagggcttgacaatccgctgccagcaacagccatgactggtgacaacttcaggcagtacaggctttgcactcagacagagctgggtttgaatccccacttccccgttcaacagctatgtgttcttagaaaaggctcttaacctccttaagcctcaatttcctcatctgtaaaacagtggaartaatacctactacccagattgttaggaagattgtgctttacttgtaacatttgtttaaaaacatgaaatctgttcgaatagaggttaaaataaaaaactgcattgaaagcagagagaaagagacagagacagagggacattaattccaacaagatgaatccagaaatccatccagaaatccagaaaatcttcaggtggggaagagcatttccagcagagggaacagcaggagcaaaagcatggaatggggaaagctgtagctgttatggcaggaattgggacacaaggagacagacgctgagcacctagactgccttcaaccctccattcaccrgtgatttcctgggttgttcacttgcttctgatactccccacttacaaaccctgatgaaaacttaaaggcaagatctatttatggcctctcaatccagcctaatctcccatgtcctgctgcttccgttttaccttccagaaacacccaacacaacacagttcagcaactccatgcctttgtccctgctgttccttctgtgagaaacaccaactttccctgcaaactcgaattcaattcttgacgttctcactttcttccagggaaacttctctcctccacccacgcctgtctcgccaccccccacctgactgtcttgaatgttcccatcctgtgactcaagtgaggaacawgggttttggagatggattttggaggcagagggacctggattcaaatcccagccccaccaccgtcaacagcctgcacttcactgtaaactcggaatgacacacccacctggaggagaggtggaaggacgacggcaggtcacatctgagagctctcagctcagagtatgtggcccctgaatacattctggctattactttgcatttaaaatgttgcattttctatggcttttacttgcctagctctttaagggaaggtattgtgtcttcctcagctttgaggcccctagccctatcccgggaacatttgctgaagtgcagagaaaagcagagggctggcagcatgtaaaggagcccaggcatctgaggcccacatgacagtttcatcctcatccagggctggtccctccatgtcgaggtggggctgacaaatcacaaaggtcaggctggatcaaacccagggcagcccacagtgcattgtgaccagggcttttatgagcctcattgctcagttataaaagccaacctggccctgccccgtggaaagaaaacatctatcaaaggctctgagttggccacaactggattaagtgtgtttgcagcttccaatgtgagctgtttgcaaatcacctaagaataatgaatgtcttagaggactcagcaggccacttggggaaagcatctgagaccctccagacactcccaggcacacattcactcgcctcagggattcccagggttgggagggataaaggggcaatttttctcatcattaaagggcagccgattgcctctggggtggaatgcagtatctgtttaacagggtagcgggtgacagattacagctgcttgggaagaagcatcccatatctaattgaaaatcccaggggaagttagggtgggtccaatctaattaccaaaattggagtggggccaacggggcttgatttttcagctctagctgtgacaagacagcgtgtctgtgcaaatccagtggcttaaaactccaggaagcagatcaagggttagaaaaatggccctgagtgttgcacctccttgctggggagcatgagttggaaggcattgcctaggaggaactattttgatctccaaaactctcaccctgactcaccctaagtgattgagtcatcactgtgacggatattgaagacctcagaagcgaaaccttggctgatacttcactttgcttctgaagacaccctggaagctgagaagtcctcttagctttgagtcagcaaggtggccatggccaaggaacacccgatggcatgacctttagctaaggagctcagaaatgccagtgctaacaaacagccagccccaagcacagcatccgccctgcggggccacactagaaaccctaggaagacacagaggacccgctcacctgctttgataaaaatacaagttaccatgtgaattttgtgggttatctccttttatccttacaaccacattatgaggtgttcttatcctggttcaccaaggatgactttgaacccactgggagttaagtgacctcccttcccccaggcccacagggctggtgagcagggaaagtggaggttccatggtactgactttggggcctacgctaatcaatccactgcccacgctgcctccatggcctcttcaggggacgtgatcagccgttccctgccctaatggtggcctcctgagctttggtcatatccagccatcctctcacggctgggctttacattttttggccagtaacatgagactaaaaactccagggagaattcatatctgcactgatgcttcctgcaccctgaagaaagcagatccagaaaagcatttctgtagctgtaactctgcccaagaatgggaagcccatcaactccaacccaagacagatgagggcaggtctccccctgcatggcacgcgtgtgttcccgagaaagaaacatggcggcaagtcaccgccgctccacgtagccgtggagagctaaagaggattagttctgatgtggacaaagtcctaagggaaggtgcatgcagatggggtcacctcaggggtctactgacctcaggaacccgtgtagctcctgtccctctcttccctccagggacacaggagaaaacagaactggaatttgagaaactggattttggatatttcctcaacactctgatattcagctgtcttttcttttcattacatcattttcttcatcattcatcgggaacagataaatgttttttttagaatagtccaaagcctaccagtcttatcttcttgctttccaaataaaatgataaatttcttagcttcatctttcccacgttaattttaaaatacataatctggacctcctctgtgggtccaggctggctccacgttcgttgtcccctgtgtgctctcctgagtccatggtgagcaaacctgggattctgatgtgtcagaaatgcagacacccttctttcgcttatagagaaatgaagacccagagaggtgcccagagcagccccagaccacagagccagctatacaaatgtcgtgctatagagcctggggcaccatcccctcatcagggtgaacccaagtttaggagacagcgggttaataggttcctttactgcaggccttctcagagcctttaagatgcctgtgcagactgcgatgttctcaggggcagagggttacgatgcagtgcttctcagacttattaaccaaagaccttttatttgtgaagcattgacagagagccagcgagccctagaagccccagacacgcagtcccgctgcactgcccagtgggaagacggccccatgggttgtacatggccatacacccctggggccacctaacccggcattttgctgcaggctcctccacctggcttcgaggctgttcccagatgaggttggctggaggcgtggtgtcctgttcacctgagcctccagtacagaactagaaatctatagagtctgctgactgacaaatgcaaacgccataaaataagaacgatctcaaaccacctgttcaaacttgagcaaaagccagaagatatttctccagataaagcagttaaaaattgagcatcctccactcttatgttatttcaccattttccttgaagaagcttccaaatttgggctgggggcttkagctgccatgccaaakaacagctgtattgtataatatagcctagtaggtctataggatatacaataaccacagctatcattataagggtaatagctattttctttctttttgagaccaagtcttgctctgtcacccaggctggagtgcagtggcatgatctcggctcactgcaacctccacctccccggttcaagcaattctcctgcctcagcctcctgagtagctgggattacaggcgccctccaccacgcccagctttgtatttttagtagagatggggttttgccatgttggccagactggtctcaaactcctagcctcaagtgatccatctgccttgggctcccaaaatgctgggattacaggcgtgagtcaccatgcccaaccggtaatagctattttccaacatcttctcatcgaatcttcatggaatccctacgagataagatccttatctctacttaataacataaaactgaggctcagagaggagaagtctctggaaggtacagagctgggattcatactctggtcggccaactccaacacctgtcctcttgaccactctttctctggcagagtaagggaatagttacttgtagagatgccgcatgccagcctggaggcgggaggtctctggagagagactttccagagacagagctgttcctggagactggcctgccccagcccctagccctacagcctgtacaaggccagcctgcagagccctagacctggagggcagaagggactcctctggtggattccagctgaggtctcaatcccctctccagatcttaagttcgacttggcagattcacaacttgcacctctctctaactgtggtccccttgccctaggctgatgatcagactatgcccaatgttggcagcctccctgggttgcctggacttctgacccactgtggctatggctcctaacacctgcctgatctctctggaggggcccaagaggatatattgttggtcccacctggccagccctcccagtggccagctctgtctggaggggctacgcatgggtgagagctgagatggtaacaggaggactaaccctaactgcagttagttccagaagttctagaaccattcgagaaataaataagctctgtgagtatttgagcctcttaggtgagagtaatataaaatgtgtaggatattaaacagggtaacaaaaatccctgtatttacttttaaaaatctgtgttaatwttgagtcaccagctgcaatgccaatgccaaacatatattttatttactttttttgttttttgagacagggtctcactctgtcacccaggctggagtgcagtggcgcaatctcggctcaccacaatctgggcctcacaggtccaagtgattctcctgcctcagcctcccgagtagctaggattacaggcgtgcaccatcatgcctggataatttttgtatttttagtagagacagggtttcaccatgttggccagactggtctcgaacacctgatctcaagtgattcgcccacctcggcctcccaaagtgctgggattacaggcgcaagctgctgcgcccagccaaacatgtatttttaattctgaaagcaaaatcctacgaggcaggaattattcccaccttacagatgagggcatggaggctcagagaggttagaactctgcccaaggtcacagagcataaaaacagcagagctgaagtacaaatccagcaggtatcaccaactcgaaagtcagggcttaaacttccatcggtataaagctatgagagcttgactgcttctgaatgtcctgccactccagcgaagattttatgttacaaaaatagaacaatgtcagcaccaggggaatccagcatcacagggaatgaggaaagacttagtcctgagccaattccctgtggctcctcaagttggctgtgtggacttgggcaaatgtcccgccaaatccgaagccttgcttcctcctctatggggtaagagtaacaattcttacaacaggattataataataattgaatacaattttaagttcctggcacacagtggttgctcaataagtatcaggcattcaacaggcatttactgagcatcattatgtgtgactaagggcccctgaagagagtggcccggcactgtgctctgccaagcagtgacaccccatccttttctctatgttgggcttcttccccacaaccacctttcaaaagaaagaccagaatgattgggactcacgggaaaagagtcttttttggaacttttgtgcaatcactggggttgtaataaccaggtcccgggcctgttgacgtcagttttaatccacggttggtttttgatttaaaacaagacattaatgtatttggcgactgcttcacaagggattcgttgatatcataatgccctaaggagaaagaaattttaggacagaataaggaactcttctcaagtaaataaaaagcagtaccttacccctaagaacacacctgatggctgcaaggcaccatcactctaggatggccaagtggaagggctgactgagatagccaaaaacaatcctcaccatgcagagaacagatggcacgggaagcacacacttagctgatttagttctcgcactagcctggcaagatgagtattactgctttcattctacacatgggaaactgagactcagagattgttaaataatttgccaaaggacattcatctaaccagggacttagacaaatctctccaccttgctggagcccagttttccttctctataaactaagaataataattcttctgacaacagagttgttatgacagttgaataatattttaagttcctagcacatagtggatgctttgtaaatatcatgcaatcaacaactatctttttttttttttttttgagatagggtcttgctctcttgtccaggctggaatgcagtggcacaatcacaatcacagctcactgtaaccttgacctgctgggctcagtgatcctcccatctcagtctcccgagtagctgagactacaggtatgtaccaccaca

SEQ ID NO: 12234 - DNA, 128811 bp, Homo sapiens
aaggaggcataaaagatgattttttccccacaacaatgagctttcttacagacatattaaacggaaatgaaatgtgctactcattcccagcgttgcagaaccaggtgaggcccgagacaaaggcgcgggatggccgggacgccagcccggggcggaggggctggcggcgggagcgtcacccgcacctccgcggggagacgtccaagcctcggcgctcccagcccggccgccgcgccccgctccaggctggggctggggctggggtcagccccgcagagcaaggggcggtgatgtcatcctctcggcgagcttggctgcgggccggaggcgaggccctgcgggaaggtttctcggcaccgctcaccggggcgctctctccgagtcacgcccggtgcctccccgcgcgggaagaagctcaatccccttcccgccccccgcgccggggaaacggcggcaatgtccgggcagaatggggccgggcggagcgccggcgaccgggaagctcaggccgtgggctgccgagactggcctagctgaaggaggtgggcagccaggcctttccgggcaggaccgcgtgtccttccgcggccagggctctaggcctccacccttccgtcgccgacccggcggttacctcctccgcagcctggtagtcttccatctttcctccggcgcgtcccctccggctccctgagtggcgcggactgcgcaggcgcactcaggccccgccccggacctgccacgcccctctcctctcgcgcctgcctcgcccatgcccagctcccgggccccgcccttcgctgcccggaccctcagtgaccccatccctgggcggggcccgtgggtggaccctgaattcgcctctcctcctgtcctctgggaggtggtagtttccatgggaatccgtgagggtagccgggcagctccctaaaccttagcaacagaaacaaaacacacgtacaaaaggcagtcctggaggggaagcgtggtcccggcccctcctccggtttgtactgtgtggattgacgcggacgttcaaacccgctcggacacctggcaacaaactcgaaagtgactgctgaaggcagtgcgcccggtgagacgttgttgcagttcccttggggactgggattggcatgctttagctatctgaacgaaacttccctttggggagttaagttttccaggtaaatgagaatttttcctttaagcaccattaaaaaaaaacattttgggtggaaaattttgtaaaatgtggcacacttcctgactaccttaaccatagtgaactagacagactttatttgtatgtgggttctttatggaaattaggaattgcactgggctctggtaaactgccctccacggaaagctggggcatatgcatctattggcaggtattctgaggctccgagttttgattttggcgtttgctttttctggtttcgtcatgcacttgaattcaggttgctggaacccacttcccattccccaagaaagagctgactgcaagggtcccagggatttggtagacctaaacttcaaatcccacatctaatccatcaacaacccttgttatttctaccccatatgctcgggaccccagttaaagattgatatctctcatctggattatgaccatcggactgtaacctggtcggtctatcagggtcttattagagcccttcaagaggaacctaacccaacgactcctccctcccctcacccattctgccctgccataagtcaatagttactaagttgtcagactatagactaatcttagtgatctttggatgactaaacttttaacatatcttagctcaaaatctcctacagagagccattctgtgaccacggcatctaaggtagccgacctcctcatcctccacccctgcatcctgtacattttcctcatagcacttctctcagtttgcaagaacgtatttatggttgcttgttgatggtgtgtctccatttagaaactaagtaccatgcaggaaggatctgttttattcactaatgtatccccttccttccacattgtgcctggcacataatagctacacaattaacatttatttatttatttatttagagacagggtgtcattctgttgcccgggctggaatgcagtggtgtgatcggagattttgagctaagatgtgttgaagtttagtcatccaaagaccactaagagcttgaactcctgggctcaaggtattctcctgccttagcctcctgagcagctgggattccaggcactagccaccacacccacctatttttttaatatgtcttttgtagagatgggatctcactgtgttgcccaggcaggtctcaaactcccgggcttaagggatcctccagcctcagcctcccaaagtgctgggattatagctgtgagccaccatgcccggcctaaaatttattgcatgaatcatttccctcatgggtgttagctttgcctcagacccaaatggagagaactggggagtggaggaagatgcaactacctgcctccttgagggaaacagggctggcgagaggagggcagagccctgactgacacaaggctgcttggccctgggtgttcggcctgagcgaggagacttgctgggcaggctggttgctttaccacacctggtcttcctctccttggattctgaactttatctaccttttgaattcctttcttattacctggcttcaactcccctgtcctggtgtttcagtcgtgcgcctcagtccacatgtgattctgatgctgacattgctttgcctgcctgcccttctcagtatcacctgagatctcgttttggatgttctctgcctacctggttccaagctcttggccccaccacgatcctgagccaatcaggagcctctgaaatcttttttcttctgctactttgttgtggacctggagttcagtagctaagtgtcacagaattatgtgcaaagcaagagtaaaccggttctgagcaaacacctgcaatggaagaacatgacacttgggacagccttttcaattttccccacaaccttttaggaacttcctaatttaaatcaatttcctgaatgtctgctaggatggtgcataattaatgcatggatcttgttataactgcggatcaccagcatgcacataaatcaacagaaaacatgcaaatgtgcattttaaaaatgcttacatgattttagcttttatacattgggtaccactctccaattttaactattaaagaacatttgttaaatgatcgcgatgtatgacattttgaggctgccagtaaacggatgagctggtctgtttatcttcacaactatctgttcacttgttcaatacacatatatggagcactccctttgtgtcaggctctgagctgggggttgaggctacaaagttgactaaaacatggcctttatggaattttttcttttaaacggatatatctgtaaataggagggtttgaattctctaggcttatgtgatgttgtagtgcttggaaaaatgcagtgatgtggtattatattctgcccaactgatgtagtctgtagggctaaggaatttaaaatcgttaagacatttggcagttcaccagatgccatttccagcaccttccatctgccacgaatggatgtccatcagaagcattggagctcagacacctttactcgtaactgctcatgaatctttggcattctgccatattttagaataatgtttagtttctatgcagtaagtcagtggagtgaatcttaggtttgtttttcaatttggaggttagtgataggttggcaggtttgcgtgcaatcacctttcttttctggagtcaaatttcttgaatacagactgtgggactggagctgccaatacctttatttagcaagtgtgggcctaataatcatagcaatcaatgaactgtcacatcaataaataacatcaataatatccagcagtggctgggcgcagtggctcacacctgtaatcccagtactttgggaggctgaggtgggcagatcaccagaggtcgggagttcgagactagcctgaccaacatggagaaaccctatctctactaaaaatacaaaattagccaggcatggtggtgcatgcttgtaatcccagctacttgggaggctgaggcaggagaatcgcttgaacccaggaggcagagattgcggtgagctgagatagcgccattgcactccagcccgggtaacaagagcgaaactccgtctcaaaaaataaaataataggccaggcgtggtggctcacgcctgtaatcccagcactttgggaggccgaggcgggcggatcacgaggtcaggagatcgagaccatcctggctaacacggtgaaaccctgtatctactaaaaatacaaaaaattagctgggtgcggtggtgggcgcctgtagtcccagctactcgggaggctgaggcaggagaatagcgtgaacccgggaggcggagcttgcagtgagccgagatcgcgccactgcagtcccgactgggtgaaagagcgagactcggtctcaaaaaaaaaaaaaaaaaaataataataataataatatccagcagtgttgttctgctataatctgcagcccttcatagtccaaatgccatcctgtggattttccattttttcctttcttcccctgtgccaagaagtgtgttactatgagatcatgctgagtcaaaataatagtaacagaagaagacgatgaggacgagggtgctgttgaaacactcatggctgaggaatttaatgttgtaaaggaaaagaaactctggctgacacatatctaaagtgagagtcctgtgctgagaaaagctaaagagattagctaagaagtgcctatatttagatctgctattgagctgggaagcggaggcacagttgtgctgaaatacctctgtaccccatgaaacagtggctgctctgagcttcttgggtccctcttcctctcaatcctggtgactgcagccccttccctgggacctcatccccaagatccaataactaaaggataactcgtggtatagcagggcctccgctggcatttgttccaatgggtaaatattcatgctatagtagttattaaatagtttggtgctcagttctgtgtttgtgaaaacactacacactacatcagcagaataggctaggttagctgcagaaacaaatggccctacactctcagtggttgatgacagcaaacatttatttgccactcacactccatgaccatcaaggatcttccatggctctgcttcatgtcttctccatgctgagacgaggttgctggagcagcctgtgtctggagtcatcaagggaaagagaagggaaagagaatgaatggtggccccagtactggctcggtaggtgccaagcctacgtggcacgtggcacctttgcacacacttcattgtcttattgctctccagagcaagtccttggccatgcctgagttagcagggcagggacacttcacggtgctgagtaatactacctagtacacgcacagcattttgaaggttccccttggtgatttcattacaatcttcatcgctcttggcctggctgtccccctttcttgtaaattattcttgagttaatagctgttctttgagatgtggttagtcatttacactgaagtcaatgtgaaacccttcacaaatgtgagaacatttgaatatttgaaggctgtagtctctgtagggagtttccttaggaagggtgaaacatttcaccagcatcagcctggtctttcctccagctaaaaatgtaaaatgttggcatagaagagctccttgatgtggttttggggtggctttgctccctgggtccctagtgatgtgggagtagccaccgaggcatgtaaggctggccacacagggtgcactgcrtcagcctgtgcccgacaggaagggaagagaaatacgtcagttactctaacaagaagaattgacttccttctctgcagagccggctctggtctcttctcttgaagcagatgcgaaggtaggatgagaaggcatggctggccgttgcagcaggtcgttttaggagtgggggagtggggtgggtagagattatagttattgtaacttttcttaaatttatgacattgaaaaggtaggaaacaaaacataataaattagataaaagatatcttgtaattttattgaataacatacatttaacatttgagataataatgatttaagtgatatggtggaagtgacttcagagttaattaaaaaccaaaacaaaacagaaaaacactatccaaaagctatatggtgtgatttttttttttaaagggtagagtgtcatttgctttcttctttggtttgcaaattcttatacttacagtttattactattttrctctctctgaatcgactttattgttttgatcatccgtaatttctcgtttggaggtggaacataaatatcattttggaattataaaaaagttagctagggtctaatttaaatttcttttaattaagcttccttaatctctaaattgcttggtaagaaagagactatgagaggaaagtgcacattagatattaaagatttattaaattagaattgggctgggtgcggtggctcacgcctgtaatcccagtactttgggaggccaaggtgggtagatcccttgagatcaggaatttgagaccagcctggccaacatgatgaaaccccatctctaaaaaaaaaaaaaaaatacaaaaattagctgggtgtggtggcaggcacctgtaatcccagctgcccaggaggctgaggcacgagaatcacttgaacctgggaggcggaggtggcagtgagccaagatcctgccactgcaatccagcctgggcaacagagtaagactccgtctcaaaaaaagaaaaaaagaaattagaattggtgtagaaaagattatttagccaagatagttggagattctaacttagctgctttgcctaaatgaagcataaggttttggagttaaacagacccagtttagagtgtgagtttaggtaagttacttaatcactccaagactcactctcctcatctgtagaatgggtacatttacttcataatgtggcaataaggattagtagagataatgtatgcaaagtacttaaactatctggttcagagtaagagctaaataaatagtagctgttggcacaacagaaagcataacaacaattgtgagtagtacctagaaggatataataatattaattctcggccgggygtgatggctcacgcctgtcatctcagcactttgggaggcctaggcggatggatcatgaggtcaagagatcgagatcatcctggccaacatggtgaaactctactaaaaaatacaaaaaaattaggtgggtgtggtggcgggcgcctgtagtcccagctactcaggaggctgaggcaggggaattgcttgaacccgggaggtggaggttgcagtgagctgagatcgcgccactgcactccagcctggtgacagagcgagactccatctcaaataaataaataaataaataaataataatattaattctcatttctttgctcttccatacaaagaggtcaagtttaaagtatgaatgccatggcttcctatttcagtcatgaattcctatttctgattctaaagtaatattttttgttgtttttgggtggtaaaaggctccccgaatgagaaagaatactcggaatcagcggtgaattgcagtgatctttcagagaaagcgcctgttcaactttgtcctctctcaggtaggcttcaagttttatagattcaagcccacgtgtgagtcttctaatgttttatttatttatttatttatttttatgtatttttatttttttttatttatttgagatggagtctcactctgttgcccaggctggagtgcaatggcacgatctcggttcactgcaacccctgcctcccaggttcaagtgattctcctgcctcagcctccccggtagctaggattacaggtgcctgccaccatgcccagataatttttgtatttttagtatagatgaggtttcaccaggttggctaggctggtctcaaactcctgacctcaggtgatccacccacctcggcctcccaaagtgttgggattacaggtgtgagccaccgagcccagcctgtttatttatttacttattttattattattattttttgagacagagtctcactctgttgcccaggctagagtgcagtggctgcaatttcagctcactgcaagctctgcctcccgggttaacaccattctcctgcctcagcctccgaagtagctgggactataggcacctgccgccacacctggctaatttttttgtatttttagtggagacagggttttaacatgttggccaggatggtctccatctcctgacttcatgatccacctgcctcgtcctcccaaagtgctgggattacaarcgtgagccaccacgcccggccttatttatttttttgagacagagtctcgctctgtcacccaggctggagtgcaatggcgcgatctcagctcactgcaacctccacctcccaggttcaaacaattctgtctcagcttcccgagtagctgggattacaggtgcccaccaccatgcccggctaatttttgtatttttagtaaagacagggtttcaccatgttggccaggctggtctcaaaactcctgacctcgtgatccacccacctcagcttcccaaagtgctgggattacaggcgtgagccaccgcacccagccgagtcttctaatgtgaagtagagatatctgagggacctgaaacttgtacaacttgtggagactttgggaaaacaaagagggaaccaggtacagggcatctagggccttggacagggccgtgcaaataaaggattctgaagttgaggtgtcattcgcttcccagaaaacccacctctgaatgagtaacaagatagacagaaaatgtataaacgcacatcttcatttctgtgtcagactttctgatggatatgcatgcgtgctgtctcattgttgcaaaaatgagtcttttaagcctatgaatagggaactgagctgagagctgttctttattcatcaccttcctttgtggctgtaatcagcttccgtaaagaatctatgcaagcaggccggtcgcagtggctcacacctgtaatcccagcactttgggaggccacggtgggcagatcacctgaggttgggagtttgagaccagcctgaccaacatgaagaaaccctgtctctactaaaaatacaaaattagcggaggatggyggtgcatgcctgtaatrtcagctactcgggaggttgaggcaggagaatttcatgaacctgggaggcggaggttgtggtgagccaagatcgcgccattgcattcccgcctgggcaacaagagcgaactccgtctcagagaaaaaaaaaaagaatctatgcaagcaaaaaagtcatgaggttttcaggtaaaatttcaaggacaatgcagtcactcaacttttcccctgtgtacgaggcagaaagcatggtggctgcacgctgaagctgtgaaacttctcaaggaaatagctgtggtaaacaatacaggagcgagctgccgcccgcttgaaatgacctgcagggctgtggcttgtgggctttgagaacgttctgtagtcttcccttgaaagcgtgtgtggtgatgacagtcacattcacacgcactcatgctaccgcagatctctgcatttccactctggtgacgtttcccccgtaccagggagggctgaacatttatttcctttgatctgatgactgactgctcagagacaatagatgattggatgaaagaaataggggcccctaagaataaacaatgtgtccctttcccatcctcctcrtctcttttcttcattggttttacttttcttgtacttttcccctttcaccagatttagaagccaaagtcaagatttgctgttaggctgaggaaagcaagcaggcattgtttcaaactcctagtgcatggctgactatttcagtcccctggcggagctgtcccacacgtctctccctgggaagccctccctggtcccaccagccctctctgctcctgtgtggagtgactcttgccttctgatccttgggttttgtactcatcccaccatgttatgagttatttgtctgtgtgtccatgttctggctgggatgggtccttcttaaatgcagagattgagtctcacttctttttagatcctcgatatctggcacgtgcttgatacatagaggccaataaaatcagtgttgaactgacacactcaatgccgtaaccaaactgtgtttgtctggatgccgaagttccactgggatacagcatgaccagataaagaccaatggaaacacctagattgaagttttccccatggctgcccgcgtccctcccaatcccagaacagtggcttaacttcctactcttgggccttcctgaaggggagatggaagggtagaagaaacccttttgagtcgggcttgctttgttctggctgttgctctagggctgtgcctggatgactcagtgagttccccaaacagccctgtgaagcagggatggctccatgtcacggaggaggaaggccagtctcccagagatgaagcagctggcctgagagcacgtggctgagtcctggctgggtatgagcccagactgtctggctccaaaagtgacacagagacaggatggctgagtgtcgggggggcttctccacatggctgtaggagaatgtttccttccaggtggtgctgtggtgtgggatttattcatttttaattgccagataaaatcaggctgatcgatggagtgctgtaaaacaaagacaggcaccattacaaaaatgtagcaggggagttaggagactggatctaagctccgagcaggtgaggacggtgcctgactcagtgcttgggacatcatagagcatttaagatcttgttgagcaaatgatggagtgaccgaataaatgtcatcctgggaaaatggacctaggagatttccgtattcaagctatgagattgtgaattcctgcgtgagatgattaacatacaatttcaaagattcctgttaaattccaaaatgactcagatttttctatgctttttggatttctgaagactgaggttttctgcagtgaggactcacttgccccctgcccgtccttacttcctgctgtacttgaatatkggcttcctgccctaggaaggaagtttgacatcggagtaaatctccgtgtcgcaatattcttcaggtttctcaattcaagccaaacatcaagtgcctcctggctgggtgatgggggaatcgctgaaatctgatattgtccctagaaggcaaacactcaagacagaatgaaatcagggtcaccatcgaaatatacaaattagaaagcagttaaatttgaaggagcaatggatctttattgtaaatgaggagaaagtttctgaactgggtagccttgatctggcccttgaagggctaatagtaagagtgaggctgctcttactgttagtaccacgactgtcagccggcattagctgagtgtacttatgagctgagcactgtgctctagaggtctccacatgcatcagcacgtttcgtcatcatagcacckccgtgaagtgggtgctgcacctgtctacttcgtagatgaggacatgaagccccagagggcttaagtaacttgcccatcatcagctcaacagcaagtcggtggcagaggcagctactcacccacacagccagcccccagccctggtctcatgactgtccccatctcttgcctcattgggcagaaggaagagtggggccgatgcgtggaaatgcagagcgcatgtggtcagggaatggtcttgaatgaggtcagtatgggagtggcgagcattctgtgggaactgaggatggaggagtcaggagaactggatcgggaggtcacgactgggatgcctgtgctttagaatgtgtttacgggaagggaaaaccagcgtgacttcactggagagtggaagagtgacacattcccacctcagtattgtcacatctgccgtctctcaccctagagatgccttctcctcctttccaatcctcacacaactcccctcttctcccaggcctggcggtggcgtctcagccaggcaggtgtcctgtcctttcctgtcacctgtcagtcttcctcttcctcgtggtccattcagcaacatcactgctgctctgggtggttgcatgtggtcgtttgcctgcaagcaggtgggtgcagccagttcaggacccctgtgacaactattcctgttacctgctttgtgagtgttaaaaatgtcatccttggccgggtgcgatggctcacgcctgtaatcccagcactttgggaggctgaggcgggcagatcacgaggtcaggagatcgagaccatcctggctgacacggtgaaaccccatctctactaaaagtacaaaaaattagccgggcatggtggcaggcgcctgtagtcccagctactcaggaggctgaggcaggagaatggcgtaaacccgggaggtggagcttgcagtgagtggagattgtgccactgcactccagcctgggcgacagagcgagactctgtctcaaaaaaaaaaaaatcatccaccttactcccttactctattgttgtagaagggcctgaagcacaaacctggtgttgtgtggtgatggcgggacagtgtggagaaatatgcagcgaattttaatagatttcacagaattccttgactacctcatgttctacttcaaaatggcacaaaaccaaaagcattcaagagagaattacatttgttttatccatttttaagactatgtaaagtaactccatgtggtttttcatatcttgctagtgtaagtgaccagaatttaaatctgtaaaggttcactttttcttgctaatgctgtgaggtgtttggaagttatctctgatcttcctggtacttactataggctcattcagtttactaattaactccatctgccaccttaaaaacccttagtagtggccgggcacggtgactcatgcctgtaatcccagtactttgggaggccgaggcggacagatcaactgaggtcaggagttcaagaccagtctggccaacatggtgaaaccctttctctactaaaaatacaaaaattagccgtgtgtgatggcgcgtgcctgtaatcccagctactcaggaggctgagtcaagagaatcgctggaacctgggaggtagaggttgtagtgaggcgagattgcaccattgcactccagcctgggtggcagagcgagactctggctcaaaaaaaaaaaaaaaaaaaaagagagaaaaagaaaaaagaaaaaaagagaaactgttaatggctaggaaaaactttatgaaaaaacaaaacaaaaaacctgaaagataattttaaaatgagtaaattgtcacctaggcatactttgtcttggaaaaatagactatgactctgtctcaaaagaaaagaagtaaagggatagtgaatgataatatgtacttgtatatgtaaactgcatgagaagacaaggtgaaatagtcagatgtttgcatacatcaaatcatattaaggacattgtctgcagacgcgggccatcaatacatggcatagtgattccagtaccataagcaatgttgccctccatgatgtctttctgaaacaataaaaaattcttgttaaagtttgaaatgaaacaaaatacagtcttccttccatttacacactagttgcatttcttttttttttttttaacttattactattattttttgagacggagtcttgctctgtcgcccaggctggagtgcagtggcactatctcagctcactgcaagctctgcctcccaggttcatgccattctcctgccccagcctcccaagtaggtgggactacaggcgcctgccacaacacccggctaattttttgtatttttagtagagacrgggtttcactgtgttagccaggatggtctcaatctcctgacctcgtgatccgcctgcctcagcctcccaaagttctgggattacaggcgtgagccaccacgcccggcccactagttgcatttctagaacatttggagtgtacaaaaccctgcaaaatatacttttaaatatgagttaaattctgttgttaattaaaatttttttttgcctaaatgacttgtatgatttatatgaaaatgcaagacagttatttgtcgctgtgacaatcatatatactccacacattcctaaagatgggggtatggtactgcactcattgaaaagctggagcgagtccygctgaaatgaagcaactgtggttcaatcgaatgcccaacgccatcaagccagtggggacaccagtggaacactggaaaccaaagagaaatgaccttcatagctttctggtcaatcttgatgctaccataggatgatgctctatgctatacctcttggatcgttgcaaaaagttaccccttctttggagtggaccttccaaagttaaacagaagagtacgtcggccaggcgcggtagctcacgcctataatcccagcactttgggaggtcgaggtgggaggatcacctgaagtcaggagtttgagaccagcctggccaacatggtgaaaccctgtctgtactaaaaatacaaaaaaaaattagccaggcatggaggcacacgcctgtagtcgctactactcgggaggctgaggcaggagaatcacttgaacctgggaggcggacgttgcagtgagcagagatcatgccattgcactccagcttgggtgacaagagcgaaactccatctcaaaaaaagagggtatgtctcaatcttatcaatagaaggctttactcatagtagttgctaaaccatagggttggttgattgttgttctaagtgctaaccaagtgcttgagtgacatggtttatagaagctagaatcaaggtttagagaaactaggatcaaagtctctaaaagtgaagagtaacaatgatgggatgaatgcggaatacacatacctcgagttctctaagctcagtcccaggcaactgggaacaccagaaggtttcctgctttggtctgtatttgaaatacttccagtgaattacaatgtagtgttatatccttggctttaatttgaggtcaatatagtgatacagaaagtacagttttgcacatcttctgccaagccagaaggagctgtctgtctagggagttgatcgtcttagtcttttctttttttwcttcttgagacggagtttcactcttgttgcccaggctggagtgcgatggtgcgatcttggctcactgcaacctctgcctcccgggttcaagtgattcccctgcctcagcctccsgagtagctgagattacaggcatgtcccaccaatcctggctaattttgtatttttagtagagacagggtttcaccatgttggtcaggctggtctccaactcctgacctcagttgatccgcccgcctcggcctcccagagtgctgggattacaagcgtgagccactgcacctgggcaattgtcttagtcgtttgcattttgaggatgtctttctgtatttctttcagtgtattaaagctatagacagcatcttgacttttcatttcgttttgttttgctttgccttggctaccaggaaggtcagaaatacatttaaggttgaagtggtcactgttttacttcctgttcttagtagaattatcagtcctttttcactggctgctgatgtctctctgactttattttagctgtcttctataagcttttattgtaagctgcatcatatttttgttagatgtagaatagggtataaatgaccagtcagtcaagtcatgaaccttaagaaccttgaacaggccgggcgtggtggtccatgcctataatcccaacactttgggacgccgagggccygaggtcaggagttcgagaccagcctgaccaacatggtgaaaccccgtctctactaaaaatacaaaaattagccgggcgtggtggcgggcacctgtaatcccagctactcggaaggctgaagcaggagaattgcttgaacccaggaggcggaggttgcagtgagccgagatcgcaccactgcactccagcctggacaacagagcaatactccgtctcaaaaacaacaacaacaamaaaaaacaaaaaacaaaaaaacccggaacagcgcctggggtgttcaataaatatttactgaatgactggatgaatggatccaggaaatgaactgaatttcatttttctgtaacgcggagtgaatgggcactagggggagcgtgagctccctcttagccttcgaaagggcgtttcccacacttgcacctggggcccacaggcgggggtttgggaaagtaagtgtagtgctttgtaatgatcattgaaccctgtatttctgaagtgcgttaagacctaatagccacctgtatgagcgagcggttgagtatttcagattcccccaccagattcactgagtggtgtcattaccagccaatactgcagctatgtggtcctgcttacctggagtactggagaccagagccagagaacggagcacaaacagccacatgaaaagaaagcacagtgcacagagcaagtgtttgcagccaggtgcaaaaactcttcactaaaaacactcgagagccaggtgcagtggcttacacctgtaaacctagcactttgggaggctgagacaggaggactgcttgagcccagaccagcctgcgcaacatggtgaaacccatctctacaaaattaaaacattagctaggcatggtagcccrcacctgtagtcccagctactcgggaggcggaggctaaaggattgcttgagcctgggaggccaaggctgcagtgagccatgatggtgccactgcactccagcctgggtgacagaatgaggtcctgtctcaaaataaataaatgaaaactcaagaattagacaaaccagatggctctggacccagtagtacgattagtagagtggaaataagaagacagcatgaagaactgaggggcaagttgagaagaatgggctcgtgcagttggtgacttgatggctaatttgcaccttgccacttggcacttggtcacacacrgttttctattactttcctcttttccagagactcagagccttggggcactgagggatgccagttctgcctgttcatctggaacctggatctaaggagggaagaggcgttgcccctgctggcatagtcaggtaccagcccagccaggtaagaacctaaagtccttgttgctttgtgattttcccttcatctagagaggaggcctttggagaacaggtcttgtgggtgctttgtcagagactagaagccgagaacatcccttttcagagctctgggttttctgttcctcatgcaacctctgcagttgggatgaataatatattttaattttattttacaatagggaaactgacaaatattgaattcctgaactgagcaatcttggcctgtaggcccatgaacttggagaaaaaattaaatctttatttttattaacctttaactcaaatttagcattttcttaaaatatggatataggcaagaaaccacagtagaatcagcagaacttgtgactttgtcaccaacagaaatcacagatattttcataccacatgatatgttgtagctatctcaagacattgtttctattcatcactactttgaaattctgggagtccttagatcactgctagatcttaatatttcatgcatcaaggaacacatatattactatattacaatttttaaatatttcagtataatcaatttcttcctatgtaacacagcataccttattttatgcgtttaaatacgtaggcttcaccagactaccaaagattaagaaaaaggttaagaacctttgcttaaaggaaatgctaccttagagctctgttagcctctcattcactaatttgccatggatcataaattaatataatgcagattttttttgaagcctagcaaaggaagtttagcttttaaagcattgaaaggacgtcttatcactaagggattcccatagatttaataacaaaaatggtactataggaagtatattgatttgatcttctgcattttctggataaaaggatgtatgcagaacctttcagctgtcattaaacaaaaacaagagctaatgcataaggcagctcatgaaacttattcaagactgtaaataattgataggctgagcttgtggtggtgctgcttcatacatccttaattgattaaacattttttgagtgttgaagttaatggtaaaaataatagccaacagttgggaatgtcatttttccagtatttcttcaattagggtaatgtacattaaacacagacttttacgtcctctgaccactaaagttatggaatccatattaggaaaattcaagtttggaagtttgaggcttttagaaatatragaagtgttatttaagcaaatttaaaattttacattatcaccgcgagcagaaaatgcaagggtttgtgtagaatattttgtctttttggaagtaatgctgcagagatacttaagccaagaaaaatgttgccattttttgttttcttttctgcaggtattgaacgggctgagcttttcatgatggttcctgctgacctggaaacatcttaaatggaaggttagcttctatgagtcactgatactctttttattgctatttctaaatttccttggcttgaaaattacttctgctttgcagaaattatctgcttgcagctgtggataatttataacaatctctggtgaaacctcagaaaagagatatgcttttrtcttagatggatgtcagcagctgctgcagaacccggtgaaaacaccccccgggtagcacgaggctctgcgagccgtaactccgacaaacgcagaacttcttgaggctttcttcttctaaggagtatgacacagttaaaaaggaaaaaagaaccacaagcaaaacagttgccagtgaaataggagagggagctctttaaacaaggcyggctgcagctggcctccgccgctcatctgcagggcgtgagcgcttggtccatgcagtgaagctcttccaacctgggtcaaygaaaacggagaagaaatggcccaagaaatagatctgagtgctctcaaggagttagaacgcgaggccattctccaggtcctgtaccgagaccaggcggttcaaaacacagaggaggagaggacacggtaggctgcccttcccggggggtcactttgggtgtttagctttctctgcttggggcctgccactccgtcgccaatgctgtttgcttacaaatcactacccacctgctgctgggcttcgtgcctgagaagggtcctaacgaaggtctgttggtggagatgatcctccttatgtaactaaacgtagaggacgctcaggaggaggagggaggccgctcttgttattcatttaaaacggtgcctttgggcggtaagtttgctgtctgccatctgcttgtctgtttgccgacttcgtgggaatcattcaagggacattttcaggcttccagtttaccccttctttaaggaaagacctccagttaagggttttcctacctcatttttgacggtgccgggaggtgtaaagaaaagcaaagaaagaggctcacaagcagcaactctgatggaatccagccctgtctttttttctttgctcgcttttgcttcccagctggctttgaggaagggggagcataaaatatgaacctgcttagcctgtttcctgaccgctttgccaacagggaactcttccctgtctgtctctaagctgcacgggccrtttgatatgggtcagcatttagaaaagcgtgctgaactctagcagagcagygttccgccttagctgtcaagatccatctttaaacaggttggcgcttgtttatcaatgtctatggaggaagtgagggtttggtttctaatggcagaacacattagaaaacaaaactttggacaaccaaatgcttgaggagtgaggagaattttctggtatagtattcttcatcctccctgttatttcaaagctttctaagtgcacttgtaaactttcttccattaaaaactataatacagtctgggcgtggtggctcacgcctgtcatcccagcactttgggaggttgaggcgggcggatcacctgaggtcaggagtttgagaccagcctggccaacatagtgaaaccctgtctctactaaaaatacaaaaattagccgggcggtggcaggtgcctgtaatcccagctactcaggaggttgagacaggagaatcccttgaacctgggaggtggagtttgcagtgagctgagatcgcgccactgcactccagcctgggcaatagagcaagcctctgtctcaaaccaacaacaaaaaaacgaaaacaaaaactataatacagtgagaaaagtgaaattttatttgatgatgaaagatctttcagtgatttgagacatccttttgaatattaacaaagtgacatagacatagtgataacaaagttgtatttcaaagggtactaattctagggtagatcctgaaagttgaattttaaagtgcatttctgatgtcatcttgtttcttgggattggctcatcttttctacaagtaggtatcacagacattcataaaagagcgtgctagtaaatgacacctttttggtccaatacagtatctctttgcactatggctatttgtctaggggagtgggctgaccactyattaaaaaaaaaatgtagcaaaagcatagcatcagttgattttattgggcaacttatacccatagcaggatgtatgctgtgtgtttctagattattccatgccttgcagattagaatggatgctcctttcagtgtcttttcctctcctttcactattcttgcttactatcataacagcctttgggcaggaagggatggacctagcagggagcttctctgccccaggcatgttatttatactttgccatttagtcctcacagcaaccctgggaggtaaggtcatatcacctgtttcacggttgaaaaaacccttgagactcgactctgagatgttgagtgagagcccagttcacacagccatgttggagtccagggatgtcgaatgccaaagccccttcccttgccatgggggttactgcctgggctcttgccctatagcctggggtcaggtgttccatctaatactatcttctttaactctgagggctgcaggaaactgaaaacacacctgcagcatctccggtggaaaggagcgaagaacacggactgggagcacaaagagaagtgctgtgcgcgctgccagcaggtgctggggttcctgctgcaccggggcgccgtgtgccggggctgcagccaccgcgtgtgtgcccagtgccgagtgttcctgagggggacccatgcctggaagtgcacggtgtgcttcgaggacaggtaagcatggccggtggttggatccctcccactgattcaggtctcggaggaggcctctttacaaaccgctcataaagagagcactcactcctcaccttcagccagtaaatgtgtaccgagtgcctgatagggagctacctttctagccttggaagttatcttcatccaaaaataaattttatgtagcaacatttttttcatttacagaagtttgggccaagtgtggtggctcatgaccgtaatcctagcattttgggaggccaaggtgggtggattgctggagcccaggagtttgagtccagcctgggcaacgtagtgagaccccatctctacaaaaaaatacaaaaattagccaagtgtggtggtgcatgcctgtagtcccagctactcaggaggctgagatgagaggatcatttgaacctgggagctgtgattgtaccactgcactccagcctgggcaacagagtgagaacctgtttaaacaacaaaagtttgttaagtcgaaggatgggctaacccaggagttcagattcatttgggtctcttaactaagtgctgtcattttcttagcacttaatttatctccttcagtaccagtggagtaaattataatctagggaatattggagtaatcatctgaggctttaaatactgcgtttttgaagctgacctgtctttaatactcagstaaagaaatggacatgcttccctttagtgacagactgaatctacgtttatagttatcaattggtgtttagggggttttaataccagttttaacatggaattggtgtttttgcgttccccattctgaaaacgataaagagccaacttggcttagactccygctgttcaaagcaagaatgaactggccatgagctccgtgaaaacactagaggggtgactccgtctgctgggggagacggtgcacaaggacatcacagaacttcggagaagggaaggaatactaggctggtgtgaatgggagtcatcagagaccctgagatttgaaaacaacttctaaatattgccacagatgtgtgagtgccccagggacaaagactgtgggaggcacttacacagtgtgggcattgtggctggggtttcttccccctaaatccggagggctgtgtttaacgcacgccctggcattcatytacttaagtgtcctgtccctttgcaaggcttactgtatttcagtcatctagccagagaggtgaagtggttcaacctgatttctttgctcttgaactgcattccgtccatttcgctcacagcgtgccaagtcgcacggayggtggccgaattcgccttctcatctcatgtttctttggtttgctgaagccattgtccttcaggcttttccttgcttragagcaaaaaataattactgtgagctgccctggcggcatagagagcaattccaaatcatctctagaaaggtctcagkatcttcttccccatttcaaccaaccatatatatttgaagtctaataataaacattgctgggcagggtgttacatttctcagcattttttcttcttctaccaatgaactgtaaacgaaaaatcaaaacaagaggacaaggtctgaggcaatctcccaggaagctgacagtgttgaaatctctgccctagtgagtcttgtgtcccaggcactgtaactttaccctctaagtacatgaaatacgacttctaaaaccccagcttccttattttgaaatgaggttggttttcaaaatacttaaggtcattgcattactatgagtgcattaacaggagaagtcgggaggggagagagccaagtagtttgtggtgatgtgcattttctttcccctcgccttgctccctgtccccgcagccctctgtcctctctccagctttatccagtctgggctgtcctcctcctctttaggaccaaaagaaagatgagactttgtaaaactttagaatctttgacattcataactgtcgcacatctggggacctagaaaaggtttttgaccccgatcattgtctcccctgcttcttccttcgcttcaggctcatttctcaagaaaaagtggatctgtgacaggaacaagatgaggaaaattggtttttaaaatcaagaaaggggaagtgctagggtagcaatgaccaaaaccaaccaaccaactcgcaggttgctgcagaacaagaggcctgtggcaggtgttggccctgaycttgtgttgagaggttccagaagacatttaagataaagtttctgtcttcagggaaggttttctcttagagaactgagtgccaagttgctaagggccctgggagctcagagagggagagatgaggcaggctgagtggcwcaagacgacttccagaacatccatggttggaatagtcttttaatgttttattaaaagcataaaacaatcgtgtggggtagctactactttcatcctcattttacagttgagaaagtggaggattagagacacaagatggtttgtccatgtcatatcagtaagaacagagtgaagatggcaacccaggtccccccggcccccaggcctccttctgaatctccagtcctctcccgcctgctaggagccttgtcctgggagggcagagtcttttatttatttatttatttattttgagacagagtttcactcttgtcacccaggctggagtgcagtggtgtgatctcggctcactgcaacctctgcctccaggttcaagcgattctcctgcctcagcctcccaagtagctgggattgcaggcacctgctgccacgcctggctaatttttatatttttagcagagacggggtttcaccatgttggccaggctggcctcgaattcctgacctcaggtgatccacctgcctgggcttcccaaagggctgggattacaagcatgagccactgcgcccggccggcagagtcttaaaagccacttagaagagcttgcctccaagacagtaggagctggagcctgagcatgtgctctttgccaagcgaacaccatgccgaaagtctgcctggttttgcagggcaagatcaggagagcggaaggtaaaggtaaaagagcaatctgagagttgctgcagtgaatgagaggcaccgagggaggaggctggtggcaatagtgatggagaatgggagagacaggaaaaggggaggatggaccttggttacaggggataaaagagaaaggtgaaaagtgattctgaggactggccagacaggtcgcttggcatgctgaactggatcacggggcatccgagaaccgaaggaacagaaagagcccagtaatcaaaggcacactggaaaggacttagaagaaccaaggaaagttgttttcagtagtgaaggggctcctgttgtcctcagcaggggccgatcagaagagggtgacttgggaggagaaacaaagaagttaaaagcagaaacatccttgttttccactgatgtttcttcccggggaatgtattgacactttctgcagtgaaatggcagatggtaacaattatgttgaaatatcaaggaggagactatgctttgtatgtttgttttagcttcatyaaaaaaataagattaaccttgatgatttatgtttgcattaattttttctattaaaacgaatatactgtrtcataactaattccacatctaaaagaaacctggtcttctcccttaagattgctgaggaattactcttgttcagacttgtttccttcaaactgtgatcttcttgtcatgctttgtaattgctgtgacaacaaatcaatgattcttcagcttcaggtatctgtggacacactgcctgtttcgttaggaacattttgctgccagtcaggtgctttagaaccaaattggtttgtacagagaattctgtaagttgcaagtattttaacaatgataaaggtgcaacggagcttatataccatcattagaacagaaggtttcaagttgcagcaggtgatactgttgatttcagggtactttcctgaattgctcaaatttgtctcttgtaccacacctgatgccaacaaagagctgcttaagtgtgttcggttgaaaaattgatccagaccttggcattttattattatgtccttagttctcaggttgggtcttgagttattgctgcagagcagtagtggttaaaataagatcttggaatttatcaaaagggaggtgagctggatgtggtcatccacgaggtcatggatgtggtgtgtatgcytgtggtcccagttactcatggaatgcccaagcgggaggatcacataagcccaggagtttgaggccagcctggccaacatagtgagacctcgtctctgaaacaacttaaaaaggttttttgttgttgttgttgttgtcattcagcatttcagataaggacttaagatgtaaagatattgttacaggatgatgcattgtattttctgcattgcatgaaagaatttttattgaaaatgaagtgacatttcaaaggaagttctattctaattatgtttctgcctaaagtaaacttcccagattttagaaaatgtaatcttttaaatttcagactggttttcccagtacttttataatcccatgttttgataaaatattgaattatcattttatattcacaaaggcaaataactagtgtatgagaatgggataattcactctcactcttgaaaatatatctacycttcaagtgagtaaaaggtctaactctgctaactctgtaaaagattgaaaagaaattgaatgccaagtgtgatacaggagagttggcaaggaaagattttagcctggtgccaaggttaagatgatatttgtctactgactctttcctgtttcaaaaccttatttctttttttccctctaaatcctacttttaacattgctggcygggcatggtggctcatgcctgtaatcccagcactttgggaggctgaggcgggtggatcacttgacgtyaggagttcaagaccagcctggccaacatggtgaaaccccatatctactgaaaatacaaaaattaggccgggcacagtggcaggcgcctgtaatcccagctacttgggaggctgaggtacaagaatcgctggaaccggggggcgaaggttgcaatgagcggagatcacaccaatgccctccaagctaggcgacagactcaatctcaaaaaaamgaaaaaaaagaaatgtacagagtatttttttttttttgagactgagtctcgctctgtcgcccaggctggagtgcagtggcatgatctcggctcactgcaagctccgcctcctgggttcacgccattctcctgcctcagcctcccaaatagctgggactacaggcgcccaccaccaagcccggctaattttttttgtatttttagtagagacagggtttcaccttgttagccaggatggtcttgatctcctgatctagtgttccgcccgcctcagcctcccaaagtgctgagattacaggcgtgagccacggcgcccggcctatggagtactttttagaaaaaaaaagtttcttttgtgtttactaaagggaatgttttgacaatagtgtgtgtgttttactaaagggaatgctttgacaatagtgtgtgtgtcattcttcttgttgaaactgaactgtattctgtagtcagcacttgattagttagggaaagtcctgcctttaaaacctttytgagaaccggtgagctttctgcgcattgtcttttgttaatattctctgttgtcaccttacgtagttcagctgaaacctgtcaccctgtaagggaggggagccccaagagagtttttctgggttggcattttgcatggtagccaagacagtttagcatccagggttcacaccaagaatggtttatagataattttatcggtggctcatgcctgtaatcccatcactttgggaggctgaggcgggtagatcacttgaggtcaggagttgaagaccagcctggccaacatggtgaaatcccatctctactgaaaatacaaaaattagccgggcatgatggcgcacccctgtaatcccagctactctggaggaggctgaggcaggagaatctctggaacctgggaggcggaggttgcagtgagctgacagcgagactcagtctaaaaaaaaaaaaaaagataattatttaaattatttagccaatcattttgaaacctctatatttttataattattatctatatgttatacagcatctctttccataattatttttgttaccttcagtgttttctgattatatttacaacaatattttaaaccaactttgcattttataactgattcaagtgctcattgctagtctttggagaccatgatttcccagtttgcaagttctttattttgattcatttttcaatcacttgaattgcctccttaagaagtttttcctcacacctgtaatcccagcactttgggaggccgaggtgggcagattgcctaagctcaggagttcatgaccagcctgggcaacacagtgaaaccctgtctctactaaaatacaaaaaattaggtgggcatggtcgtgtgtacctgtaatcccagctacttgggaggttgaggcagragaattgcttgaacccgggaggcggaggttgcagtgagccgagattgcactactgcactccagcctgggcgacagagcaagactgtctcaaaaaaaaagttyttccccaggagaggactgtgagtggtgtattttccacgtcattgcgtatttgagagttgctttccgtggtcttccttcatgaggaatgatttcactgggttttaagtcctgggttgccactgtttactcagtaaatgcagccatgttgccttttggaatttaacattatggagacagctgatgctagttttatttttatttcattgtttatctcctgatttttatgtagaagaaacatactggtttttttgtttcttttttttttttttggcagagactgcagccttattctcttttaaaactttttatttagttggtttttaatttttttaatttaattttttttttgagactgagtctcactctgtcgcccaggctggagtgcagtggcacgatatcagctcactgcaacctccgcctcctgggttcaagtgagtctcctgcctcagtttccctagtagctgagattacaggtgtgtgttaccacacccagctaattttttgtatttttttrtagagataggggtttcaccttgttggtcaggctggtctcaaactcctggcctcaagtgatctgcccgtctcggcctctcaaactgctggaatttcaggcgtgagccacctcacctcacctagttagtttttttagagacagggtgtcactccgtcacccaggctagagtacagggygtgatcatagctcactgcagcctccaacgcctgggttcaagagaccttcctgcctcagcctcccaaatagctgggactccaagtacgcaccaccacatctggctgatatagatatgttttaagacaaggtcttactatgttatccaggctggtcttgaactcctagcttcaagtgaccctcctgccttggcctctcgaagtgctaggattgcaggtgtgagccaccatgcccagttattttttttttctgtatcctttttattaaaaacagtttctaatatgtgtctgggaatgatgtttttgtggattaagggccgttcttttgagctgctccctcttgggtctcctgggtttttatttcggtttaactcagtcatgctttcctcagtcaagtctgattgttctcaagatgctttcatgccacttacacagcttctttgggaayagcatttttttttttttttttgagacggagtcttgctctgttgcccaggctagagtgcagtggggcgatctcggctcactgccagctccacctcccaggttcacgccattctcctgtctcaggctcccgagtagctgggactacaggcgctggccaccatgcccccctaattttttgtatttttagtagagacggggtttcaccatgttagccaggatggtcccaatcttctgacctcgtgatccactgcctcagcctcccaaagtgctgggattaaaggtgtgagccaccacgccccgccaggaacagctttgaaggcataagttggcttccttttctctttgtattaataatcttcttcctcgggccgggcgtggtggctcacacctgttatcccagcactttgggaggccgagctgggcggatcacttgaggtcaggaattcaagtccagcttggccaacatggtgaaaccctgtctctactaaaaatacaaaaattagttggatgtggtggcacatgcctgtaatcccagctactccggaggctgaggcaggagaatcgctggaacctgagagttggaggttgcaatgagccgagatcgcaccaccgcagtccaccctgggcaacatagtgagactgtgtctcaaaataataataataataataataataataataataawgatgatgatgatgataatcttctccctcaacatttaatgtctttttctttctctttcacattctggcaagtgtctctgccaagtcagcctcacagattcaactttctagcctgccatttctgctcttttctgctgatgaaacagttcattctgctttggctctgttagtttatgaaatattcccttattgtagtcccaccgtctcttcatcctggctcttccttctatcttgctgtgtctttttctcagaggtgggtcttaaatgtttttggaggctgactgctttctgaaagttccctctggttccacggtgatgcacggtcacagaggctgctggcctggtcttctggactccatgtaccctgactatggcattttatcggaagctcttggttgtctctttagaaagccaggttgagcggttgcccacagagagcgtgtgctcctgctttcggccttctcatcgcccctctgtcgtggtggatcccccttcttaggtctacagggagaggacaggtcggggcacagcatctaaccgtttttatygccaaggccttaaacaagtacggctctgtccagctgcagtagaatttttcctaatttcattgactggttatctgatataacagaccaggagtcacaaacttgacatcaacagacgacagacagggcacagaccttgtttgttctgacctgcgcagtgtttaatattgatcattttagtgcttcaaaatgggtgtgtatcctctggttaagcaagttcccacccctccctgttgtctcccctcccagcccccttccctcatttacagtttctgcttgggccctcagtgtgtggccctgcccgacacagttagagggtgtgacacctactctatgtacatatgtagaaagctgaaactggatcccttccttacaccttatacaaaaattaattcaacatggattaaagacttaaatgttagacytactcaatttcagtgcacactgctacaaggctacacctattttggatcccaccttatctctttaattctaaggatgcccccctgcggaggggaggatattcattcattcactggggctgtaatgtgcctggccagagcttgtagctgtgaatatagcactggatgtgacagagaggggggcacctgccttctctctgaggttaagcaagggagagttattcgtgttttgtaagaagtgttggtaacagcttgataaaaaccctttctttatcttcatcttgattctctgactcctttgatagttacctaggattcaatcacaatgatcagtcttttttttcctgtaaggatgtggaaatcagatcaattgagctrgtggaaaaaaacgagtattttgctttgtaactatgaaccattttagatgcgagactagttgaagtagggccggtcacagtggctcacgcttataatcccagcactttgggaggccgaggtgggtggatcacctgaggttgggagttcgagaccagcctggctgacatgatgcaatcccatctctactaaaaacacaaaaatggccgggcgcagtggctcacgcctgtaatcctagcactttgggaggccaagatgggcggatcatgaggtcaggagatcgagaccatcctggctaacatggtgaaaccctgtctctactaaaaatacaaaaataaattagccgggcgcggtggtgggcacctgtagtcccagctgctcaggaggctgaggcaggagaatggcgtgaacccgggaggcggagcttgcaatgagccaagatggcaccactgcaccccagcctgggcgacagagcgagactccatctcatggataggaagaatcaatattgtgaaaatggccatactgcccaaggtaatttatatccccatcaagctaccaatgactttcttcacagaattggaaaaaactactttcaagttcatatggaaccaaaaaagagcctgcattgccaagtcaatcctaagccaaaagaacaaagctggaggcatcacactacctgacttcaaactatactacaaggctacagtaaccaaaacaacatggtactgttaccaaaacagagatatagaccaatggaacagaacagagccctcagaaataatgttgcatatctacaactatctgatctttgacaaacctgacaaaaacaagcaatggggaaaggattccctatttaataaatggtgctgggaaaactggctagccatatgtagaaagctgaaactggatcccttccttacaccttatacaaaaattaattcaacatggattaaagacttaaatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaaccaccatcagagtgaacaggcaacctacagaatgagagaaaatttttgcaacctactcatctgacaaagggctaatatccagaatctacaatgaactcaaacaaatttacaagaaaaaaacaaacaaccctatcaacaagtgggcgaaggatatgaacagacacttctcaaaagaagacatttatgcggccaaaaaacacatgaaaaaatgctcatcatcactggccatcagagaaatgcaaatcaaaaccacaatgagataccatctcacaccagttagaatggtgatcattaaaaagtcaggaaacaacaggtgctggagaggatgtggagaaataggaacacttttacactgttggtgggactgtaaactagttcaaccattgtggaagacagtgtggcgattcctcaaggatctagaactagaaataccatttgacccagcaatcccattactggatatatacccaaaggactataaatcatgctgctataaagacacatgcacacatatgtttatcatggccctactcacaatagcaaagacttggaaccaacccaaatgtccaacaatgatagactggattaagaaaatgtggcacatatacaccatggaatactatgcagccataaaaaaggatgagttcatgtcctttgtagggacatggatgaagctggaaaccatcattctcagcaaactatctcaaggacaaaaaaccaaacaccgcatgtttctcactcataggtgggaattgaacaatgagaacacatggacacaggaaggggaacatcacacaccggggaatgttgtggggagcggggagggatagcattaggagatatacctaatgctaaatgacaagttaatgggtgcagcacaacatcatggcacatgtatacatatgtaacacacctgcacgttgtgcacatgtaccctaaaacttataataaaaaaaaaatgagctggttgtggtggtgggtgcctgtaaccccagctacttgggaggctgaggcggaagaatcacttgaacccgggaggcagaggttgcagtgagccgagatcatgtcattgcactccagcctgggtgacaagaatgaaactctgtctcaaaaaaaaaaaaaaaaaaaaaaaaagactatttgaaataaaaaaaataaaaatccaactgtatgcttgcataggactaatttagctgggagttactgagcagttggacaaactatcatgaaaaaattaggctgatctcagttttacaatatgcagcttctgctgctgctgcttttgttgttgttgttgttttaattttatttgagagacggtctcacactattgcccagactggagtgcagtggtacaatcttggctcactgtaaattccacctcctgggctcaagcagtcctcccacttcagcctcctgaggagctgggactactggcrtgcaccaccatgtctggctgatttttgtatttttggtagggatgttgctcaggctggtctggaactcctgcgttcaagcaatcctctcgcctcggcctccgaaagtgctgagattacagrcktgtcccaccaatgcgacttcttgatttgaagtttttgtagttcatgtgtctaaaggatctctggagacctccttgccactggggtactggttggagaacagttctgcacaggagatgtgcttctttagggatttgaagaatcctggctgtgcagaccaattttctacttcttgtcagttgaatggtgaaaatacgttaagcaactctagggacatcatgctgacttttcttggaacatacagtgtagatgcagtagcttagccacctgcagatgcaagcaatttagatgcaaaatgcattacaacacgtgtgtttggctcactgcttggtgttagtaatgaggtcaaaatattttctggtagagtcctccattcatcttattgaacgtttgtgtgctagaatttgcaaagtgtttttcaacagttatttctcctttgataatgaaatgacagcattaacagaattcagggctgtgaaaatggatgctgaaaaccccagaagtttattaagagccatctaggcatccagtgcttggcatttgtaattctagtgatcctcatgcagttaatgtgaaggtcagtcatgggtcaggtctcctgattctatagcttcggccctccccaccaccctaggcttttgccttttgagatatatttatgggctaattgaaaaaatttttaaagaagtgagtcatgattctgaaaagtttaagggcacaaatttattgctgaactcataaatcttccaagaaactttcataacctcattctgatttaatcacctgggaagaagtgctagatgctttctttggttactaatgaatcacactaccctgtgttggccctaacatggacagagactacaggatctatcacctctatcatagactctaagggcagtgagtggtcctcctttgtaaacttgggattaggccgggtgtggtggctcacacctgtaatcccagcactttgggaggccaaggcaggcagatcacttgaggccaggagttcaagaccagcctggccaacatagtgaaaccctgtctctacaaaaaatacaaaacttagccaggcatggtggtgcatgcctgtaatcccagctacttgggaggttgaggagggaggatcacttgaacctgggaggttgaggctgcagtgagccgagattatgccactgcactccagcctgggcgatagaatgagaccctgtctcaaagaaaaaaaaaaagtcttgggattagtgcagacagggagtccttacaaaagatattgtggaataattgcttatgaagatgctgattttgcaagaaagggtaatggacacccgggccaaacctagtattcaaagcaagcagtctcaaatgcaaaaagtgctggttgtcatatggtttagggataaaaatactgtggtatttttactttattctttaatcacagataggcccaagagatcctcgagtttatgyccaaatctctatatgccaaattagctcctgtttaaactgcacaagtaatcagttggaattaaatgagattagatggttctattagatgattcgcgctgggtgactaggattttaatttatctactacttgtgtaggttctgaaaccagggctggagtcctttcaatgatttgcaatgttcattcacttaggcactttcaccttttgctcttccctcaccttagctgtttttcattttctgtgattgtatgtctgtctgtgtgtgtgtttacttatcgatgttgtccccctgtctgattagctcagtcgactgtagcgtctcagatatggatattttgggcccagtggtaacgggctggagcatgtgagagaggagatgagctgaaatgggtcactcaccagaaaggcaattctgcaagtaaggtgcgtttatcaggcgggggccttgtaattcctgccctttggatttgctttctgtcccctcctctaaggattagaccttgttctgtttgccaggactgaagaggcatctttagaaattgaatatggagaggtgcagcccttcaaaggcatgggaatttaccacccatgactccctctggacttgccctgattttttatgttytgcttcccacaagtrctccaggggaaaacttytgcctagaggctgagactgccttaaggtgttttgtgttgatgtaggggattagataattgagtttctgactttatggatgcaaacttttccctgtctttgtagagacatatcacagttgtacactttatatatttttggctctgaatggtaatgactgattaccaaaattytgttataggccagatgctgtggcccatgcctgtaatcccagcactttgggaggccaaggcaggtggattgcttgagctcagcagtttgagaccagactgggcaacatagcaaaaccccgtctctacaaaaaaaaaaaaaaaaaaacacaaaaatcagccaggtgtggtggcacgtgcctttagtgtcagctactcaggagactgaggtgggaggatcgcttgagcccgggaggcagggattgcaatgagctgagatcgcgccactgcactccagcctcaacaacagagccagaccctgtctcaaaaaaaattatgaaattcttaaatgctctttctatattttccttgttctagtcactaagtattggtagtaatcatttatgtactaatcagaaaatagtagtgtctaaccagatgaaggagagaaagttagttgatatcttctsacaattactagcacttcatagagaaagatagcatattttgaaaaacgtgcagattggcatatatttgtgattttacttacattagcaagcattaattttctaaaaaatccacttgagttcatgtatagcctgaaagaacctaatggagaatttatttcagtcaatactgtaatttatagaagagamtcagtcatgagttgaagttttaatttttttcttaaatttgcataacaaaggaattggccagttttgtggcacattattttaaggatgtgaagatcttataatatttacatgtttgcctttttatatcctaaaaggatattaacaattctgcctttctgagattgaggttgagtatggattcccccagaaaaccaagaggaaaacccatgttaggacgtcagtttggagcagttagcgtctcgagtgccctctgtgctgtcatgcatgtgactaagatggtaggagttaaagtcctgccgtagggagctgctgtcagaccagtgggccaaacagggctcctttcccatgattcacaagtggtctgctcaggtggatcgcctgaggtcaggagttcgagaccagcttggctgacatggcaaaaacctatctctactaaaaatacaaaaattagccgggtgtggtggcgggcacctgtagtcccagctactctggaggctgaggcaggagaattgcttgaacccacgagggggagattgaagtgacttgagatcgtgccactgcactccagcctgggccaccagaaaaacaacaacaacaacaagaacaagttgtccactcagatttaagcccccaaatctccatcaacacacattgatcccatattccatacttcaggtcctcccaagaatcttctcaggtaaccctgctctgtgggctcttggagaatgttgtaaacacaaactaaccttagcttaacctacagctgatctccctccaagcccaatgcataacatcgagttttcctgtagcccatcacttgtgccaagagcgtcccacagttgacatgatacattggtcatttgtggtgatgttgagatggaggcctgctctgtcacccaggctggagtgcaatggtgcaatctcggctcactgcaacttccgtctcccaggttcaagcgaaaattctcctgcctcagcctcccgagtagctgggattacaggcatgtgccaccatgcctggctaattttgtgtttttagtagagacagggttttgccatgttggccaggctggtctcgacttcctgacctcaagtgatccacccaccttggcctcccaaagtactgggattacaggcgtgagccaccgcgcctggctgatacattggtcattttgatgataataattttgtttctctttgtgtatttgttcacaaaatattaagtactggattcgtgctgggcacaagtatatgttaatatgcttaacattcacttttttttttttttttttttttgagacggagtctggctctgccgcccaggctggagtgcagtggcgaaatctcagctcactgcaagctccacctcccgggttcacgccattctcctgcctcagcctcccgagtagctgggactacaggtgcccgccaccatgcctggctaattttttgtatttttagtacagacggrgtttcaccgtgttagccaggatggtcttgatctcctgacctcgtgatccgcctgcctcggcctcccaaagtgctgggattacaggcatgagccaccacacctagcccatattcacatattatacattgaacgtacacatgacatgcaagataaaacacatagcggtgggagttgcacagctttgctgctgatactgaaatcacttcgcctctatggggaatctgtaaatttaagtgtttaagccaggaaattgattgctgaggtccattgcaagactaatattttgtgaccttacctaacccttaaaaggggtaaatatagcactattcatatcttctctctctgaagcttcctttctgctcattttttcaggaatgtcaaaataaaaactggagaatggttctatgaggaacgagccaagaaatttccaactggaggtaaatgctctttacttttttagtaaagtaaaatgatctattcctagttttaaaatatttgatgttaagactttggaatataagcaacatgatgggtgtagtctgcgggcccctatgtcttgccattccatttgctgatgctctcactgtaattcacgctgctcattccctctgctcgctactcttccctctgctgcatttctacctctgaggttggccctattccttttttttttttttttttttttttgaggcgaagtcttgctctgttgccaggctggagtgcagtggcacaatctcggctcactgcaacctccatctcctaggtttaaacgattctcctgcctcagcctccggagtacctgggattacaggcacgtgccaccacagtcggctaatttttctatttttagtagagacggggtttcaccatgttggccaggatggtctcgatctcctgacctcatgatccgcccgcctcggcctcccaaggtgctgggattacaggcgtgagccactgggcccggccaggttggccccattctttaaggctcgtgcactacaaggtttccctggcttcctgcttctaggggtgatgtcccctcctctgaaacaccatcagtgctgggtttgtaattctcttctgtaattgttgcaaagttccttatattgtagcattgtttgtgcacttctgtttctctctacaagcagtaactgtgattttaaaatcttgttagcccatattgcgccaaagcacaataccttgtttataatacttgagcaagatgattgaatcagtgaagaccacagtgagtgaagagcgtttgaactgagcagaggttgatgcttgtggagtgagcgcatgttgcggtaatatgggtggaagcattttgtccgtatactgtgaatgtcttataatgagatgttgacctaaagaaggaaactgaggcaaaactaatacaggtggagagtttatctgggccaaggctgaggtctgcagcccaggaaacacttccaagggctctggagaacaaaggagagaagggtgaatcaggagaggggcgattacaaaagctggttttcaggaattctcgtgggtttacggaaatacccgtaatttattcatgattcatgattggctatccattgctgagctataggctgtgggtgatggtgtccagtgtgtggcattgttaggataatttatggctattggtggtgacactcaatctagagtccgtagagcaagtggctttgaaatgattagcccaagttgggggacgtgattgcgggctcatttcggtgtctctctaggcctgatactttaaaggaggcttgtgtttcttagattaaaagtttattttctttttcaaaagtatttgcaatgtatgktgtgccagtgtaattggtagctgggacctggaactgtggagagaatgatttgtgctttgatcacagaagagctgtgatggggcatcaggacaaaggcgcacacaggcaccgtcacggtggagtgcaggcaggtgctgtgggaaccacatctgactatatcagggatgcgggcagcacccctcctctgtgatgtgatgttggggacctagactcacagcctgactcagagggcagcggtggctcttttctagaaaaagtggcaatttgcaggtagggaaataagccatagaacctcacccaaaagtttgttggcagtaaaggaagccattcatttgggttgatattcagcttttataaagggtggatttgcccaggtgtagatttggttggtactaaattatcccatggtttatattcctggctcttcttaaaaaaaaaaaaaaaaacgctgcttctgccaagtttattggaaacctggaggaaaaaactaatactaagggtcatgtcaggcaatggaatgaagcagggttgctgtttcctctaagccagtgtttctcaacagcttcttaccgccaccctctcccctaccccacatagcctttttagagactttttcaaagttgctaccataaccttttgatatcacagatatcatatatctatgtactgaggccttttggagagccacagacggttgaaataggtaagatttgctaccaatctttgtccccttaggggtgccgtcatcccatgtggaatgtgtgaccttggcaaagcaactgcagcacaggacttttctctgtttttattgcttttatgtctctctctctctctcttttttttttttttttagatggagtctcgttctgtcatccaggctggagtgcagtagcatgatctcagctcactgtaaactcctcctcctgggttcaagggattctcctgcctcagcctcctgaatagctgggattacaggcacacgccccatgtctgactaatttttgtatttttagtagagatggagtttcaccttgttgactggtcttgaactcctgacctcaagtgatctgcccaccttggcctcccaaagtgctgggattacaggtatgaggcacttcacccggccacttttgtgtttctttaaaatacttttttgaccgggcccggtggctcacacttgtaatcccagcactttgggaggccgaggtgggcagatcatctgagattgggagttcgagaccagcctgaccaacatggagaaaccccgtctctactaaaaatacaaaattagccgggcatggtggcacctgcctgtaatcccagctactcgggaggctgaggcaggagaattgcttaaagctgggaggcggaggttgctgtgagccgagatcatgccatggcactccagcctgggcaacaagagtgaaactccatctcaaaaacaaacaaacaaacaaaaacaaaacctttttgttggtgggctggagccttcttcagaaggtagactctacccttttccacatcaattcctagcttataaacagtagtgctgtaggaggtgaagtttgtcatttctcaatgccagctaagtgcagacatctgcttcactcaaaaagttttctacgtcgttagaagttctagcatcattatttcaggtaagtagttttcatgtgtgcatgaatgtatgtgtgtgtgtttgtgcacacacgttaccatcttgtcatcttttcagcacttcatgtctcctgagtgagtgggagaagtatgttatcaaggtgacttaagataaaaagggaattaggaaagaggtgagactgatgtcttagggttttctttcttgccttataactttaagaataaaaacttcagtaaggacaaacaaaccagggtcaggaagatcaacctcagcataaatcattcttttttgctgatgtcgtttctatcaatgtataaaataaacaccagaaaagccctaactttccctccttctctacaatgcttcctcaaatgccagggtgcctcattttcccattgtcctgtttcagtagagttggggtaagaggcatggaactatgggggaaaatgccaggttaggagcacacaagtagtgctatgagccagaccaggttgggtggagtttgcagcgggtgcgtcaggaaaggtaacaaggatcaggtgacagaggtttaggtggacaggcaggaattccaccacgctcctatttgtggccctaaaagagaaccaggtgcagtcattgaggagttgaattgaatttgtgctgcagcagttaagatccacttagggaaatagaaactgtctggttatttgaataagaatttactttagggattggttagacaggaattggaggcaaaaagggaatagtgagagaacagagctagcagctgcaggaggcagacaccctccgaccctgttgagctgatgctggccagacacaggtcggaaggaaggcatgagccccttctccctcctcctggccctggtctccctctggaagcccccactggaccctaatagggaggcaactgcaacctcaattctctgatgtgttccggaaaaagtggttttgcatgttctctagtgtttttgttgtcatggtaccggcaatactctttccagccctctatatcctgagcagaagttagaaaaactagatggtggtttaaaccacaaaagtgtacagacagctccagtctgtgcctctttccacgcactggttatctattgctgtatagcaaattcccctcaaacctagtgacataaatcaagtaacattctttgacagtttctgtcttcagtggaaggctcgcctggggctgggggatctgtgctcttggggcttaccctcatacctggccagtgactgctggtattgggaggaggacttggttcctcaccatggggatatctccacagggctgcttgagtgtcctcatgacatggcggctggcttctcccagggcaagtgatccaagagagagaaaagcagagcccacaatatcttttatggtctagcttcagaagccacaccctgtcatttctgctatgccctatgggtcccacaggtcagccctagtcagagaggacaaagggtctgaatatcaggaagcaagaatcactgggaccgtctgtgtgctaccaaatcctgtgttccttgtcttgggagaatggcgacacctctcactctgtctccaaatccacagacctgagaatcaaacttgactcctttgttcctcattctgccgctacatctggtcagtcagcaaatcctgacatttctgcctcctgagtctctggaatcttcctctgcccttcattctcacttccaacgtagcagctcctaactgcttcccccttggtccatcttctattctgtgaagagagggagcttccttttctctttgaaaggaagttacttactttctgattacagaagtaatgcaaaccttgcaagcatttgggaaacacagaatagtatttagatgtaatggaaatactaccacaatcccaaactactgtaaattacatgcacgtgtacacacctgcacactcccagccttctttctaggtaagcctgtgtatatgtgtgtgcacagatagacttatccaatttcaaatgtattgtgatcagactctatgtggttttattttgcttttacaattcaacttggcataaacattttcctatgttattaagacttcttccaaaatgtattgatgactccataaaatacaccaaatatatgcactatagtttatttaacctgttcccgagtgtctgtgagtatatcactgtatttgatttttcatgttatagataactctgtgatgaacgtcttgtacaggtattttgacatgtctgtttatttttggggggtaaattcttagaagaatgattggtcaagtgtatgaatacttgaaaggcttttgatgttttgccaaattaccctctgggagtgtgtgcttatttacaacaggctggcagggtacacaaatttccttcttcccacactctggcccccattacattctgagctttgaagcatgatttcaaattacattcacgtaaaaaactagacgccaggctcagtggctcatgcctgtaatcccagcattttgggaggtcaaagcaggaggatcgcttgagcccaggagttcaagactagcctgggcagcatagtgagatcctgtctctaaaaaaattaaatgaaattaaaaaattaaaacctagaaaatgaagaaaatcmtaaagagcaatgttaaaaatacagcagcttcacccagagaacaattgttgacattttagtatatattatttctgttcttttgtgagtgtatgtatctatgcttgtgggtgcatatctgtatgtgtggatatatgtgtgtgtatacacacatatacayagacttttttgaagtatttaggttgaaccataagaaattggtatttttaggcaaaaaattattgaatagaggcaatttcacatgagtcaggctaatatatttacataattgaaatcaaattgtatgtacagttttatcctaatgtttcttcatgtagtaatttataaggaacattttcagtgtccataaatatcattggctatatgatttctgatgagtgtatctcaccccgtcataggaatgtgtcatcatttgtttaaccaaataactattgttggatagttaggggatttccagctttctgttgcatttttgaaagtttataaggttattaaaatgagaataatgcaaagaatatccttgtagatatctttttggcacatctctgaatatttctagaaagagaacaagatgaaggttaggaatgttgcctcctttagaaagggtgtggaattatccttaaaaataaaccaacatgcaaaccaatagataactttatcagtttggcaaaacaacattggtcatgcaaaatggttttctcatcgttttgatttgaattcatctcatcacgaataagattgagtatcttccacttttcaaccttctgtagatgttcttggtatgtgaaggcgattagtccttttcaatcatgttagttgcatgttatcttcctagtacatggccttctttataattttgtttttaacacaaagaagttttttgtttgcttgtaggcaaatctccttttyccgtataatttcttttgcttttatgcttcgagacttcttccttatcctgtgataggttaaatatccacattaattttcttctaatttttacttaacttttttttttttttccccttgagacagagtctcactctgtcacccaggctggagtaccatggcgcaatcttggttcactgcaacctccaccgcctaggttcaagcgattcttctgcctcagcctcccaagtagctgggattataggcacatgtcaccatgctcagctgatttttgtatttttagtagagacggggtttcattatgttggccagcctggtcttgaactcctggcctcaagtgattcgcctgccttggcctcccaaagtgctgggattataggcctgagccaccatgttaactctttacaatcatcaggaggccctatctaattttttttcctcccaatccttgatgttcctggtaccatttgttacataaccattccctttcccattgcgttgtaacccagggccactgattggcacagcgtggggcaccactctccttgtgcccagccctgcgctccagcgggtgctgtctcatagaggacacacggtgccctctccttcacctgcaactcttggcaatttggccctagccagattttgaatgtttgagagcaggagctatgagtaaaggaataagtgaataaataaattgagcagggatctgctcatttggccacaaaaagtgctgttagagggagtagtgtccattgtcagtgcccagcactgagtaggcaccttacaaatgtagacatccttccctttttgacacggggaaacctaaagctaaatgtaacattcagttgcagtaattccaggaatcattacaccctctgcacccagtttcctttttattagcttttacttatttctcttttgatgatcttattggatatgtgcaatttaagataaaatgccccccagatttccttggaagtagacatgctataagaatctagtgaagaataataaattgtggtaatatgtgttgtgctattttttcaactattaaaacaatttaaaaacaagaaaaaatgagcctcagttcttcattttgtagagcgatagtacaaaaaattttaaatattttgatttatttaaaaatttttctgattataggctggctttttcccctaaaatttcataactggatatttagttttgtggtcttaaaataatttctttgatgccaccgtggtggttcatctgtagtacattcgaattatcaaagcacccagaccttcataggctctcttgcctttaggaagctccccaggacaacctggcatcatcaccttctgtgcctccatccacggrcatttggcaatccgtgcagagggtttttaatgtggttcctggacccrcgctccaggatcagctgcaaactgattcaaattcaaccttcctggcctcacacacacaggttctaatttggtggggccagatggggttcaagagtgaatgtttggctaagggcggtggctcatgcctgtaatcccagcactttgggaggatgaggtgggaggatcgtttgaggccaggagtttgaggccagcctggtcaacatggtgaaacgctgtctctaataaaaatacaaaaattagctggacatggtgacacacgcttgtaatcccagctgctcggggggttgaggcaggagaatcgcttgaacctgggaggcggaggttgcagtgagccaagatcatgccactgcatccagcctgggcagcaactgagactccatctcaaaagaaaaaaaaaaaagtgactgtttaacagttccccaagtaacttttttaatgtactttaagtaaagtaacaaaattagtaaacaattatgatagaacttttttagatcactaataactagaaaacaagctgaaaattcatctctcctcttttggcatctgctaagcgtatagaaatgatgccctcttctggctcctccctgtaaatgcacctcttttactttttttcttttttttaacaaccatgacattctgttacttgatgtacaagcttaaaagcagaaagatgacaatattaatattaaacttttttttttcttttttgagacggagtctcgctctgtcgcccaggctggagtgcagtgatgtgatctcggctctctgcaagctccgcctcccgggttcacgccattctcctgcctcagcctcctgagtagctgggactacgggcacctgtcaccacgcctggctaattttttgtatttttagtagagacggggtttcaccgtgttagccaagatggtcacgatctcctgacctcgtgatcggcccgcctcggcctcccaaagtgctgggattacaggcgtgagccaccgcgcccggccaatattaaactttcttaagttaagaaatagttgtaatttcttaatgcctgtaattccagcactttgggaggccgaggcgggcggatcacgaggtcaggagatcgagaccatcctggctaacacggtgaaaccccgtctctactaaaaatacacaaaaattagccgggcgtggtggcgggcgcctgtagtcccagctacttgggaggctgaggcaggagaatggtgggaacttgggaactggagcttgcagtgagcccagattgtgccactgcactccagcctgggcgacagagcgagactccgtctcaaaaaaaaaaaaaaaaaaaaaaaaaaaaaaaaaaaaaagggttaaatgtaatagataagcagtctactcagactttcactgtatttctaatagttagggaaataaaataatttagaaaggctaaggcttaacatagcctctgataatgctctcaatgattcatcatgtaactaaccaggttaattattgtatcttataattatgaaggaaaatgacctttatccctccctcccagcagtaaacgtgattgagttcttcaagtgacttttctaagttgtattcttctgcatgggcagtttagacatgatccgtcccatcacagggttatgaggacggcatcagattggctgtgtgggcttgaaacactcaggctcatgaattaaaagaagcaggtgccaggccgggcgcggtggctcacgcctgtaatcccagcactttgggaagccaaggagggcggatcacgagatcaggagwtggagaccatcttggctaacgtggtgaaatcccgtctctactaaaaaaaaaaaaaaaaaaatacaaaaaattagacgggcatggtggtgggcgcctgtggtcccagccactcggcaggctgaggcaggagaatggcatgaacctgggaggtggaggttgcagtaagccgagatcgtgccactgcactccagcctgggcgacagagcgagactccgtctcaaaaaaaagaaaaaaaaaagcaggtgtcagtcaatacgtagctgactctatcccagtgccctgcctgcctctcctctccgttggtttgctcagtaaacacccctcatccctgcaattcatccaatggattccacaaggatgattctgtaaagctttctttgaattacaaatggagtccatagtttatgtgtgcttatactcctaagaggatgtctttatgaagtcatgtttatttcccagataaaaattttaaaaattttacatagacttttgttttatttttttgagacagcgtctcattttgtcacctaacctggagcacagtggcgggatcttggctcactgcagcctcaagttctttggctcaagaaattctcccacttcagccccccaagtagctgggatcacaggcatgcaccactacacctggctaatttgttttgttttgttctgctgacatggagtctcactctgtcacccaggctggagtgcagtggtgcgatcttggctcactgcaacctctgcctcccttcaagcgattctcctatctcagcctcctgagtagtggagattacaggtgcatgccactacacccagctgacttttgcatttttagtagagatggggtttcaccatgttggccaagctggtctgaaactcctgacctcaaatgatccacctgcctcagcttccaaaagtgctgggattacaggtgtgccactgaatccagcctttctttcttttcgttttctttctttctttctttctttttggtagagacagggttttgccgtgttgcccaggctggtctcgaactcctgagctcaagtgatccacctgcgccggcctccaaaagtgctgggattacaggtgtgccactgcatccagcctttctttttcttttcttttttttttttttttttgtagatacagggttttgccatgttgcccaggctggtctcgaactcctgagttcaagtgatccacctgccttggcctcccaaattgctaagactgtaggcgtaagccactgtgcctggcctgcttttattttaaaggaaaggtggatcctattcttgaatattttgttactactctccttaagaggaaagataaacacatcaccactaaaagaagtgtgtgtcttggtagtgttttcccagcagattggattgcttttcgtgtctcagagatttttagacaggtccatttaaactaagtagagccaagactatcaaatcagattttatgattaatgtaataagaccttgcccttcaaaattttttgctttctccctgtgtttctagataataatcttcctgagacaggctcttgattttattcttttttttttctttttttgagatgaagtttctctctgtcacccaggctggagtgcagtggagtgatattggctcgctgcaacctccgcctcctaggatcaagcaatcctccctctcagcctsccaagtaactgggaccacaggtgcacaccaccacgccyrgttagtttttctatttttagtagagacggggttttgccatattgcccaggctggtcctgaactcctgggctcaagtgatctgcccacctcggcctcccaaaatgctggggttacaggcatgagccactgcacctggctgattttattcatttttgatttcatgatgcctttggctttgcacatagtagcaacacaaaaattgaattgattagaaggtccaagtcactttgaatacatgaatttaacctagacattttttgtatctcaagtatcttaactggatgactggagtttccccgatgctttctgagcgcctgcgttccttccaggcctgcttctttgtctgtatgtctcctgatgtcctctgagccctgtccgtcactccatgataatgaggtcactttaggcagcctacttcttggtcctgaattgtcacgactactccactacttacttgcttcattgggttttgattcactgttttwggaatggaggaagaaccatgattaggtgggctggttatcaggttcgtcaatattttattttactaaatactccctgctcttttgggagttggcaaacaacagcctgcaagccaaatctggcccatcaccctgcttttgtaaataaagttttattggaacaaggccatgttcactcattctcatatccatggctgcttttgcaacaggttgagtagttgcaacagagaccttacggctggcaaagcctgaaattttctaccaaaaaatttacagaaaaagtttgctgacctctactctagaagatcagttgataaaatacaacaacgttttcatgcccatcattatttttcctatttcaatgaatagcatggaaaccaaggtgaagtaattgaactgaagggatttctgaatgaaggattcatgtgttcatatgtttagacaaaaytactcattagactagtttttagggagtaatttgctgctgttaaactacctcttcatatgaataattttttaaaagagcagacacatatatacttaaataggaaataattttgaatttaataacttcatgttcatttttaaaattgtggcaaaatatgcacaatataaaatttgccattttagccacttttaagcattaagttcattggcattaagtatatttgcattgttatgcaaacatcaccaccatctgtttctagagctttttcattctgctatattgaaacccattaaacaataactctccatcctccccttcccccactgtcctacattctgtctttatgaatttgactactctaggtaccacatataagtggaatcataatgtatttgttcttttgtatctggcttatttcacttagcaaaatttcctcagggttcattcatgttgtagagcatgtatcagaatttcattcctttttgtggatgaatagtattctgtgtcatggatataccatgctttgtttatccattcatctgctgatggacatttgggttgtttccacctcttgaccattgtgaataatgctgctgggagcattggtgtacaaatatttattagagttcctgctttaaatccttttgtgtttatactcagaagtggaattactggatcaaatggtaattctatgtttaatttattgaggaactgccatggaattttcagcatctgctgccctattttattatacttccccactagcaatgcacaagggttccaattttttcacaaccacactaacacttattttattaacacttttttttttgagatggagtctcactctgttgccaggctggagtacagtggtgctatctcggctgactgcaatttctgcctccagggttcaagcgattcccgtgtctcagcctcccgagtagctgggactacaggtgcatgccaccacgcctaatttttttttttttttgtattttagtagagacggggtttcactgtgttggccagtatggtcttcatctcctgacctcgtgatctgcctgcctcggcctcccaaagtgctgggattacaggtgtgagccaccgcacctggccaacacttatttttataacacttattttatattttcttgatagtagccaccctaatgggtgtgaagtggtatcttgttgtggctttgatttgcatttccctaataattagtgatgttgaacatcttttcatgtgcttattggccatttgtacatcatctttggagaaatgtctattcaagttctttgcctttttttttaattggattgttttgtttcttaaaaacaaaaaaagaacaaagctggaggactcacgcttccagatctcaaaacttactacaaagctacagtaatcaaaacagtgtggtactgatataaagacggacatatagaccaatggaatagaatagaaagcctagaaataaagccatgcacatatggtcaaatgatttttgagaagggtgctaagaccattcagtagggaaaggatagttttttcaacaaatggcactgggaaaactggatatccacatacaaaagaaaaaagttggcttatttcttagccaacttttttcttagttaccttatttcacttagcaagtgctaagtgaaataaggtaagccagacccttacctaacaacatatataaaaattaacccaaaatgcatcaaatacctaaagataagagctcttgttttcttagaataaaatggggaagctgggcgtggtggcttacacctgtaatttcagcactttggaaggcccaggtgggtggattgcttgaccccaggagttcgagaccagcctagacaacatggtgaaaccccatctctacggaaaaaaaaaaaaaaaaaaaaaaattagctgagcatggtggtccacgcctgtggtcccagctacttgggaggctgaggtgggaggatcatttgaatctatggtgagccaagatcgcgccactgcactccagcctgggtgatggagcaaagaccctgtctcaaatcagtcaatcaatcagggggaaagattcacgacattggatctgctaatgatttcttagctatgacagcaaaggcacagggaacaaaataaaaaatagaaaaattggacatcatcaaaatgaaaaacttttgtgcatcaaaggacactattaacaaaataaaaaggtaagcaacagaatgagagaaaatattttcagatcacatatctgataagagattaacatctagaatatatagagagctcctagagcctatattcatttttttagagaaaatccaaaggatgctgaaaagcagtttagaccttcttgccccaggtactcaccaaacctgaaccagtcaccctcggccttgagtgtatgtcagtggaagacttactgcccagagtgtctgcctgataggacatgggtagcttcattaaagggaaaaggtattgttctcttctgtcactaagcagaagagtaatgtctggtggcagaaggatgccggataggggatgcttcttgcccacaggattgtaaatcttctgttagtaattgttgctccctggaaggcactggttgctgattcacagtcctgctctgtgtcttctttcatcctgggacagtggcttggagccagtgctatcttagctcaaattttcctaaggactaaaatatgcttaaaatggctctgggctgggtgtggtggctcacgcctgtaatytcagcactttgaaaggcagaggcgggcagatcacttgaggtcaggaattggagaccagcctggccaacatggtaaaatcccgtctctactaaaaatacaaaaattagctagacgtggtggtgggtacctgtaatcccagctacacaggaggctgaggcaggagaatcgcttgaacacaggaggcagaggctgcagtgagccgagatcacaccactgcaccccagcctgggtgacagagtgagactctgtctcaaaaaaaaaaaaaaaaaggctctggactcctgctctaaaaccatttgtgactggatatcatgattctttacatgctgagggatttttttaggtcaaacttttagagagattttccattttgaatatgtgaactatagattggtttaaaactgtgttgtccaacacccactctaacccctggttttgctcacctttctttagcatttagagaaaactcaaacttcagtgtgggtcaaccctcaggactgtgacttacagtggcacaggtcggacactgcacaagggagccacttgtataaggggatattgttcaaatacccacttatatcgtgtattgattgtgatgattgtstatgtcagatacagcaaagtgtattgttctracaagatccatatattatgacagatttcctgggggtgggcataaggcctgttgaggaaggggcacatttgcccagttcccatggaggctccgtttagatagccccacctgtgcttttctttggtggcacttggaactccagggtatagtttcttacacaggatgttattccyactccacaggcaccagcagagaggtggccagagggaaggccgcctttctcctgactgcctgtctgtagcacccacagcgtgacccatgctgtgtgggtgtgcatgaccttctgcacacagggctgctgtggggcctttcggtggaggagggatttgctgatcctgctttgaaagaggcctaaccacactgatgatgcagttcaggacctgaaaaccctcagccagctacgagcaacacgacttggcgggctgatggagtcactgtgggacattccagggagtctgccctgtgtcctctttccccgtgaaccaagtcacccaggagagaagagttggagcaacagggcccgcatctgctgcaggaattgcagtccagggcactggtatggttgggggttagcgtcctcaactgacaccatgacagagcccagtttgagatggtcatccatgtatagggatttgtatcggtagctgaaataagctgcttcatccctattatttctaggctgagaaatggatgcatagatggataatgacttgtcacagacatgccagcttcaggggcaggactggtgtttgagccacacgcggcggatcttactccccgctgcctcaatctatagtttgtgtgaatcctcacagtgctgtgagccctgctgtgggtagaggttgtgactcacttattctttttttattattatttattttttaaaaattgggccaggtrtggtggctcatgcttgtaatcccggcactttgggaggctgaggtgggaggatcacttgagttcaggagttcgagaccaccttggccaacatagtgaaaccccatcactactaaaaatacaaaaattagccaggtgaggtggtgtgcacctgttatcccagctactccgagcctgaggtagaagaatcgcttgaaccaggggcgcgaaggttgtggtgagctgggtttgggccactgcactccagcctgggtgatggagtgagattctgtctcaaaaaaaagaataawaaaaaataaataggctggatgcagtggctcacgcctgcaatcccagcactttgggaggccgaggtgggcagataacctgaggtcaggagttcgagaccagcctgaccaacatggagaaaccccttctctactaagaaatacaaaagtagccaggcgtggtggtgcgtgcctgtaatcccagctacttgggaggctgaggcaggagaattgcttgaacccgggaggcagaggttgcggtgagccgagatcgcaccattgtactccagcctgggcaacaagagcgaaactctgtctcataaataaataaataaacaaataaacaaaacattttattttgtagagatgggatcttgctatgttatccaggctggtcttgaactcctgggctcaagcagtcctcccacctcagcctcccaaagtgctgggattacaggtatgagccaccacacccggcgtcacttattcttatctctctcgaagtacctgtgtgtattgcacttaattaatgtgaatgaattaatgaaattacatgtaagctaaattgtgcaaaaccaatgaccttgtgttaatacacatttggttgtacagctcaaatgaagtaatgcttcctgctatdaatagtgttggttgctactgatgttgtatgtatgtatgtatgtatgtattttgagacggagtcttgctctgtcgcccaggctggagtgcagtggagcgatcttggctcactgcaaggtccgcctcctgggttcaygccattctcctgcctcagcctcctgagtagctgggactacaggtgcccgccaccacggccrgctaattttttgtacttttagtagagacggggtttcactgtgttagccaggatggtctcgatctcctgacctcatgatctgccctccttggcctcccaaggtgctgggattacaggcatgagccaccgcrcctggcctgttgtatttataagcaccacctcttatatggcaagccctcttctgggtaccagggacagcgagatgcagaagatgaggccatgtcctcaaaaaggggagagacagatgcatattgattacagtggagtcagaggagttttagtgcaggcgtgcacagtaaccacaatggggccagcctggtgaggacagtcatggaatccctgtgaatgaactcttagaagggtcatggaggaggtgagctggggtgtagatgaaggaggtgagctggggtgtagatgaaggagtgtgagctggggtgtagatgaaggagtgtgagctggggtgtagatgaaggagtgtgagctggggtgtagatgaaggagtgtgagctggggtgtagatgaaggagtgtgagctggggtgtagatgaaggagtgtgagctggggtgtagatgaaggagtgtgagctggggtgtagatgaaggagtgtgagctggggtgtagatgaagggctgtctgggggaggagccgtgggaagagggtcatggaggagtgtgagctggggtgtacatgaaggactgtctggggggaggagccatggggagagggtcatggaggagtgtgagctggggtgtagatgaagagctgttctgggggggaggaggcgtggggagaggcacaaggcctggagtgggcacaggcagctgggaggctctgtttgactggggctgagcgaaggagatgggggtggcagaaagggacagtggagaggcaggtagtcactcaagcacccgcggcctctggatttgcctcctggggctgcagtaacagagtgccacaacctggggatcctccaacaacagaaatgtatcatctcccagttctggaggctggkaggccgaaattgaggtgtcagtggggccatgcttcctctgctggtgctagggtagaacgctgcctccctcttcctgcttctagtgggtctcagcaattaccccagtctctgccctgatggtcacggggctgtctccacattgtctcccctctgtgcccatctgcctgtgtgtctagattcccccttcccttcttgtttttgagacagggttttactctgtcactcaggctggagtgcagtgctgcgattatagctcactgtagcctgtcagtcctgggctcaagctatcctcccacctcagcctcctgagtagctggatgggaggatcactgcaggcacatgccaccatgcccagctcatttaaaattttttttgtagaaaaaaaattagctgggtctggtaactcacgcctgtaatcccagctacttgggaggctgaggcaggagaatcacttgaacccgggaggcggaggttgcagtgaaccaagatcgcgctattgtactccagcctgggcaacaagagtgagactctgtctcaaaaaaaaaaaaaaaaaaaatttttttttttttataggacatagtctcactaagttacccaggctggtctcaaactcctggcctcaagtggtctcttctgcctcctggaggaggctgakgtgggaggatcgcttgagccctggagtgagaggctacagtgagctatgatcacagcactgcactccagcctgagtgacagagtaaaaccccgtctcaaaaacaagaggggggraaaagaagttactcagctttctgggacatggttgttggtttccaggtggtcgtttccccccggctttgtattaggaaaatgttcgaatagaagcagagcggtgacccyrtgtctgtacagccctcgactatccccgttttggtcttgtccccacccgctccccaccctaagttatatttgtacactttttctgacttcctgcaggctttttaggcaagttgtggtacaaaatccgttttgtcacttgtagacgttgtgactttgggcccatgacaccttatccctgagcctcgcttttcatttataaaattgggggcctggcacagtggctcacgcctgtaatcccagcaccttgggaggccgaggcggacgaatcacaaggtcaggagatcgagaccatcctggctaatacggtgaaaccccatctctactaaaaatacaaaaaattagccaggtgtggtggcgggcgcctgtagttccagctacttgggaggctgaggcaggagaatcactcgaacctgggaggcggaggttgcagtgagccaagatcgtgccactgtactccagcctgggcgacagagcaagactctgtcttaaaaaaaaaaaaaaaaaaaaaaaaattgggatgacacctggcaaccacccgagcagcaaatgtgtgcaaaatgctcckcgccgtgcctggcagacacggctgccaaccagccatgtgcctgagacaagccctggcagcctcagacctgggccctggcctgcagctgttcctgtccctggcaaagacgggtatccctgctaaagtcactcgccagccagaccgggcagggtggtgggggcccttggtccaaaacacctgcctctcgagggatgcctgyctgtgagcatctcrcagctccttgcgcgaatactgacatgttaacaagaggtcaaaattcagggctctttaaggaagcttctaggaagaaacaactgaggaatcaaagagaagaagtgaaatgacagtcaacagtgggctggtaaaagccacacagggcagtgctgctccaacttccttgagttctcaaatctgcccggatcttgctccaatgggattggggctctgcaggctggaggctgcctggggctctgtgtctctagcaacccctgccctgctgagagcaacagcccacaactggggcagtgaggcagggggcagagtgggacctgcgggtccccctgcatgctttcatatgtcctgtgaactaagagtgggttttatattattatyattattattattattattattattattattttgagatggagtctcattctatctcccaggctggagtgcagtggtgtaatctgggctcactgcaacctttgcctcttgagttcagcctcccgagtagctgcgattacaagcgtgtgacctcatgcccggctaggctaatctttgtatttttagtagagacgaggtttcatcatgttggccaggctagtctcgaacttctggcctcaagtgatccgcctgcctcagcctcccaaagtgctgggattacagatgtgagccaccacacctggccgggttttacatttttaaatggttaaaaaaaaaaacaaaagaataatctttgtgacacattcaaatttcagtgcccatgaagtttcgtgggaacgggcacgcctgccctttattactgtctgtggctgctgtcatagggcggaattgagcagctgtgacgggcccctccctggggccagcacagtgcaacgttccctctccagccttgacccaggccccgcctgtgccccgcgtcgctgcagccggcagggggcagcagaaagccacgcgcacgcccggtccgtgcaggagccgcagcggggacgcgggggatttgcgacccgggccgaagcggaggtttcctagctggggtctgagatgtggacctgaggcagaactgcccgtgggggatagcaggaggagacgaggtgggggtgacagtaatcgtgcaggcagggccggcctcaccgggtaggcagggcaataagggacaattggtttgctggagtgaaagggcaaggcctgcaggcggaggggtgaccccgcagggtggggcaccccggaagccacgtgggcctggacttcagaccacgccatagggagtcactgaagggttccaggtggtagtgtgatagcctcagattctctaagagggatgtggctttttggtgactgtgcctcaggatactgttgccacaaccagggacagagtgacagtgagggctgtaaggccacatagggcaggagggacccrgggcagrgtgacagtgagggctgtaaggccacatagggcaggagggacccagggcagggtgacagtgagggctgtaaggccacatagggcaggagggacccrgggcagggtgacagtgagggctgtaaggccacatagggcaggagggacccggggcagggtgacagtgagggctgtaaggccacatagggcaggagggacccggggcagggtgacagtgagggctataaggccacatagggcaggagggacctggggacagggtgacagtgagggctgtaaggccacatagggcaggagggacccagggcagggtgacagtgagggctgtaaggccacatagggcaggagggacctggggacagggtgacagtgagggctgtaaggccacatagggcaggagggacctggggacagggtgacagtgagggctgtaaggcacatagggcaggagggacctggggacagggtgacagtgagggctgtaaggccacatagggcaggagggacccggggcagggtgacagtgagggctgtaaggccacgtaggacaggaggaacccggggcagggtaacactgagggccgtaaggtcacatagggcaggagggacctggggacagggtgacagggctataaggccacgtaggacaggaagaacccggggcagggtaacactgagggctgtaaggtcacatagagcagcggggggggacctgggggcagggtracagtgagatctggaaagtcacatagagcaggagggactcggggcagggtgacagtgagggctgtaaggtcacatagacctggggacagggtgacagtgagggctgtaaggtcacatagacctggggacagggtgataggtgagggctgtaaggccacgtagggcatgggggacccaggaacagggtgacagtgatggctgtaaggccacatagggcagggggatccagagacaggagcaccctgtggtatattgccgcccgcagactgctgtgcaccagctgtctcccaggtctgtgctcgccccaggatgggcaggatgagcagcgtggctgtttttctcttgcttccatggccagcacactgcagtcaggctgttttttgcttggacctggatgttttctctcagggggctcctgcaggtgctagctttggtccctgaccagctggtcctactagttgagtgcccgggcttcaggcaagactgtgttgtaccttttcattctgtcttagggaagtatttcttaatggggaggggaagggtcacaggtgccttatagaatcctgtgaaagccagatgtcccccagatgaaccccagaaaatgcacacaggcaggtggactcggaactttagccatgatttcaaagactcctgcactcgctatggccagcctggctaaggaccctgayctaggggctgccttcttcctttgaggcttggggcttggtgttgagagcttaacatcacatgctatttgccctcccaaaggccagcccatctgattttcttactgtccgtgtccttcagtgggtcttatggaagtgatgtttccatatgtaaatggtttttttggaatggctgaaatcccccaagcttcggcacaggagctagactgcctcccagggtggcaggcccggtgttctggtctgtgtattgggcagagtggagccctctgggaacctcccttagcaggagaatgctgcttccttcccagccccctgctggacgaggactggtctcttcctatgcatttggccagggaacactgtgttcacagaactgggaacatgctgagttttatttctggcgtcttaacacatcataaaaacctcttttcttgaaacaaaaagagtactatatcagatgcagtcttatttaggaaattattagcctctgtaactagaaataagtagattacagtttttaaaagattaatttaatcttcatcacaaggcaagcttacaggaatagattcattccattatgaaatgtttccaaaggacgaatggaagatttagaaaatctaatccaatatcaacttttaataaaagtagtcattcccaacaattatggtttcataatgtgtgtgtatgtttaaatgactttaggagagtayaatttccataacataaaatgtgtcttttcagtctacaatgcaatgattttgagtaaatttacmaagttgtacaaccatctctacactctaattttggaacatttctatcacctcaaaatgatctcttactttttaatcacaagaaatgatactagagaaaataattttaatctactatttcctgtatttacattagctaagtgctattcttaataataaacgccctctatggatatctctcgcaggcaaacatgagacagttggagggcagctcttgcaatcttatcagaagctgaggtgagtgttacaaaggacagaccgtccctggccctccggggcaggagcgcagaggacactctgcaagaacttataggtctcttgactttcacatgtcactgctttggaatgtgactcttttttttttttttcttttaaagataaagttcctgaaaaagattaaagcagagatgtttccagattctcatgagaaaccttctagttagcatagtattttctcactagacattcagctctacttcttaaattctcctgaagtgttataaggaaactaaatattatgtttaattgcrcttaagtgaaattctaaagcaagcatgtgctttgattaatcatgcctatctctaacaccctacccagcrcctggcgcgttagagatactggtgaaataaacattgatagaattgaataatggcctgagagatgtgaacttctttgcacaaaattctaaaaactgakcagtcatgaagctggccataattcacacacctgattacactcaatttattaaagtgtttctgaaagctccccaccagctgctattttgtttggcccatggtgaaattttccaatatcgagactttttcatttttttcctcccctgttctttcccatttcttttagcacaagcttccagtttgcttcgtggttgattctcacatccacaacatttttggcgcttctgctggtgtggtttgtgctaagagaacacgggagcgcagatgggaaccaggggtttccccgcagccaggtggcaggtccaggccggagcacccaggctgtttcagaacacatgactgagtggggcggagtacccagactttaggcagcatygccctcatatagataccaggaaatcatgcccctcgtagagcagcaggtccaagcagggctgctggctatttttccaaaaagtgaggcagtttaaaaaaaaggcggagaactagaattatagaataatggcacattttgtgtatttgtaaaactaacggcttgcatggttcacaacccatttcttatgcctgtgttttccttggcagcaaaatttctgtggttcctcctactccacctcctgtcagcgagagccagtgcagccgcagtcctggcagggtaacgtatccattctgggcacttctctagtaggggtcaggggatagaaggagaggaagcaggggagctttcgaggctgaggccgggcacggaacctcccagcaaagggatctgactgtgcctggagygggtcacaaagcggggtggggagcgagggccctcaggctgggcagagcttctctcctcattctggtcgcgggaccctctgtgtcatcagcgaccctttctgcctgcacccraggtctctttactcttggcatggcatcggcccccttccccaactctgctctgtgctgggcgtgtgtgtagagtctctggggtctaaggggaaataagattggttaacgtgtgtgtgagtgggagtgtctcttttgagtgtttgcaggctctgatgtacagtggaccagcaccatttctgtccaaagaaattagctgtgtgatcttggggcagttacctgggtttcccacctgagaggtggaaataattatacaggtgctgcttgacttatgatgaggttatgtcccaatacgcccaaagtaaattgaaaatactgtaagtcaaaaatatatttagctaggcgcggtggctcacgccagcactttgggaggccgaggtgggtcacttgaggataggagttcgagaccagcctggccaacatggtgaaaccctgtctctactaaaaatacaaaaattagctggtcatggtggcaggcacctgtagtcccagctactctggaggctgaggcaggagaattgcttgagccttggaggtggaggttgcagtgagccaagtgccacygccctccagcctgggcaacagagcaagactccatctcaaaaaaaataaattgtatttaatacacacctaacctaccaaacatcatagcatagcctagcctgccttaaaagtgctccgaacacttgcgttagcctacagttgggcagaatcatttaatgcagagcctattttataataataaaaatgttattaataatacaaaatagaaaagatcaaaatgcaaagtacggtttctactgaatatatattgctttcacaccatcatcaagtcagaaaattgtaagtcaaaccatcgtaagtcagggagtgtctatatttgtatatatcgtctatatttgtatggctgttgtgagaaattaacaaaataatgtctgtgttggtacttggaaaaccgtaaagtgccatggaaatatattgtcttggttatcttcattattctataaattaaagggggcaggtatatatgggagaatatgggagctgatcataatcccagaagacatagtcctgagtgctatcatcctgaatgttggaatcctgaaagatcaaaatcccaaaaatataattctagaaaatctaaaaatgattttgaagaaatttatttaaaaaatttaaaggggatttgagaaacatgtaaaaacatgacaacagcctgggcaacatagcaasaccctatctacaaaaaataaaaaaattagctggatgtggtagcacatgcctgtaggctcagctactcaggaggctgagggaagaggatcccttgagcccaggaggccaaggctacagtgagccatgattgcgccaatgcgttccagcctgggcaacagagcgcgactgtctctaaacaaacaaactaaaaacaaaaaccatgacagaacacttmactggccactttacacaataaataggcaaaaacagcatgcatatttttgcaagcataaacactcagatatactaatgacagtcacatgggtataacaattatgaacagatgaaccatattcataaagaaatacatcagaaagggaagtgtagaaatacacattactatggctggtattgtgtgcatccagctttgtaactgaaatattgtcatgaacagcagtatttttcaaacagtcatttgatgagatggatcaaaaaccgccatgggtcaccattgcatatacagtcacccaaacagctgagatctcaagaaattttatcttttgcaaatacagatgtacaaaaaggagatctcttcccttaggaaatatcaacatctttatgtacatgtcagagtcatggtgtgatgacgtactttgaagcatggagtcagttttcaaaaaaaaaaaaatgcataacacaaattaaaactctaaaagtgtctgtaatttttacctccagcatgggacatgatgagaacgtgaactacacagcatagcaaactgtgctgtgtgtgaaggggcagaattcatacacaactaaactaaataatttggcagcrgagatttcttgtattttttttgcctgtgtttttacttctaagatctttgaaacacttgctgcacttgtatttggagagtggttgtggtctaagcttttttttttttttgcttttttctttttttgagatggagtttcactcttgtccaggctggagtgcaatggcgcaatcttggcccatcacaccctccacctcccgggttcaagcgattctcctgcctcaacctcctgagtagctgggattacaggcatgtgccaccaggcccagctaatttgttttgtatcttcagtagagacggggtttcactattggccaggctgcttttgacctcctgatctcgtgatctgcccacctcgggctcccaaagcgctggggttacaggygtgagccacctcgcccagccaggtctacgcattttgtaagcacatgctgtccatttgaaaggctggttcttgctccagtcgttgcaattaagccatttcctacttttgcaacaccaatactaattagcttttaaacttttaccattcattattaaataaccttatactcatatcacaggctttttggtgaaggaaccgtttcacagatctcttctgttgtgttgtgaggaatacaataagaaggaatgataggtggcttcctcaataccaaatctgtattagggttctccagatagacacagccaataggatatgtatatagatacatgagaggagtcttactaggggaattggctcacgtgatcacggcagctgagaagtctctccacaagccatctgcaaactggagaccctgggataccagtagcgtgactcagtccaagtcccaaggtgtcggcgccaggaaagctgatggtgttgttacaggaaacagaccccaagaaacggttcttgaatctcgcggaagaaagaatgcagggcgagtccacagagtaaagtgaaagcaagtttattaggaaagtaaaggaataaagaacggctactccatagacagaacagccctgagggctgctggttgcccatttttatggctatttctcaatgatatgctcaacaagggrtggattattcatgcctcccctttttagagcatgtagggtaacttcctgatgttgccatggcatttgtaaactgtcatggcactggtgggagtgtagcagtgaggacgaccagaggtcactcttgttgccatcttggttttggtggattttagctgtcttctttactgcaacctgttttatcagcaaggtctttatgacctgtatattgggctgacctcccatctcatcctgtgacttagaatgccttaaccatctgggaatgcagcccagtaggtctcggcctcattttacccagctcctattcaagatggagttgctstggttcacatacctctgacaatgtaactctcagttcaaagctgaaagcctcaggacccagggagcctctggtctaagtcctggagtccaatggccaatcagcctgggttctgatgtccaaggcagcagaagaaaagtctgttccagctctcagagaccaattcatttgctgtatttgttctccttgggcccctggttgagtgggtggtgcctgccaatattgagggcagatctttctaaccgaatccactcagactcacacactaatctcctctggaaacaccctcacagacacacccagaataatgccttaccaggcttctaggtattcctgaagccaatcaagtggatgcctacaattaaggtgtcattaattaagtccacgagtccaccccttgtcaacctgtacccataggctctccttaagtcatacttaatttaataaaggcagtaacaaagtaataggtccccctaacatgatgcaactatcccataattgtgattttggggattttagatgttagggatttggacttcagggattttaatctttagggatttagactttagggattttgatctttcatcgtttaggattatggcatttgagactgtgtctttgagattatgatccaaacccaaaaatatataatgctgataagagagaagaatcacatacattctttttcttttctttctttcttttttttttttttttgagacagartctcgctctattgcccaggctggagaccagtggcgtgatctcgactcattgcaagctccgcctcccgggttcacaccattctcctgyctcagcctcccaagtagctgggattacaggtgcccgccaccttgcccagctaatttttttttgtatttttagtagagacggggtttcacgtgttagccaggatggtctcgatctcctgacctcgtgatccgcccrcctcgggctcccaaagtgctgggattacaggcgtgagccaccgcgcctggcctctttttcagtttcaaactgagactggggtgaccttcaaaatcctgctctactttctcctggaaatttcaaattctccagagtcgttccagtacctacgtgctcatgatgtatttattggacagatggatgattggatgggtggtaatgtaagatggatggatgtttggtggctagatgggtggatggatggatgaatgaatgagacttggataaggaagtgaactcctttctgttgttttatcttttttttcttctgctttgggaagtggagcccctcagctcttgcctggtcaccttgtggcttttaccatcctcatcccctgtgccacccacatcctgccacttctgcatggagttggggtggggccattggagaaaagaggttaaacaagcagtaatttacttgagtacagtctttgagccaatgaaatgccagtcatcatttcccaggggtacttgtcatcttgtcaacaacccgctgataatgctccttcaatgtgaatagcaaaagtagggagagacgctgaatgaagaagatgcctacccctcaggaagactgctgtccgcctccaggcctgcatgcacacacccatgcccacctgcacccccagcaccacgcccacactcactcgcacacacccacatgccagtgttttggggttggcagcctggacactgctgaggcaaacacaagtcatcaagcataattctcattctctccttctgtctctgttttagttacaggaatttggtcagtttagaggatttaataagtccgtggaaaatttgtttctgtctcttgctacccacgtgaaaagtaagtgcatgcttcatgatgtgttttcccactaccttccaggccagccgagcccactggccagggcctggccggtgacctcggttgacactgtccctcaggccactcactttgtctctggaccctggggaaagccacagcacctggcccttcatctctttcccaayaaagcaggcctctggttcctcataggaagagaaatggtggctcagacctgtaatccaagcactttgggaggccaaggtgggtggatcacttgaggtcaggagttcgagaccatctggccaacatggtgaaaccctgtctccactaaaaatacaaaaattagccaggcatggtggtgggtgcctgtaatcccagctactggggaagctgaggcaggagaatcacttgaacccaggaggcggaggttgcagtgagccaagatcacgccactggactccagcctgagcaacagagcaagactccgtctcaaaaaagaaaaagaaaaaaamaaaaagatgcaatttcagggaatctaaaaccagaacctttcaggccagtagggcccaattatctatctattgtctgcatggaattacttgcctttctcctctcctccttggtaaatgtattttcttcagttagcagtaatcctgtgatttgcagatgcatgtaacctagaaccacctccacttgcaatcttgtgtctttcaatgttctttctgctcagatacttttttctctgtttatcttaaaattcaagtcccagaggacagactccttttcatgcctcctaagatgcccagggctggtcaggtgtttagaaaatgtccttagtgtgctcaagggtccttaggcatggatttctctttcactgtgtttctgctcggcttctcttcatcatccccttttctgtagttgcatgcggatggtctcagtgctgcacttggctctgagacagtctctttatrtgactttaattagttgtccgtattcctcatgagccctgtstcagctgtcacacgatgacaatggacatcaaagcactgctcttcagatgagcagaaacagtcgtctcatgcaatggtctgttcctttcttagggaggaagcagctgaatttcatgggcctgtttgctaagagcgtttggtggcttaaaaatcactgtttccatcctgctgggctctctgacagtaacccctgctctgtgccccttggcctggaacgtgttttccagctgtcccggctgcctcttctcttgttctcttgtgggtgctattttcccacccacccccttgtatttgtcatgtatgggtgggtgctagttcaccttccctgtatgtctttctaggtgcacagcccttctccaaatctatgtggcttctgtgaattgtcttccaccactgccactatagaatcagtgccttggagttagccccaaccctgtcatcccccagccaccgaaatccagagaggtgggacacacacgtcagcacacatgcaccttcctggatgctcccagccctgcacacaggttcattggatatgctcacagctgtcaggtggccaccccagagcctggcctgtgtacctgctcacacacttgagcacttgaggctaaccagtgtaatacccaggtggacaactagagctagtccctgggcgaggtgtgggggaattcacaagagcaaaacagcaagcatcccttctcagatatggaaagcagactgaaaccgcatcacacacacacacacacgcaygcacccagcaccccccatacccccccaccacccccaccccctgcccagaggcagagatagaaaaccccagctttctggctgctgggagtggtgcttggcctctgacctttcccgagtgcttcccctgtttctgcaggaacaggacacgtgaccacacacacgcccttctcccgtctctgccacaggacacttagcgtcctgtaggcgctgactcctatttctttggattttgagctcctcttctcgtgctcctattatcttattggctgcctgtttccccacggaagtgggtgcagagggaagcctcattctgaggggaggaagattggcacctgaggtcctcggggagggactgtagagggccccagactcttcactggcccaggtgctgaagggtggctttgcccctgaggggttttgaaaggtgacccagaattacaacctctagctgctgatkctgcccaatgaagtcaaaccagcgggaggaaatgagtggctgcagctctgtctattatcagtacgtttctagaagatgtcagcactgtagtcccccttagaaaggggaagaggaaatgagaaaactggtcttgcccagaagcaatctgcatttctttctcttccttatcctttgtcccctaataatactgacctataagcctatttcttagagcccaaatttctcaagaaggcttgtcctctcccctcatctgtgaactttcaatggcccaaataggcccaggctttgggatgggcactaagagattgctgggggaccagttcctcctaagggcttagaaattagagcccctcacagcctcacagtccagactgagatggaccatctgagcgtgtcctttactttgtccactttgaggacctggtgcgtactagtgccttacgagctgctggccttagaaagatcccccagtgtttcttgatggtcaccttgaggacatggggatggcattgctatcagaggaggctaggaggcatcctggtggaaaagctggacaccccagccgttccctctttagatgaaagagatactgcaagactcattcttgggcagtgtaggcaggagagaacgaatacatagtgagaggatagaggattcatgcaataacatcccaaggaggtggatccaaagccagccggggggtcaagagccacagtgtccattgcagtggcctctaaccacgtgttgctcttgagcccctgaaatagggctgcaagatgcactaccaaagtgaacacactgggtttcagagacttggaatccaacaaaagtaaaatatttcayggataactttaatgttgatgacattttttaatattttggatatattgtgttaaactaaatatagaattaaaattaatttggccaggcatggtggcttaagcctgtaatcccagcactttgggaggccaaggtgggtggatctcttgagctcaggagttcgagaccagcctggccaacatggtgaaaccatggctaatacaaaaattagccgggcgtggtgacacacacctgtaatcccagctacttgggaggctgaggcatgagaatcacttgaacccaggaggcggaggttgcagtgagccaagatcacatcattgcactccattctgggcaacagagtgagactctatttcaaaaataaataagtaaatagagttaattttacctgtttttttttttttaacttttttaatatggctactataaaatttaaaattgtatgtgtgacttgcattgtctctctgcyggacagcacagctctagagacagttttaaggtccccgtttggaggagtggggttctcaagggaaaatgaaaccatcttcagaggatgaaactatcttcaaggtggttctctcacttctgtatgtggcttccttccttcaaactttcttcatctttactctagaccactattacactgtaaaaatgaaacaaatttgtttacagtcatctttccagggtttgtttattataattgttatgaggacaccycaaatcttatttttacctcgcttcaaaaagtcacaagaaatggtgttaagttgtaacatctttgtaaggaacccctagaaagccggcttgtttggtaggctgccgtcttcgtgtttggatgagtgcacacacatatgtgtgacctggaacgcagaggagcttgggtggatgatttcccttcacctctcaccctgaccatggcctgggtggccacagcgggaccttgaaggaagccagccctctcctgccctgacccagcacactgtctgctcaccttcccaacacctctgcacttggtgggggaatgtgccgcccttgctcctccgtgcactttgccctcttaagaccttgggacccactgtctgtgggttcagtgaaccccagaagaggctcccacaagtctcagcaaagctgcttgttcccacccatcaacccttgtgtttgccttttagagctctccaaatcccagaatgatatgacttctgagaagcatcttctcgccacgggccccaggcagtgtgtgggacagacagagagacggagccagtctgacactgcggtcaacgtcaccaccagggtaccctgagccccacaaggcctccaygctgatcaccttcatgttgtcttccagaactttctagcctgccttctctgtagatttatgttttctttggttttatagaaaaacagtaagccatcagaaaaacataattaccagtcagtgcctctatttgggcagggctggcccaaggcaggtcaggattgaaggtcagtctggaaaactgttcagcacaaggaaaggcttccacctaatcacaagcccctgaggctcctctgtgtccacagagctccctgctggcttcaagcctgcgccaaagcccaagggcttcctgcagggcccacacctgccgggttagccctggagtctgcaagaccagcagcctttggttaaaatctatcctgacctctgatggaaactattgaaaacgtaaaggcgcgagcaagcctgtgggggcgctcttcccccgctgtccacaccacaagtgagagctcccttagtaaaggcttctagggaaataattattccaccttcccaccaggactaacccagcctggagtgaacgcttcgggtatgagagagagccaaccttagaatgggaaagcccgcattctagttcagctgaggtgccttggctgggcaggtgccaccagctgttgcttgcagtgttgatgtgactgccctggtaggctggacagaactggtgtcccttctctgctgctgtggactccactcaggctgtccccagacagactgtcctttaggcgagggtgtgaggtcagcccccctctcctgctggaacttgcacacagcctcttgagagttcacgtcctgcctcccgctccagcccagtgcgcccctctgtaaaatgaagatgataatacctgttctgcgcacagcacaaggttttgtaaacatctaatgagataatgtagtatcttgatttgctatctaagtcatctaaatattttatctaaattgccagcattgactatgatgtgctggactctgtactratagcttaactaggctatctcattttatcttcataaccaccatctagggtaggtattgcatgcagcctcattttacatgtawagaaatggaggtttagattaagtcacctgccaaaggttgtatagccaaaagaggactgaactctgaggcagtgattcccagctcttatgagtatagggggtcactggggctcttaaaatgcagattccaaatcagtagctgcggggtggacgtgagatgaggaaccgcagatgcatttttggtgaactcctgggatctggcgaagtctatgctgtgaagttctcagaccacacttcaggagcgaggtgtctagacagtttgaaatgtatttggcaggtgtttgaaattctataacacaagtgtcagctcctgtcagcttcccggggtctacagaagctccctccgaactccctccggggatcactccttctagtgaaacaggtggaggggagggttagcaaccatatgaagccctgtgtgccacacgtggtggcagcattgcttcttacctacttcatcacatttaattctcacaaaaataccgtggtagacattgttactcccatgataaagatcggccgagcctggtggctcatgccggtaatcccagcactttgggaagccgaggtgggcagattgcttgagccaaggagttggagaccagcctgggcaacatgagaaaaccctgtctctacaaaaatacaaatattagccgggtgtggtgtcacatgtctataatcccagctactagggagactgaggtgggaggatcgcttgagcccaggaggtcaaggctgcagtgagccatggttgcaccactgcactccagcctgggtgacagagtgaaaccctgtctcaaataataataaattaaaaattttaaaaattggccgggcaccatggctcatgcctgtaatcccagcactctgggaggctgaagtgggtggatcacctgagttcaggcgttcgagagcagcctagccaacatggtaaaacccyrtctctactaaaaatacacaaattagccaggctcatggcgggtgcctgtaatcccaactactcaggaggccgaggcaggagaatctttgcttgaacctaggaggcagagattgcagtaagccgggatcgtactgttatacgctccagcctgggtgacaagagtgaaactttgtctcaaaaaaaaaaaaaaaaaaaagcctgagttttagtgagaggttgaccaaygtgcctaatgtcacatagtgaatgagagatggagccaggagcagacctgggatttgactctgaattctaaactctatgttcccataagaaggacaaatgaggaccgctgaagaaagagggttcaggaaggggcgtgtggaagcatgagtaattatcttacttgcttgagtcacaggaaaccactcagaggctaacactgacttggggttaaccagatgcctggcattgttctcagcgtaatgcccttcagaggtatttagcctttgtaatccttaagacagccctatgaagttggtactgttcctgtccctactaaagacagggacactggggcaaagagatgaccaagagctaggtgaagcctgctccagagaccaaccacaccctgtccacgccccagaggtgagacgcatttsccatttgcaccgtgatgtgctgtgtggtggctcatcccacgcaccacaggctgggcttgtggcgttctgcatgaggatggcccgtgggtcctcggcaygccccctcccctgctgcatgtgcacatggcccagagcctggccagggttgtctgaagggctaagggagctcagggatagaagtggtggggtgcaggggagacggtggggagacagtggggagagagccaatccaagtagacattgttatgcgtgtgtccacttctcagccatgctcttggcaggaacgcttccaactttctgcaggccttctctctccccaccttaattgaggttgtggctgggttggtttctttgtttcattttgagaccaagtctcgctgtcttgcccaggctggagtgcagtggtgatatcgtgggtcactgtagtctcgatctcgaaggcttaagtgatcctcccacctcagcctcccaagtagctgggactacagggatatggcaccatgcctggctgattttttttaatttttatttttagtagagatgttgcccaggctggtctcaaactcctgggctcaagcaatcctcccacctaggcctcccaaagtgctaggattacaggtgtgagccaccacgcccagccagatatggctgttataagggacaatttagccaaatgtttataaagtactcagcaatgatagtatgatctataaatgctaaataactrttgggttgaaatataaggagtacacttctatttatttatttttatttatttttgagacagagtctcattctgttgcccaggctggagtacgatggcacaatcttggctcactgcaacctctccctccccagttcaagtgattctcatgcctcagcctcttgagtggataggattacaggcatgcaccaccacacctggctaatttttggatttttagtagaaatggggttttgctgtgttgcctaggstagtctcaaactcctgagctcaatcggatgcctgccttagcctcccaaagtgctgggattacaggtgtgagccrctgcgcctggtccaggagtacgtctttaaatagaacattcatcagactgcaattacacatgccttagctggggagctcaccaaaattcctctcattttcatcagattattaatatttcatcaatattaattatagaacacggtggccctgctttggaagtagaggatgctggtgcccaccttgcaagtggctacactgaggcacagaagtagtagataactttctttttttgtttgtttgtttgtttgtttgtttttttgagacagggtcttactttgtcacccaggctggagtgtagtggtgcaaacacagctcattgtagcttctacctcctgggctcaggtgatcctcccacttcagcacccccgagtagctgggactacaggagtacaccactctgcccagctaatttttgtattttttctagagatagggttttaccatgttgcccagactggtcttgaattcctgggctcaagtgatcctcccaccttaaaatcacgcggtgactcggggatgttaactgagaaaacagctcaggatcttttccacaccacttctctgttaagtttgaaccacatgttctgaaaacaccccttcaaaaatgctgacttaagcatctgggccagaattcttcaagaagtgaattcttacctctcctcttctgtgcattccactgggattttattgtatatgttatgaatgtacagtattgacctatattggccataaaaacatgcacctgttaaacaggaaggatgcctaaaaaccgtcaggaggggctatctctggggaggggaactgaggacagaggtggaggaaaaagattttctctcttttctgttttttttttttttttttttttttttaagatggagtctygctctgtcacccagacagcgagcgagcagtctgggctcactgcaacctccgcctcccaggttcaagccattctcctgtctcagcctcctgagtagctaggactacaggcgcctgccaccacacccagctaatttttgtatttttagtagagacagggtttctccattttggccatgctggtcttgaacttctaacctcaggtgatctgccagcctcrgcttcccaaagtgccgggattacaagtgtgagccaccatgcctggccagttattctttttaacagctactctttttttttttttttttttttttgagacagagtcttgctctgtcgcccaggctggagtgcagtgtcatgatctcgactcactgcaayctctgcctcccgggttcaagtgattctcctgcctcagcctcctgtgtagctaggactacaggcacgtgctaatttttatatttttagtagagacagggtttcaccgtgttagccaggtctcaatctcctgacctcgtgatctgcctgcctcrgcctcccaaagtgctaggattacaggtgtgagccaccaagcccagcctaacagctactttttaaggcttttagttcatgctgccaagttgccctccactgacgttgactccatttacctgaccactggcaaggcagagtcacgtgttttccagcactcttgccaacattcaactttgtacctttttttttcctcgaaatgtttattatagtaaaatacacataagacttaccatctgtgccgttttaagtgtatagttcgcggcattgaaaacattgctaatgttgtgcacctgtcaccaccatccatctccaggactttcttctagtaaaactcaactttataatttttaacatttgccaatataatgggcagttatttaaaatgtgcctttctttaactgcaggtaagctttttctcctactttttcctctggcacaccttcattcttgaacccctcccattggatcttctggcttttccagcctctggctcctccgctgtagctttgattgacacttctgtcacacctttagtgtcccctcagacaacatcacacatcccctatgtgtttgtgatctgtgtccacgtgtctacgtgtctgtaggtctaggacgtgctttctgtttaaccgtcaccagctgctccaggtggaaggccttccctctcaggcttaccccagccagcctcagcatcctctcgggtgattgcagcctcactgaagaccatcccccagaggcctgcgtgctggagaaactgtccctggcctctttcccattgacctggctggtgcttccatttgaatggtgtctctgtcttcctactagctagtgagcycttggaggatggacgtttcatcttctcctctttcttctctcttcctccccttctactcttccagcccccagaatttagcatagtgstgtgaatatagtgttgcttaataaataaatgtctgtaggaattaagttggcattctggggatggaaagcataaataatttggaggtaatcctttctttcatttgttctatcatattctcacttagtattttcttcctgaaaattatgactgtggggcaactgttgtatttctgagttctgctttcaacccaccaccaaaaactaaagtctccacttggaaactgtatattttcagtcattaagaggttttcccaccttgcccattgtgttccaatggaacttttctgcagggatgggaatgatctttatgtgagctgtccacacaatgcccagggctgcatgtggccatggagcatttgaaatgggtctagcgcaactgagaagttaagtttgtttgatttcaattaatttaagtagtcatgtgtggctagtgactaccatattggaaaacacaactgtatacatcatagaaatgtcagcttggctgtgtgtggtggctcacgcctgtaatcccagcactttggaaggctgaggcatgtggatcacttgaggtcaggagtttgaggtcagcctgaccaacatggtgaaaccccatctctactaaaaatacaaaaattagccaggtgtggtggcacatgcctgtggtcccagccacttgggaggttgaggcaggagaattgcttgaacccgagagatggaggctgcagtgagccaagattgtgccactgcactgcagcctccagtgtgggtgacagagcaagactccrtctcaaaaaaagaaagaaaaaataaaaaaagcatcaactgttagcaaagtatttttagaaaatttagagacatattttgatttttccctttttataagcatcttagagctaaaactctgcttatcaggctaattattatatatcaagtgattaaatgccaggaccatttattaaggctaaaatttggacttaagacttttactaatccacgagtaatctacccatgactgttcatgactatcccaaagctggatgttgtctgtctctgggccctgtgtgcttgcatgcgcgtgtgtggtgtgtgtgtgcgtgtgtgtgtgtgtgtgcgcacgtgcacgcatttaccaaatgcaggtgtgtcctcctactcagaagtttgcatgttagtaacatcaagtcatagatgcttgctgaagtcaccacatttgaacaaaaccaaactgggatggagactataatattaatttctgtttttccttctcyagaaggtcagtgcaccagatattctgaaacctctcaatcaagaggatcccaaatgctctactaaccctattttgaagcaacagaatctcccatccagtccggcacccagtaccatattctctggaggttttagacacgtgagtctcattccaatgctctttttttgtttttttgttttttgtttttttggaaagcataatgtacaagtccttatttcaattactcctatttgaaggtccttatttttggagaacagcaaggcattttattatccatccttccattccttaaaggcttccacaggttttagtaaagttgcgttatcctcaggcctgtgtcttggagttactccaggtgtgtcagcagattcattatcaatccactccaccagtgctctgtagctttctataatgcagcattctgcaactcgcgtaaacagatagggcaggagggcgccggtcagcttcttccaagtggttggagctgcgttaggcatgcaagccactgacagtgtcgcagtccacgtgtgtgtccaatctcatgtgttaaaatcttacaggatcaatgtagtgaaacattagttctttccagaatgtaatagttatcaaaaattgaatagtcagttgaagatgttttctgtcacttcctccctttgccttcatagcacaagctataaaaatcactgccatacttagcaaagctgaatatccctacaccatctgtcaaagaggcctgtccaaagacaaaatttcaggagtctcttgggtaaagatcaatcattgttatccccatgacacaggcgtcttcaggtttcttcttttttaagaacttcaagatgtcccctgcatgaacttgtaggctttgtttgtgaattatcattggctctaaaggaacacctcattgcagaaacaggaaccagttctaggaggtttgctctcaagccgtagaattatgcctcccaataggccttgagccatttcatagattcttcattgataattctggtgtttcctagagatccagcggactgaatataaatactcatttgtctggagagagtgtctttctgtaagggccactgaagaactgttcaaagtcttggggagcctctggatgggaagtgatctaatatgattgggaatgcaaagtaatgggtccaaagagatcactggctggctggaagccttcgttcattcagcactgttttccccagcatctratttcccatactgtgacacaaggcctgggatctttgagatggagatgttttcagtgtctgttcagagtgccatactgtttgcataatgacagatctcttctgttaacatcgtgttcctaggttgaactttctttttttttttttttttgagacagagtattgctctgtcacccaggctagagtgcagtggcgcgatcttggctcactacaagctccgcctcccaggttcacgtcattctcctgcctcagcctcccaagtagctggcactacaggcgcccgccaccacacccggctaatttttttgtatttttagtagagacggggtttcaccatgttagccaggatggtctcgatctcctgacctcgtgatccacgtgcctcggcctcccaaagtgctgggattacaggcgtgagccaccatgcccagctgaactttctttattttaattttatttatttatttattttttgagatggagtcttactgtgttgcacaggccagagtgcaggctggtgccatctcagctcactgcagcctccgcctcccagttcaaatgatggtcatgcctgtctcctgagtagctgggattacaggcgcccaccaccacgtctggctaatttttgtatttttagtagagatgagtttcaccacgttggccaggctggtctcgaactcttgacctcaagtgatctgcctgcctcgacctcccaaagtgctgagattacaggcatgagccaccgcammcggcctagaactttcattcttccttttaaatgggtcaaacaggtgttcggccatgaggctttattaggaagaaggcatccttctgaggtttttaccttataaggatggacatagctgggcctggccggaaaagtgttgtggagggaatcttcacccaccaggcctcgaggccacccgcccacctcccatggccgttctcatgtgcgtgtctcatccaagtactctttttttttttttttttttttttttgagatgaagtctccctctgttgcccaggctggagtgcagtggcacgatctcagctcactgtgacctccgcctcccaggttcaagcaattctcctgcctcagcctcccgagtagctgggattacaggcatgagccactgtccccagccccaactactcttgatatgtgcggcatggttatgacatcagtagacaaggggagggatgagctgtcgccttgtgagagaaactggaatgtgacaatagaacttggaagtgatattttacttaggttgggatttggggaaacccttgctatactttgagagtggttttcttttttacatcttatgatgaacattttcatacatatgggagtaataataaatattggtgtcttttgattttgtgtttttataattttgatgaagtctgatttggcagcatgttcttttacggttaagtctgtgtctcgtccatctgcaagtcatgaagatattctcccatgttttcatctagaaatttagaaaagtttagcttttaccttcagggctgtgctccagctcgttactatttttgtgtgtgagtgaatggtgtaaggtagagattggggctcatttttttccatatggatatttagtcaacctaataccacttgttaaaaaaaaaaagaaaaaaaaagactgttgtatcccacagtgactttggcatcttggttggaaatcaaatgtccacataagtgtggatctccttatggactctctgttctgctccagtgatctcttcgtctgtccttatgccaagaccacactatcctgagtactgtatctttgtagtaagtcttgaagttggatattataagtcttccaatttggttcttctttttcaagattgctttgtgatgttttaaatgtattctctgtgtataggtaggcattttaattcattcgttcattcatttgtttattaaaaaacattaaggccgggcgcggtggctcatgcctgtaatcccagcactttgggaggccaaggygggtggatcatgaggtcaggagatcgagaccatcctggctaacaaggtgaaaccccttctctactaaaaatacaaaaaattagccgggcgcggtggcgccactgcactccagcctgggtggctaacatggtgaaacctcgtctctactaaaaaaatataaataaataaaacacaaaaaattagccaggcgtgatggcaggcgcctgtagtcccagctactcaggaggctgaggcaggaggctgaggcaggaggatggagtgaacctgggaggtggggctttctgtgaaccaagatcacgccactgcactccagcctgggcgacagagcgagactctgtctcaaaaaacaaataaacaaaaaacattgagtgtttacttttttgcctagaattgtgacgcatggtataataggtggattcttgggtgaggggccataatgcttcaattaacacttgtgttagtccatccatgttgctgtaacaaaatatcacaggctgggtaatttataaacaatagaaatttatttttcatggtcctagacactgggaagttcaggatctcaaggcatggacaggactggtgtctagtggtctgytcctcatagatggctctaagtctcttcctcacatggtgaaaaggatggaagggcaagagggtccagtgctgtgtgcagcctcttataaaggcctgaatcccattcactagagccccaccctcatgacttattcagttcccagaggccccacctcttcatactatcacattggcaattacatttcaacatgtggatacttggatctttcaagctgcctgcttagcccctttccaagtgtactgtactttactttctttttcttttttttttttttttttgagacagagtctcgctttgtcacgtaggctggagtttagtggtgcgatctcagctcactgcaagctccgcctctctggttcacgccattctcctgcctcagcctcctgagtagctgggactacaggcgcccgccaccacgcccggctaatcttttgtatttttagtagagacagggtttcaccgtgttagccaggatggtcttgatctcctgaccttgtgatccgctcgccttggcctcccaaagtgctgggattacatatataagctactgcacccggccaacgttttttttttaaagtttccttttttttgttaaaggataataataaatgttaaaaataataatttcttttaaagactttcttcaagcctccttgctttgtgctcataactctttgttaagccctatcctatgtagctgttagatacaaaggaataagtacattctgtgtccttgtactttaaccaagatatttgtgctgaatatgctcacaggcacattccagcttgcagcctatgccccttccttatttggaaatactacttttctaagtccttttgcaagcaacttcctcttttcctttgttctctattgcctatacctatttttaaaagttttaaattattagccagtcaggttttagattgtaaggtctggctccagccaatggagacaaaacacagcagcggggacaagctgcgtaaaggataaaaattgcttccctccattgttcaggtgtgctgtcrtcattgttccatctgtaaggagcaccctttctgcagaaagtaaaattgccctgctaaaaaaactttttgtctaaatgctaatttttccttatagtagtaaggaacaagcattctgtttctaaataaacattttacttataacaaaatggtggcccgtacggggatacactcctccaggggcggtctctagtcctctctcatgaggaggcgccccactgcctcgttgcggtggcctctggggtaaggaatcgagacccaccctgtgtgacgaataaacctggactctcagcaacgcggaaagaaagcagccagtaacctggagtgcagggtcctcacataccacgcgggccaggtaacctcatgcataagacaaggaaggaaataccggaggagctggtaaaatatttccttggtggtcaggactaaggaaagaaaagctgcggggyggtaaagcattccttggttaggacataccwaggtaagagaaacygcaggggcggtaaagcattccttaggactgaagaaagaaaagccgccagggggcgggtcggggtggggcggtgaagtattccttagtcaggatgtcttaarggttaaaaagaggtgaaaagtccccattaggggggagattaaacatcacacaaacctccagtagtaamaaagatattcgggccgggcgtggtggctcacgcctgtaatcccagcactttgggaggctgaggcaggtggatcacgaggtcaggagatcgagaccatcctggccaacaaagtgaaaccatgtctctactaaaaatacaaaaaattagccgggcatggtggcgggcgcctgtaatcycagctactcgggaggctgaggcaggagaatagcttgaacccgggaggcggaggttgcagtgagccgagatcacactattgtactccagcctgggccacagaacaaaactccatctcaaaaaaaaacaaaacaaaaaaactaaaagtcttttagcacaggtcctacccctagaatttccagcacaacagcaccaccctggggaccacgtcctcatcaaaaaataaaaagaaaaaaaactcaagctagcctaggaaggaccctaccttgtgctgctaaccaccaagactgcctttgcacagcaaaaaaaggatggacacatcatacccaagtcaaaaaagcatcatcaccttcagaatcatgggccattgttccaaagttatctctctttttcttttcttccctttacttcccatcttataactaatttttgttgtcgttgttgttgagatggtgtctcgctctgtcacccaggctggagtgcaggggtgcaatctcagctcactgcaagttctgcctcccgggttcacgccattctcctgcctcagcctcccaagtagctaggactacaggcgcccgccaccatgcctggstaattttttgtatttttagtagagacggggtttcaccgtgttagccaggatgatcttgatctcctgacctcatgatccacccaccttggccttccaaagtgctgggattacaggcgtgagccaccgtgcctggccaacataactaaatctaactcacctcaagttattacttttaatgcctgtttaattatgccttataaagatttacataaccaaaaacagcttactacttcagaaaaatatctctgtccctcttggacttcctcaaattaggaagacatagtaagttcctttaagaatactagtaatccagagaatagtagctgtattagtaaaaatcagactcttgtccttctgaaacaaaatctctatgttctgcttagtctaatgtcctatacaacactaaaggtttaaaatagactgcttccataggtctttgtcagtccttaaatccatatatccatttcaccaaaagaattactccttctagttgtcaatctccttcaaccactccatcaatcactcctcccaagcacaaggacaagactgaagtctctatagtaaaggtgaaaaacctaaggcaaacgatagcaatgaagacaaggtatcaaaatataaatgcctggctaaaatggattaaatattccatccgcactctaaataaaagcgactgttacgcgtgtgcgcacggtaggccagaggcccagcttgtcccctttccactcggacagtcctctaatcgacaagacgtagactgcatagtaggtccttttcaaaatcccacagcctaggatagtaaactgtgccagactctctctgctatttcctaaagtgcagtaccctgcaggtcagccctcaagggccatccagcctccatcttccaagaccagttttacctcgtgtctccaatgacgaaggaaaaatttggcgtaccttaaagacttaataggatgcagtaacgtcaggcacttccaagagctaacccatcagtccacccttattcatctccaagtgaacgtatgttagtattrtaaaaaacctttactagacactctgccaaataattaaagcagtacttatgctgtagttcaattggctatcccttttaccctggcatttcatcaaccaaaaaaactctttcttttaaaaactcaagcaaaacagctaagccaaaacatgttttaaaagtttaaaaagaaaaaaaaaaaaaacactgtaaaatcaaaaggagggaattgtagaaagtaaaaagtttccttttcagtttcctttctggtaataataataatgttaaaaataataatttcttttaaaaactaacttccttcaagyctccttgctttgtgctaataactctttgttaagccctatcctatgtagctgttagatatagagaaataagtacgttctgtgttcttgtacttgaatgaagatatttgtgctgaatatgttcacaggcacatacagctcgcagcctatgccccttccttatttggaaatattattacttttctaagtcctttcacaagcaactttctcttttcctttattctctattgtctatactttttttattttttattttttgagatrgagtcttgctctgtcaccaaggcttgagtgcagtggcccaacctcagttcactgcaagctccgcctcccaggttcacgccattcttctgcctcagcctccctagtaactggaaccacaggtgcccgccaccacgcccggctaatttttctgtattttcagtagagacagggtttcactgtgttagccaggatggtcttgatctcctgacctcgtgatccgccctcctcggcctcccaaagtgctgggatgacaggcgtgagccaccgtgcccggccacctctacctattttaaaaagttttaagttgttagccagtcaggttttaatttaaattgtaaagtctggctccagccagtggaaacaagacactgtagcaaggccaagctgtgtaaaggataaaaattgcttccctccattgttcaggtgtgctctcgccattgttccatctccaagaagcacccttttggccgggcgcggtggctcacgcctgtaatcccagctctttgggaggccgaggagggcggatcacgaggtcaggagatcaagaccatcctggctaacacggtgaaaccccgtctctactaaaaatacaaaaaaattagccaggcgtgatggcgggcgcctgtagtcccagctacttgggaggctgaggcagaatggcgtgaacctgggaggtggagcttgcagtgagccgagattgcgccactgcactccagcatgggcaacagagcgagaccctgtctcaaaaaaaaaaaaaaaaaaaaaagaagcaccctttctgcaaaaagtaaaattgccttgctaaaaaaaacctttttgtctaaatgctatagtaccaaaaaacaagcattctgtttctaaataaacattttacttataataggggtggaggggttgggatgagactgtgccttcatagacagccagtgggccagtttctactaatctgcccagggtcccactagattggagtctgagctccttcaagggccagaatcacatccttgtagccctagaaaccaacacatagccaagtacgtgggcttggatccaccccatgacagccggtgggatcctgtgtgacctgcccaccactctggcccgacctcaccagctctcacctaccccatcgctcattccactcagctgcagggccactgactggtgctgggacccccagacacatcccacctccaggcatttctgtacccttccctcccagacatcacaagtcatgcagtcccttcctttaaggctttgttccaagccaccttctcagggagctccccctgccccactccccccacctgctctatgttaatccatgtcctcaccaccccgacatgctatagagttggctcatctgttgggtattgtctgtgtcacctccccactagactctaattcccaagagctgtatccaacacttaaatggcctcaataaatgtttgttgagtgattgggttaatcctaatcatagttaccatttattgaaagcccaaggcaggtgcttcacagctcagtcattctcacaaagatcttgttatggaaggtgctgttatcccatttcacaaatgaggaacctgaggttcacagagtttaaagcgacttgctgmggtcctgagatgactgtagaactctgattcaaaccaggggcctggggagtccataccggggagtccaggcttttcacactatcccacaggcgttttgtactcttacattgagcagttttcctgacccatgctgcctggttcagcctcactcactcagggccagtccacacgtagaagcagggaaccaggatgctagcctagggagaggtggggtgagcaaatccatcttagtccctttgctgcttagggactttttgttggaaaacaaaaatttgtttttaacagccccatcagtggcatatgagattatgcaattccccatatactcattaactttgagtattaatcagattttacacatacacacatggatgatgttaattttataattattaactatgcctaactaaatcatagtgcaaattcagtagggctgtctattctcacccatttttctaaagttttctctgatttgtgcccttaaaatttataatcatgttactatgcattgaatcgtaacctgttccctttaggctgaagcagcatttatttgaggaaactgaactcccacaaaacaaaccactgattattgcttcttgctaaaggtgttgccttcccttctgagaaatatttacattctctgagaaacaaggatcggagtaaaaacaaaaaacaaaaaacccagcttattaaaattccacttattacagaagtataaagccagatctagacaacaaatagggaaaatcatttaacctcccaagtaggcaaatcastgcaaaattaaagcaagctgttattttgggaccactttagtaaattytaaaaataatagagctccgtgttggtaaggtgtagggtagcaggcgttcttacaaactgcagggtgagcagaaactgttacaacttttctagagggcaattagcagtagatgtcagaagcttttacttgttctctttagttgaactctctttagttgaagaacttcagtcacaggaactactctttaaaaattatcatgaatgttggccaaaatgtgcatacatagatgtcccagacagcattgtttataattgttttaattttgaaaaactgtcaacaacggccgggcgcggtgtctcacgcctgtgatcccagcctttgggaggccagggcgggtggatcacaaggtcaggagtttgagaccatcctggccaacatagtgaaaccacatctctactaaaaatacaaaaaattagccgggcgttgtggcgggtgcctgtaatcccagctactcgggaggctgaggcaggagaatggcatgaacccgggaggcagagtttgcagtgagccaggatcacgccactgcactccagcctgggcgacaaagcgagactcctgtctcaaaaaaagaaaaactgtcaacaaccaaaatgtcaagagaaagttaaattatggagaatgtgcacacagtattattctaactgtataaatttcaaaatcaggtaaaactaaacagtagattgtttgggggatatattcatgtataataaaaccattggctggatgcagtagcttatgcctgtaatcccagcactttgggaggccaaggcgggcggatcacctgaggtcaggagtttgagaccagcctgaccaacatggtgaaaccccattctactgaaaatacaaacattagccaggcatggtggcaggtgcctgtaatcccacctacttgggaggctgaggcaggagaaatgcttgaacctgggaagtagaggtggcagtgagctgagatcgtgccattgtactccagcctgggcgacaagagcgagactctgtctcaaaaaaaaaaaaaaaaaagtagaaaaagtaaaaccatcaagaaaatcaaggatgattaacagacagtttgaaatagtgtttcctggagacaggaatgagaggggatttgataagggaggaggagttctggggcacttctgaagtcctggcgatgttatttttcttaagctgagagtgggcatgtggatgttaattttataattgtttaatcctatatgttatatgtactcttttgttatacatttcatggcaaaaaaaaaaaaaacaacgaaaaatcaaatgatttgcttagcttacaaaggtcatccacattttgtggcatttttaaaaggctgataatcactaagcttaccatgcataggcatggttctaagtctttttccgtgtgttaactaattgaacttcaccatgaccctatgaaatagatccccattttacagatgaggaagctgaggctctggagggtaagataattggtcaagatcacacagccactaagtgtcagggccaggcactggaaggctgctgtgtggcctcatcactcaccatcttaaccactttgcaaaaatgttctcagtgtgttcttatcaggatttattatttttaatttagctgtggcttcagttgactctgagttttctgcccttgtgaaataaaagggcatgaaacttagcttgcagttacaggagatacatttgtgaccttcagagaaagtcactggcagaaggctccctgcctgccttgagtttttcctttgccgttacccagattgactttctttcaaacccagactgtgccaatggctttaataaaagtcaggctgagttttgggttgcgcttctgggccagaatcttttggttgactccatttgctgcattcaacttgtaacctgctcaaaggctctgttctggctccagagagagcagaaccaggagccctgccagggcgatggtggtggagccatgagtcgcctgggaaggaacgcatttgatggatggacgtgctctgctctcctttcattatgagggtgtatcctccccgtccctgctcagcagacacagcggttgaactactcagagacatgagcatacattatggcccagagatttaggagccctggtccactttcaggtctgcttctgatgtgtgatgcaatttggggcatgactcaacctgccttgaccttcgtttatctacttataaaatgatgagtaatgacaatgcttcctggatgctttataattctgggtgccaacctggacaagcgcagctgtgccctttctttctacctgcacaccaacagctgcacacccaaggagcaaagtgcatggcagggcagccctaaccccaggacactcacgcctgcatgctggagattaggtctgccctgttgtgttcccargtccactgtgcccagcactgcccagcaatcctgatgtctttgcctgattaacacagtttttttgctctccacaacaaacatttcacacctcctccagtcttttcaaacctgctcttcctcctcactctcaaatctccctttttactctaccaagaaagaaaagaatcagtttgaaatttcccaatcctcctgatagcaaaattaaccaaccgcatttgcacccaagtgactcttctttccccacccgcaatagaagaagctgatgcctgcagcaatacttgggatcctgccctcccctgccttctctgttccttattctattacttgtccttcctctctcttacgcattcagcctctacttacctggaccctgaaacacattcaagtctcctgtaataaaacaccttcactaaaccttccattcccctccagctaccacttttctctccccacctcagctaatctttttattttgttttgttttgagatagagtctcgctcagctgcccaggctggagtacagtggtgctatctcagctcactgcaacctccacctcctgggttcaagtgattctcccacctcagcctaccaagtagctgagatgacaggtgtgtgccaccgtgcccagctaatttttgtatttttagtggagacagggtttcgccatgttggccaggctggtcttgaactcttgacctctagcgatccacctgccttggcctcccaaagtgctgggattacaggcgtgagccactgcacctagcccctcagctaagcttttattagttgtctgcacttggcattcccacctttcccctcccactcacacagccctccctgtctggctccctgcaaaagaaggcgccgtctcttcctgcccttctgtacattcatatttcagctgtgtctcatctaaatagcacagtcagatgtttttaaaaatccagtcattgactttttttgtagtatgtaacctgttctagtttattgtaactacttttttctcctgtgttactgtctctaccaccttcttttcatcattctttttggattaaacaagtctggcttctatcatttctggtgggcagtaaaatggttaaatcttactgttgattccatcataggtaacagatcctttttttctctaccattaagattttctctttgtctttgattttaagcaatgttattatgatgtacctatgtatagtttttttaaaaaatattttcctcttaaatctgtggtttattgtctcttgttagtctttagaaattcttaaccattatctcttcaaatatagcttctgcccgatttttctctatatgagagtccaaacatatactttttcattatgtcctgtatgtctctctccctctatctctctctctctgtctctttctctccctctcccatctttctgagatgggggtctcattctgttgcccaggctggaatgcagtggcacagccctagctcactgcatcccagaactcttgggcttagcaggagcacccactcactatgttgtgcagactggtcatgaactcctggcctcaagcagtcctcccaccttggcctcccaaagcactggggttacaggcatgaaccatggtatttggccctgtatgtctcttatactctttatttttcattcattttttctcctctgtgcttcactccaaatattttccattgacccatcttccagtttaccaatcctcccttcagcttagtctgatcttatgttaatttaatttgtggagttcttcatttcagttgccttactttttaggcaacttacttttttttttttttttttttgagttgaagtctcactctgtcacctaggctggagggcagtggtgtgatctcggctcactgcaacatctgcctcctgggttcaagcaattctcctgcctcattctcctgagtagctgggattataggtgtgcaccatcacaccaggctaatttttgtatttttagtagattcaggtttcaccatgttggccaggctggtctcaaattcctgacctcagatgatctgcctgcttcggtctcccaaagtgttgggattgcaggtgtgagccaccatgcccagccaaggccttaatttctatttgattaattattataaattctagtcctctggagaaatttctatttgattctttattatatattctggttctctggagaaatayattcttttcatatattttcttgaccatattagttacagttattttaaagtttatatctttcagtgccagtatcaggatcacccatgagtctatttttattgtgcattttttcctctttgtttttggtcacttactcttggatcttagacttaggatgaccaaccatcccagtttactcaggactcgcctggttttggcagttcaagtcttgcatcccaggaaattccttagtcctaaggaaactgggacacttgcttactttttagtcctggtatgcgtggcaattttttactgaatgctggacattgagtatgaaaaactgggataatttgagattcaaaaatattaggttgctagaaaagtccttgtggktggaccgtgaattttatataattataacttggctcaaacacatctttattaataaaagtaggatccattacaatcaacacatttttgccaaagagaaatgagtttgtttattcctgtaccataaaaatctgtgctttgggattcartgaactcttggaaagcattttctgcatccttctggttgtgttttccctgcacaaagttctcacaatgcttgaagaagtagtagtctgttggcaagaggtcaagtgaatatggcagatgaggcaaaactttgtagcctgatttgttcaacttttgtttttgttttttgctttgagatggagtctcgctctgttgcccaggctggagtgcagtggtgccatctcagctcactgcaacttctgcctcctgggttcaagtgattctcctgcctcagtctcccaagtagctgggattacacaggtgtgcaccaccgcgctcagctaatttttgtgtttttagtagagacagggtttcaccatgttggccagctggtctcgaactcctgacctcaggtgatccacctgccttggcctcccaaagtgctgggactacaagcgtgagccaccatgtctggccttgttcaacttttgaattgttggttgtgtgacatgcagtagggcgttgtcatggagaagaattgggctccttctgttgatcaatgctggctgcaggcgtttcaatttttggtgcatctcatcaatttgttgagcatacttctcagatgtaatggtttcgctgggattcagaaaactgtggtggatcagactgacagcagaccaccaaacagtgaccaggacctttggtgcaagtttggctttgggaagtgctttggagtttcttctcagtccaaccactaagctggtcattgctggttgtcatataaaatctacttgttgtcacacatcacaatctgattgagaaatggtttgttgttgtgcagaataagagaagacaacccttcaaaatgatgatttttttgactttcactcagctcatgaggcacccacttatcgagctttttcacctttccaatttgcttccaaggctgaacaatcatagaatggtcagtgttgagttattcagcaacttctcgtgtagttgtgggagcagcttcgatgattgctctcaattggttgttgtcatcttccgatggccgccactacrctcctcatcttcaagrttctcattgcctttgcaaaatttcttgagcccctactgcactgtatgttttgctggaccaaatgcattgtggatgttgcggattgtctttgctgctttatgatccattttgaactcgaataagaaaactgctcaaatttgctttttgtctaacatcatttccatagtctaaaataaacataaacagcaaataatccattattagcaaaaaaataaataaagcgagaaatgcccattaaaatgatgtataacataaccacatttattcaagaatgtattccaatatcaaatagcaaattccaacaatgcaaaaactgcaattakttttgcacttttattatgcttcatagagaatttgcttttgctcttaacacacagagtggaggcaaagaatctttatctagtctgaggctgagctgattcaaaactgggtttccattgatgaagacaggtccatttccagatgactcttcctcctagtaaggaagtctttggaggatcccagctgaaggtctggatatttaccaagccccttccctgtgataagcctgaaggccagttttttcctctctagtaagatgaaactgctggaagcatttttttttttttgctttttttttttgagatggagtctcgctctgtcactcaagctggagtgcagtggtgtgatcttggctcactacaacctccgcctcctggattcaagctattatcctgcctcagcctcctgagtagctgggactggactacaggtgtgtgctaccatgcccggctaatttttttatttttagtagatatggggtttcactgtgttagccaggatagtctagatctgctgacctcctgacctcatgatctgcccgcctcggcctcycaaagtgctgggattacaggtgtgagccactgcgtccagccagctggaaacattcttaagcttctcggcccctcagccacagcttccagttcagcaaacgccttgaggaaaaggcagcatctcggtactcgtggatttgccctgtctctgggaccttagctcctcaggttccccatgacttcgtagccttgaatgctgattttgccccccagtcccgttagactgctgaaaactctgctgagcttctgagtctctttgccatttcattttgattgacatcttggccgtccagcccttggacgtgcagcggtagtgattcaatgtgctcctgatgcaaggagagtcaagcaggtcagtaggatagaatcaagtcctgtgttgcttacacagggacttatgccttgaagtgaaaggcagctccggatgtcaggcttacttccatgtgcttctcttcagcatcttggccccttgcatcctggtggtcttggcagctctacaatctcttgaaatagtttagttgtttaattcagctttctaattgttctcagcagaaaagtgtgtgtaacaccatttagtctgacatagcctgaagctgagtcccatgacaaatgctgtatgattcattagcttctccgttcatctacctggttcttctctcaggctgctcacaccttttgccaagctcctctgtccattctcttctatcttcacttctcatacctcactcactcatgctggtgcaccagtccaagctttttttttttttttttttttttttttggtagaratggggttttaccatgttggccaggctggtctcaaactcctgacttcaagtgatccgcctgcctctgcctcccaaagtgctgggattacaggcatgagccactgtgcccggcctgtgcctttttgagtgtgtaaaaattttacattgttttccattttaacagtggaatggtgttgacaggtgagatttttcagagccagtgactggatgtggtgaagcttgttttgttcttagcattcatcagttcaggttccagcctgtctgatgacttgttggtattgtttattgtttgtttgtttgttttgagatggggcctcactctgtcgcccaggctggagtgcagtggtacaatctcagttcactgcaacctctgcctcccaggttaaagcaattcttatgcctcagcctcccaagtagctgggattacaggtacgygccacttgcctggctaatttttgtattttagtagagacggggtttcaccatgttggccaggctggtctcgaactcctgacctccagtgatccaccctccttggcctcccaaagtgctgggattacaagggtgagccaccacgcctggtctcagttgctgttttttttttctattttatctttcccttgtggttctgactttctgcccccaggcttgttttttttttctttttctttcttttttttttttttttttttgagacggagtcttgctcagtcgcccagactggagtgcagtggggcactttccactcactgcaagctccgcctcctgggttcacgccattctcctgcctcagcctccggagtagctgggactatagctgggacgccaccatgcctggctaattttttttttctttttttgtatttttagtagagatggggtttcaccttgttagccaggatggtctcgatctcctgaccttgtgatctgcctgcctcggcctcccgaagtgctgggattacaggcgtgagccactgcacccggcactcccatgcttgtttcttagtttcttttcaagatgttttatagtgtggaggagctagttgggaattcgaagtagaaatcagttaggcttgtcttcctataaaaaggcagcacagagattggttgcatgcaaagtatttaagcacgtttaatagtgataaggtagctgattgtatcttttaggcccaggaattttgtgctaattaataacattcattagcctctccttatctacatcgtataagcttggagtaccctagactgtgatgatagttttatttttcattttaggtaaccagaaaaattcagatacaatttactgttaccattgggtgcacactttacttgctttattctatttattcctcaccatagccctgtgagatcagtatggttttttccagttagactttgccacagctaatgagtggcagcactagcatttgagtccaggtctatctgattcccagtcgcagccacttagccccagactgtgccgctttccgcatagctgtcctgccatggatattatcttggcctcctgggagtgatcttgcagaattgcataggagctagtccatttcgccccaagcaatttgtgttaaagaatgagatcgtgtaacatttattgctaggcaaaaactgtatctaggcaagagagggccttctgaggattctctrtctccttgagatagaacatgtggcaacttattttggcaaagtacaagctggtgcattattaacttgatgtgagtcaggatacatgctgtatgagtttttatttatgtgctgtcttgaaaccagaacatcaaaaaagtgaattaactgaagtaacttrttatatctgttattcttgatttcagggaagtttaattagcattgacagcacctgtacagagatgggcaattttgacaatgctaatgtcactggagaaatagaatttgccattcattattgcttcaaaacccattctttagaaatatgcatcaaggcctgtaagaaccttgcctatggagaagaaaagaagaaaaagtgcaatccgtaagttgttttttttaagtttaacatgagacatattgattccaaaatgtatatgaaaaagtaaaagtctaagaataaccaagacaattattaaaaaaaaaaacaaaatgaaaaggcttacttcaagtattattataaagctgtagcaatgcaaacaatgtgttattgatacaaggacagaacaagtcaggaragtagaatcaaaagtccagatacagaccttagcgtatatgaaaacttacatgatcaaggagtgtcttagtccatttcggctgctgtgacagaataccatagaccaggtggcttataaacaagacaaatacatatctcacagttctggaggctgggaagtcgaagctcaaggtgctggtagatttggtatctagtgagggccccctttctggttcttagatgactgttttcttgtgtcctcccatggtagaagggacaaggcagctctcttcgggcctcttttatgagggcactaatcttgttcatgagggctgcaccctcatgacctaatcacttcccagagaccctacctcctaataccatcacattgtaggtcaggcttcaactatgaattggtgagcgaggtggacataaacattcagttgtggagctattacagatcagtggggaaaagtggacttcaataaatgatgttgaaaaatttggctttccacgcaggaaatacaaaattaaaatcttgattcacacaatccataaagagatttaaaatgttattctcactgacagacatgaaaaggtgtagcaccattataataataataataataatattattattattattattattttgaggtggagtcttgctctgtcacccagactggagtgcggtggcgcaatctcggctcactgcaacctccgcctcccgggttcaagtgattctcctgcctcagtctcctgagcatctgggactacaggcgtgcaccaccacgcccagctaatttttgtatttttagtagagacggggtttcaccatattggccaggctggyctcgaattcctgacctcgtgatccacccaccttggcctcccaaagtgctgggattacaggcatgagccaccacacccggccagcactattattttaatgtgcatttcccttattactaacaaagatgagcaacttgttttaaaaaaaaaaaaatagagacagggtctcactatgttgctcaacctgatcttgaactctcagactcaagcagttctcccacctcagcctcccaaaatgctgagattacaggtgtgagcccagccttttgagccactttttatatatgcatttgccacttaggtttattttattttgtttttttgagacggagtcttgctctgttgcccaggctggagtgtattggcacgatgtcagctcactgcaacctctgcctcctgggttcaagcaattctcctgcctcagcctcctgagtagctgggattacaggtgcccgccaccacacctggctaatttttgtatctttagtagagacggggtttccccgtgttggccaggctggtcttgaactcctgacctaaagtgatccacccgccttggcctcccagagtgctgggattacaggcatgaaccactgtgcctggccaggcttattcttttgtgagttttctattcatatcttttgcccatttttctttttaaaaatttaattaattaaaattaatttttttttaagagacagggtctttcttgctttgtcacccagcttggagtgcagtggtgccactatagctcactgcagcctcaaagtcctagtaggctcaaggaatcctctcacttcagcctcctgagtagctgggactacaggagtggagtgcaatggcacgatcacagttcactgcaggctcaagccatctccctgcctcagcctcctgagtagttgggaggcacatgcttgtagtctcagctatgtaggaggctaaatttgtaactttttttttccagctagattttttaacttatttttgtagagacagggttttgttctgttgccaaggctggtctcaaactcctgggctcaagccatcctcacacctcagcctcccaaagctctgggattacagccatgagccactgcacctggcctcccatttttctattggattgtttattgttttatttatttaccagaggctttttgttaaacctaatttaaataggtttaaaaattatttrttagttatatgtattgtacgtattttatccatcctagctgtaacttgttttctaacttgtttattatgacttttcttgtagaaagtttaatatcaaatgtatcaagcttttcctttaaactctctgctttttgtgtctgtagaagaattcctgtggcacccaagggtttaaatacgttctctggtttcttcttatcgtttttttttttttttccccacacttagatctgttcacattacaagcggaattgattttctatatatagtttaaggcaggggcctcagttttgcctttcttttttcttacatggggaacttctggcatactgttttaattaccagctaaagagtgatgatgggaaaagaaatcaattgttgatttaatcaaactctcttctgctctgaaatttttagtagctctttagtaccagacaaattaagtacacatttctatagcacttgtggttccttcgtaacagaatctctcctattgttctagtcttagcttttattattactcttcctgtaccgtctacctcaggaaaactggaatagtctttgccccaaaagtatttcctgacttttaaatttcaaaatttgaggaatgcagttaaagcagtgcttatatttaaaagaaaaagacttaaaatgaattatttaaacctccaccttaaaatgctagaaaaaggctgggtgctgtggctcacaactataatcccagcactctgggaggccaaggcaggtgaatcacctgaggtcaggagtttgagaccagcctggccaacatggtgaaaccccatctttactaaaaatacaaaaattagccgggcatggtggcaggcacctgtaatcccagctactagggaggctgaggcaggagaatcccttgaaccagggaggtagacgttgcagtgagctgaggtcacaccattgcactccagcctgggcaacaagagcaaaactccgcctgaaaaaaaaaaaaatagagaatactcaaataccagtataggaatgaaagaagagacaacatgacagcacttgcagacattcaagtataataagggggtcaggctgggggctcatggctgcaagcccagcactttgggaagccgagaagggtggatcacctgagggtcaggagttcaagaccagccttgccaacatggtgaaaccccgtctctactaaaaatacagagaaaattagccaggcatggtggcatgtgcctgtaatcccagctacacaggaggctgaggcaggagaattgtttgaacccaggaggcagaggttgcagtgagccaagatcatgccactgcactccagcctgggtgacagagtgagactccctctcattaaataataaataaaaattagccaggtgtggtggcacacacctgtagtcccagctacttgggaggctgaggtgggagaatcacctcagcccaggagggctgtgattgtgagctaagattgtgccactgtactccagcctgggcaaccaagtgagactctgtctgaaaaaaaaaaaaaaaaaaaagaaagaaaaaaatatataataaggggatattatgtaaaactttgtgctaataaatttaacagcttagatgaaatgaacaccttcttttctttctctctttttttttttttttttttttttttaagaaatgaggtctcactatgttgcccaggctggtctcaaactcctgagctcaactggtcctactgccttagcctcccaagtagctgggatcacaggtgcacaccaccgtgcccagccaattaaaaaaaattttcagtagtgatgaggtcccactatgttgcccaagctggtctcaaactcctgggctcatgcaatccttccgccttggcctcccaaaatgctgggattacaggcatgagccaccacacctggctgaaatcgacacattctcaagagacacaaattgccaaaactgacatgaaatgaaatagaaaacctgaataactctatatctgttaaagagattgaattggtaatttggcatcatctagaagagttgaaggggcatataccctatcactcctggttatatgccaagagaagtgcttgcacatgtgcaccatgagcagagggaaaaactaggacataagacaaatgttcatcaacaggataaatgacttgtgtattcattcagtggaatgatacgtaggattagagatgaatgagcggcagttacagcaacatagatgaatcccaaacataatattgagtgaaaaaaagcaaattatggaagaatgtatacagaatgatcccatttatataaaagttcaaaaacagggaaaactaagcagtacattgtttaaggagacacatcaaaatggtgaaaccataaagaaaaccaagggggtgataaatataaaatccaacgtggttattacctggttacgggcaggactrtgatagggaagtcactggttatgttctgtttcctaagctggggggcaggggtacatgggtgtgcactttattataatgcttccaaccgtataggtatattttmtrtattctgttttacatatttgagattgcatgaatgtgtaatgctcagtaacttaagagtaaatgaactgtgaagaattagagatggagttttgagggattttttgttttggtttgattttttgagacagagtcttgctttgccgtctaggctggaatgcagtgatgttatcatggctcacttcagccttgacctcctgggctcaggtgatcctccaacttcgggcgtcgagtagctgggactacaggtgcacaccaccacacccagttgacttttaaatttttcgtggagatgagttctccctgtgtattgcccacrctggtctcaaattcctggcttatggaatcctccctgagccaggtgcctggccagtttttgggttgttttgtttttcttttttgagatggaatttcgctttattgcccaggctggagtgcagtggcgcgatctcggctcactgcaacctccatctcccaggtacaagcgattctcctgcctcagcctcctgagtagctgggattacaggtacatgccatcatgcctggctaatttttgtatttttagtagagacagggtttcaccatgctggccaggctggtctggaactcctgacctcaggtgatccgtccacttcatcctcccaaagtgctgggattatagttgtgagcttctgcgcctggcctcctggccgatttcgagtattttcacaaaaagcttaacctagggggaagaagagacccaagactggggctaaagaagggcacagatagaggaggctcactgtgattttttactttggaaagtagagcctgtttctagcctgtggagagggggcttgggctgctgctggttggggggtcattgccatcactggggctgccagaggagccatgaagggcagcgtaggggcctgtatggaggggtcagcctagaacaggacaggacatgtcttcctctccgcctggatttcaggggctgggtgagtgcagatggagacatctgtcatgctgcgtgcgacctctagactcagcagaatcccacttctcagcggttgggaggagcagagtctttgaggcccctgcaaggaaacagcacagtgcgaggcatatgctttctacttccacttttttttcttttgcaggtggtgggtggcagaagggacgggaatccggctcatggccttgacatccaggcaggcgagagaatctctagttccatggtcttcgccaaatggagtagggcctgaggaaggcaggacgagcttcacacccccaggaatattccagagggttatgtggctagcatttgaccatagactgcatggatcagaagctgcccacccagcactaacgttgctcactattaggctattaagtcctttctatcaacccaaaaattccagcaggaarcctggtaaagaaaacgctggcatgtgggttctctgctgcccccaaactctttatccacccctttccctgagttctcactctgtccccgctgtgtttggcccctaggtatgtgaagacctacctgttgcccgacagatcctcccagggaaagcgcaagactggagtccaaaggaacaccgtggacccgacctttcaggagaccttgaaggtacttgctggacagatattcctgtgcagagtcctccygagcccgggtggagcgcctggggcagagtccagtggatggtgctttcaaactcttgactcagttagatataatacagacacctatatgtttcttcgcagctctgtcaatcagtgttaagttggtagaaaataaatgtcagcctttgtacaggaaaagtgcagagtctgccagactcaggaatggcttttgattaatgatttctgagaagatggtgaaaaagaacctggctgcctctttgtctcgggctaacaccggggcacaggataattttaaacattagtttgtcttagtgaatgtttctgtcaaagaggtgctctcagacagagtgccctgaaaattaaactcctgagttactgtctttgtaaaagtgcccctttattgtatttctgacaaactcaggtttcttctaattttattttttttaaatgaatccttttatgaaaaatcttacaaaggaattgtttgggttttcactttctatgatactaggaaatgtgattgatggttgagggcagagatggggccatgcgctctgatgtcgggtggaaggctgcagctgaggtctggtatctgcagagagctggctgtggtggccccaatcttggtgcagggtgaggggggtagcccagagctgcagaggctaccctgccggggctgggcagccagaggtcccctcgtctcatgcctatgacaggagagggctttgtttgcctttcttggcaagtagggggtgtctgtgagctgccagccrggggccatctgggcagctggcacagagccctgagttcattaaataataatagcccttgtttcctgggtccctactgtggccaagtgctttatatacagcctggggtaattattagaatcctcatttacccacggggaaactgagacctagagagtccttagaaatacagctcaaagccacaaaggactggcagttctcaaaatttgtgtgcgtaaaatcccatggggatttacatttttaaaacatttcttcttttcttttttttttttttttttttgagatggagtttcactcttggtcgcccaggctggagtgcagtgacatgatcttggctcactgcaacctccacctcccaggttcaagcgattctcctgcctcagcctcctgagtagctgggattaaaggtacccaccacgatggccagcaaattttttgtgtttttagtacagatggggtttcaccatgttgaccaggctggtcttgaactcctgaccccaggtaatctgcccaccccggcctcccaaatgctgagattacaggcttgagccaccacgccaggcctaaatttcttattttctaagatgcccctgtacttagaactggggatttttttaaaatgcagattctgggccgggcgcggtggctcacgcctgtaatcccagcaccttgggaggctgaggcgggtggatcatgaggtcaggagatcgagaccatcctggctaacatggtgaaaccccgtctctactaaaaatacaaaaaattagccgggcgtggtggcgggcgcctgtagtcccagctacttgggagactgaggcaggagaatggcgtgaacctgggaggcagagcttgcagtgagccgagatagcgccactacactccagcctgggtgacagagcgagactccgtctcaaaaaaaaaaaaaaaaaatgtagttatataattggagttaaaaggttacctaccttaaaatgtacacagaatctcaaagatatcacttaaaatttttatccatgggtcttatctagtatattgtgaatattttatagtcctgggaaactttccagttacaattaaaataatcggcatctctaattgatcctaaatgcaaaatawcccaacaccggccagcctcatccttaatagaaatatgcataagatgcgaaggatgggaagccggggaggccgatccagcattaaaagtctcrctagaagccagtatttccaatcacaatcacacctttgtgcagcacccaggctttgtgcgacctgaggtgagccatcagagtacgattcaggtggatgaggctgtgagaactgtctccagccagttttgagagaagtgcacatcaaatgcgaggatctagaaattgatcctcaaatttttctgagcagagtacttcttggcaagcctttctggacccagggagacttgtaccccatttgacaccactgtcctgggggcctggagaggatgaagtgatctcactgggtgacattggtcattgcctggccctgctctcaaatgatccttacacctcattcccagctgagcctggagcaagccttgtggacctaacagggctatggaaaataggtctggtttgaaaaggtagattctaggctgggtgyrgtggctcacgcctgtaatcccagcactttgggaggccgaggcaggcggatcatgaggtcaggagatcgagaccatcytggctaacacggtgaaaccccgtctctactaaaaatacaaaaaattagctgggcacagtggcgggcacctgtagtcccagctactcgggaggctgaggcaggagaatggcgtgaacctggaaggcggagcttgcagtgagctgagatcacaccactgcactccagcctgggcgacagagcgagactccgtctcaacaaacaaaacaaaacaaagcaaaggtagattctgtatgtagcagggagtagtcctattgacagaarggggcgagcaatgggtaaggacccaggagaagtggctgagcgtcgcccacacacagctggagatgagagagctgcctgggggcccgagcccgaccctgctaagtggcgtggcgttctagtaaccgcttcatttctcagagggcagcagatgcagctggccagctgcctggactaactgataaggagtgtagctggaatatggggaataatcacatcaatccagagtttatagacagagattgaatgtggggcagagtcggaaatggacccrtgggctgggtgtggaggctcacgcttgtaatcccagaactttgagaggctgagacgggtggagggcttgagcccaggagttygagaccagcctgggcaatgtagagagaccccatctctacaagaaattaaaagattagccgggcatggcgacgcctacctgtagtcccaactacttgggaagctgaggtgggaggatcgcttgagcctgggaggtgcaggctgcagtgagctgagatggcactgctgcactccagtctaggtgacagagtgagatcctgtccccccaaaaaagatatggacccatagacttgagggaaaactggctaaaagttacccaaaggcaggagaaaagggaatgtgacccaagaaatgcccatctccatggccacaagccaccccagcggggaggaaaaggaggaatgaactgaggaagctaacctggccagccaagccatktgtgcctggccygcagacatcagaagtgtggacagagcctacaggcagcccccaacagagcaggggacggccctgctgcgcctcccctctgtttgcagaggctgaaggagggaaattaccgtgtctcagttcctgttttattccatctcgttcctcgattggaaagatgggtaaaggtgggcatgaggagatgaaccccaaagcaaacaaaccgcacagctgctgcaaatgggtgcaagtgtccagcctcacagcaacagccgtgtcacgaggagtcaccattcaaaccccaaacaagcgccggagtgrgggcagcatgggccacagaggtcagcagcgagactcgggcctggacacagtcagtgcacgtgaatctggcctgcagtgtcggctaccagaccaagggagggagggtcactgaatttccaagctgcttttttttcacctgcaacatggtttgaattatactgacctcatagggtgcgtgtgaaagctaaaaagatcaatgcatctagaaagcctggtgtgaaataaataagtgttcaataacttgtagggtttgttcattattgagaaaatccaactaataagcttaaagtgaggccctcagaggctgaggtggagtcagccacaccttgggaagggctgggtgccactgaggggccttcggcctctagtctctatggggcagaacccatgcttggctggggaatgggttccctcgtcactcttgggtgtgttgggagccccctgtgtggacagtaagaacatcgtgttggcctctgccaagccagcacaggccctgcatgcctgagcacrggcaccgtccctccagggcaaacacgtggtgttgcrgggaatggaggaggggggagttcatgctttgctttaaaaaataaataaataaatgcaggctggtgcagtggctcacgcctgtaatcccagcaatttgggaggccgaggcaggtgggtcatttgaggtcaggagttcgagaccaacctggccaacgtggtgaaaccctgtctctactaaaaatacaaaaaaacaagccgggcgtggtgttgggcgtctatagtcccagctactcaggaggctaaggcaggagaatcgcttgaacccaggaggcagaggttgcagtgagccaagatcgtgccactgcactccagcctggtgacagagcgagatcctgtctcaaaaaaaaatttttttttttttttttttttttttttttagtatttttgggcctgttatcattatttttggccaagcctggctgggtgcagtgtttagatgcaagttcaaatcctgtgcgagcatagactttggcttgatttctagtaggcgtgagctggacaaggactttcatccttgtcttgttctaggaattgggggtgggaggctaccagggctacccttgcctgtccccaggcagagcactsggcacctggggagtagggggaggggttcttgagcagagagaggacccccccgccccaccctggctgtaagcaccttgacccaccctaaccacatcaggtccctggctgcatccgcatcttggactcagcctgtgggagggaggcctgcgccaggccccrggaagtggggccctggaaggtggggtccagagatggggatcctaggagtgcgggccccgggagcccagctgaccatctcttccttgcctctgcagtatcaggtggcccctgcccagctggtgacccggcagctgcaggtctcggtgtggcatctgggcacgctggcccrgagagtgtttcttggagaagtgatcattyctctggccacgtgggactttgaagacagcacaacacagtccttccgctggcatccgctccgggccaaggtgatgtctggttttggactgagtgccctccatccccactgtgatagataaataacttttcagagagatcccagaagagaaaacgtacctggcaagacttggacccaagactgtgtgttcgccggcctggcgctgtgactttgaaatagttactttcttgtgggtggggtgggcggaggrtttgttttaactrgctcagctctgttcaggtacccgaacagcccccgcctcagcatcatacacagaccagactggatcaggtcctgtggcttcccctggcggaggcctccctttgctggtggctgacctgctggaagctggccatgcctttccctgggggcaccgcccgcagctatgcggtcccccagggggctacagtgtgttgtttctaacctttcaaccccaggcactctcaataataggtgacaataactaacagtaataggtgacaaatggctggacccgatgctgtgaggaaggcagaggccgccctggctaggatgtggggctccagctcctggtttggaattgcacggcgggagatagatagcacgtgggctgggggtgggtcagaggagctgatggactccatttaggatccgtgtcccccaggctatgcaggtaggaggagaggcctgggagagaggttagcatttctcggagacgctgctttgtactttgctgtgtccagatcccggactgggagagagttcatgtgagaccacgagggatgaaaaacgtgggcttctgccatctctttaaaaaccccagtggggagcctggacacggtggctcttgactgtaatcccagcactttgggaggccgaggcgggcagatcacaaggtcaggagattgagaccatcctggctaacacagtgaaaccccgtctctctaaaaatacaaaaattagctgggtgtggtggtgcacgcctgtagtcccagctgctctggaggctgaggcagaagaatcacttgaacctgggaggcagaggttgcaatgagtcgagattgcaccactgcacttcagcctggcaacagagcgagactctgtctcaaaaaaaaaaaaaaaacccagcgggatggactactcccctcagccaagggcccacggcaggcccagccttctgctccgacctggacataaggcacaagggccatctggcttcttttcctctccggagccagcgcagctgggattcgcattatctctgcctggaagcttctcaggtttcagctgaggcctcctggtgagccacctgccccctccctgctcctccaggcaatgcccactctcccactgcctgtgctgactcccccaagctagagtccgggcttagacctccccttcccagtgcctacctggaatgcatcccctatccaaggtcagcccaagacgacccaaaacccacctcctccaggaagccattcctgattacccctaccagaagtggcctcccttccaggacccggagctcaggacgcctgccatctcggcctgatctttagcctcagtgtccctttgctcctgccccagccacgttgcgggtgggtgaagcatctggcttccatgccttccgtgccttcctctcacccccgctctgtcatctctcagaacagcattggctcctccgggacgccctgagtttccagcctgaactccttctgtccgaggctgaatcccccgtgcaccctgcctctcccacacctctgtcatcagctcgaagacaaggcctggaacaagcacagggcttggcataggacaggcggccaccaggcmtcatcagactgagcctgctctggcaagtgggtgaggagcaggtggcacagagctgcaggtggyacagagctgcaggtggcacagagctgcaaggcatccctcctaaagccagtagggtggggagtccgcccacagacccgcccctgggctctgttcygcctcggtttctggccgctgaggctggaggcagccatacctcatttggcacccgagggccaggaagacgggctggcccacgcgggctcccaggagtcctgaggcctctgagggtaactgagagggctgcttctcagtgctggcaggagccatggtggaccggatgtgtcaagaccaaacttgtccaacctgcagcccgggacggctctgttttttggttgttgttgtttattttgagacggagttttgctctgtcgtccaggctggagtgaagtggcgtgatcttggctcactgcaacctctgtcccctgggttcaagtgattctctgcctcagcctccctagtagctgggattataggcgcccgtcaccacaccyggctaatttttttgtatttttggtagacatggggtttcaccatgttggccaggctggtctcgaactcctgacctcaggtgatcccaccttggcctcccaaagtgctgggattacaggcatgagtcaccatgcttggcctcaggatggcattgaatgcaacccaacacaaattcataaactttcttaaaacatgagtttttttgtgattttttttttaagctcatcagctgttgttagtgtattttatgtgtggcccaagacaattcttccagtgtggcccagggaagccaaaagactggacacaccctgctctagactcttcccaatactctcctcccaccccactgggagaaggatggtgtggatttcaggctcatctctttcccggccctctcttcactcactttctggtaaaaccactcatgacagaagtgcctcggtgggcagggaggtgtcctcagactcaccacaccctgaggggccaccccctgtggctctggacagagactacaccccatgctgtccccagtgtctgtgccagtccttggcatggaagggcagcgtgaatctctactgacctgggtggggtggatggggtggaggcttgagttcatttctgtttttcaaactcaggctgtgtctgggttttcgtagaaatgtcttagggagtgtgcagtgcccttgagtcccttcacttcctcaggctcatctggctctggttcgctggggtggccaagctgttcctccccatgctggggttggggagggtgggagtgaaaccatagatggaaggaagaccagtcctgccacggacacacctgctccacccagggccttgcaggggccagggggaagcatctgtggacgaagctgagacaaccagaggaacccagaaggttcttgggacttggggaatcctgtccctaagctctgcctcttgtccccaggcggagaaatacgaagacagcgttcctcagagtaatggagagctcacagtccgggctaagctggttctcccttcacggcccagaaaactccaagaggctcaagaaggtcagtggcctccagctccctggacattgtctgtgtcattgtctgcagagcctggtgctgcaggcagactgaggtggggtgaaagttttctagcatttcctttctacrtccccgtgcccagctccagcagctcttctttctgagccatgcagcgagcccgggagaggttctctggagcccgtagtgggggaaacgggtgaccagaagcagacaaggcctctgatgccctctctacgctcctctaaggacactgccctaggccttcctcccaggggcagattggatggtctctggggaaaccgtggcccctcctgaagagcagaggctccatgacaatgtggagccaagagcactggtacctgcagggctcagacgagataaatccccgcccccaggcatgtgggtagctgctgcccagcaaaagaagtaggtcaggagggagggtcctcagggaccctatggagattttactccttcaataacgtggggcgtgtggaaagcaggagggtggaggaggaggagggcggggaaggaggactgggagaatgcacatttcttttttttttttttttttttttttgagacagagttttgctctgtcacccaggctggagtgcagtggcccgatcttggctcactgcaagcttcgcctccctgattcatgccattctcctgcctcagcctcccgagtacctgggactacaggcacctgccaccatgcccggctaattttttgttttttttctttaagtagagacagggtttcaccatgttagccaggatggtctcgatctcctgacctcatgatccgcccaccttggcytyccaaagtgctgggattacaggcgtgagccaccacgcccggcccagaatgcacatttctgttgtgtattttgctgactccctatttggctagaagaggaaattctgctacccaagttcacggggtcaccagcagaccagcagcaagtgccccatggccatcccaacctcctagacagggtctcggggctctcactttcccccaaacttctggctacaactagactcaaacttcggcatcttccctctccttgcgttcctctttactctttkctaggatcttastaatccctccatcctgtcctccacctgaccacagagcggcacggygtgggcagcgccacagcctgtgggcagggccagcagagcccactgcaccactcccatctgctctctcggggtctgagggctgtagcagattctctagctgagctctcggttttggggtggtggtactgcatactaacgtatcaggagacatggtttgacagtgaatactggctttccttccagggacaratcagccatcacttcatggtcaactttgtttggtagtgctaggagccaagaatttacctgtgcggccagatggcaccttgaactcatttgttaaggggtaggtattcgatgtaatcaaatatttattggtgatctagtatacatcacaacatggcccagaacctgcagcgaacactaaaaaacgtaagccacttaaaacgtcttattttagctttcctatgaaaatctaacaacacayattaaagaccctgatttccaaaaattcacgggatgtgtacatgctggagtactcgaaaccctaatcttctcagttctgtgatatcaggaagccagttttgaaatcaagcatgaaaatgtggtgtggtcagtaaatatttcctaagcttaacatctcctcttggaccaacagtaaaacgcatgactgtccacatttcattctcattcagtayaggtgcattggcccctctaaaagtaaggcaaataccattattacattgaattgcaaactccccgtcagtgacatagggaaaaatgacggtcaagatagaactcaggctggacgcagtggctcgtgcctgtaatcccagcactttgggaggctgaggcaggtggatcacctgaggtcaggagttcaaaactagcctggccaacatgatgaaaccccatctctactaaaaatacaaaaattagctgggtgtggtggcgggcacctataatcctagctgctctggaggctgagataggagtcttccttgaacttggggggaggaggttgcagtgagctgagatggtgccacttcactccagcctgggcgacagaacaaaactccgtctcaaaaaaaggagaactgagcttatgttctaatcttgttgcttatctgcatggccttggacaagcttgtctgagytgattttcctgagaacagggttaaaaggagataacgtgtatctgcagtcatggtgggaggcaccccaaggaggaaagattaagatgagggccacgaggcctcagcatgcagctcgcccttcatacctgatgcagaattcggccctaagggaaatgtgccgagtcctgtggttcccaccctgcttcactggggagggtgtggatgttgtggacttggcacttttcttagtgcttcccgtctgcactgacgcacaggcctcaggagagaaggccgtgtggatggcaatgattgcagggtttgtgttccctcttcagctgtctcactctgccagaccaacaaaaactgagactgaagtcgccagtcctgaggaagcaggcttgccccyagtggaaacactcatttgtcttcagtggcrtaaccccagctcagctgaggcagtcragcttggagttaactgtctgggatcaggccctctttggaatgaaygaccgcttgcttggaggaaccagacttggttcaagtaagtctgagacattgagcccaaacgtttatactttgtgattatcctaatgggtaccgtgcaaagaaaatgcttccaccagggcagtgacttawctggttttgaaattgcctagcctgccttaattggaaatgcytaagyctagtttttactctacagctgagccataatacagccaagtattttgacaatttaaatcagatttagatctgctaaagaaacaaaaattataggcctccaaacgggctaggtacagtatttgcttttgtttctggcgtcaatcataaaaggattattttcttaaatgaaaatatcttcttaaacaaatggcaattcagaaagtacttcatcaaaagtggtcagaacagcagtgctgtccagagccgctcggcagggcaccgccggcatggtaggtggacagccctctgctgtgaggttctgtgcctggcactgcttctggctgccagcagtgtccctgacatgatgacaaccaaaaacacctgcacacatctccaaggacctccaactgagaaccagtgactgaagagaaataagcttcactgctccattgcttttcaaagatattttgtccaaagcatactgtcttcctctaagaatcccttcccatgggcaagcccagcccccagtctgagacggccccacccagctagccatgctggtgtgcaactatccactcccttggtgaagacccagcccaccaaaccagagtcctcgcctcactttcaaactayagaactccaggctgttagagcctcgcagagcagaggatgcctgcgtgaatcccagtctcaacaccagctttgttggggtgggagtggtggyggcggcgtctgtcatcagtggttggccttttaatgtggacytraggtgaaaaacttctggctggtcatcatttttaaagggatgagaggggatgaagtggtgccctccccgaccatggctaaattgtcttcctctcttacagagggagacacagctgttggcggggatgcatgctcacwatcgaagctccagtggcagaaagtcctttccagccccaatctatggacagacatgactcttgtcctgcactgacatgaaggcctcaaggttccaggttgcagcaggcgtgaggcactgtgcgtctgcagaggggctacgaaccaggtgcagggtcccagctggagacccctttgaccttgagcagtctccatctgcggccctgtcccatggcttaaccgcctattggtatctgtgtatatttacgttaaacacaattatgttacctaagcctctggtgggttatctcctctttgagatgtagaaaatggccagattttaataaacgttgttacccatgtcctccagtgcttatcaaatgaggtaaaaggccggctggtgggcatggtaactcccccctgtaatcccagcaactttgggaggctgcagtggatggcttgagctcagaagtgtgagatcagcccaggcaacatagataccctgtctacaaaaaaaccaaaaaattatccaggtgtggtggtacacacctgtagtcccagttactcaggaggctgaaccgggaggattgagcccaggaggttgaggctgcagtaagccccgatcatgcaactgtgctccagcctgggccaaagtaagaccctgtctcaaggcgggggggggagtcacagcttcgctgtgagaagcactttattttttgagacggagtctccccgtcaccaggctggagtgcagtggcacgatcttggcttgctgcaagctccgcctcccgggttctagcaattctcctgccccagcctcccaagtagctgggattataggtatgcaccaccacaccaggctaattttcgtatttttagtaaagatggggtttcaccatgttggccaggatggtctcgatctcctgacctcgtgatccgaccacctcggcctcccaaagtgctgggattacaggtgtgagccactgtgcccggctatgaggagcattttagaggagcctgatgagtgttggagcagtctttctctcctgtggaaaccatctcgaggaggttaggtgacccatggagcaccatgtcttgggttggtcagctccaacttaccagtgtacccccagggacaccacggcccctcacraaacctggccagaggacagcatagagcccagacgagtcggcggtagccctcccaccccacacacaagcacacacccgtgctgcttcgtgcctttgcaaagcttttatttcatgtctgcggcatggaatccacctgcacatggcatcttagctgtgaaggaraaagcagtgcacgaraaggaatgagtgggcggaaccaacggcctccacaagctgccttccagcagcctgccaaggccatggcagagagagactgcaaacaaacacaagcaaacagagtctcttcacagctggagtctgaaagctcatagtggcatgtgtgaatctgacaaaattaaaagtgtgcatagtccattacatgcataaaacactaataataatcctgtttacacgtgactgcagcaggcaggtccagctccaccactgccctcctgccacatcacatcaagtgccatggtttagagggtttttcatatgtaattcttttattctgtaaaaggtaacaaaatatacagaacaaaactttccctttttaaaactaatgttacaaatctgtattatcacttgtatataaatagtatatagctgatcattaataaggtgtataagtacaatgtattctaaaactgttaagccaaaaaaaaaaraactaaaaaaawatccaagtgtcctcctccaccactcacgctggtgatcactgtgctctctgccagctgcgtggagtgacgggaggagggaatcactgtgtgtgcgagagtgcttcagactcaatttccaaaataattttcacccctctaagcatgtaaatatacaaagatggatccttcatagaaattaaaaaatcaatttgagctcatttcgaatacagaacaagtatggcacagatggaagtcctgccacgtttcctttaatgatgctgactcttgtatcacacaggccagcatgaagtttcttactcagactttacaggcattttccgtaattcaatcagtcctgctcccagcacaacacaggaggtgattcgagaataatcgcgagaatcaggcctgcttggcactattacaactggggaaaacaaaccagggcgcctccctggttcccagcccagaatgtttctgytgggtaactgctttctaaaggaactgggatctgagggagttcctagacttggagcactaaagacaagcgtggcggggctggcagcgcccgctatgagcacccctctgcccttggtcctggcctggctgttacagggcctcgaactcgtcgatgcgctgcttggtgttgccctgccggatctgccgcagcgtcttgtacttgtcccggccttgcctcatgttctcgttgtggatgatgtcattgtgggtcctcttattctcatctcgggcctgggacagctcgctgctcagcgtctgtaacattaagcagcgttggtctagtcccttcctccccatatggcccggcccgtcccctaggaaaacaggaagggcaagaggggtgctgggtggggctggctcacatcactgccctccccaagcctgtctgctccaaaagcgaggcaggctccctggagacagagccccttgggcctcaccagcagctgccgctgcacacgctcgttcttctctgcctcagtgatgcgcttctcctcattgcggtcatcccggatgccctcactagacagctccgcgctgtagcccgtgggctctgcgccctcatcctgcaagctctcctggacatggtagctcaccggctcgtacacggggggtggtgggggcgggggtgctgtcatcaccaggtgcagctcctccttggtcttcaccaggtcatcctgggcttctttggcctttggaaagcaaattaataagaggacttctcacccagaagtcctatcctcctggctatgagaacagactgtcacctccctctgtcctggcaggctaaggcagcactgaactgtgctgggctgtggcttcgaagaggagcaccctcagggtgcatggggggtttacaaccctctgcgtccaagacaggaagaggaactgtgatgccggaacctgggcagttttaaaactaccatttctttttttacctgtaactctagacattatataatttttagaaaaaaaatcctgttagcatgagtaacgggctctgttcctagcctcccttcatgccacagtcattatcaagtgctctcctgctcgccacttgcagtccttccaacagcttcacacacacccagtcccgcccgcctccatcccagccagccctagagttgagcttagtgtggatctgctttgtagccagctctcctcacttaacaggtactttctccaaaaacctaagaaccaaagtcttccgcttgcaacttgggatggtgatatggctgtgtccccacccaaatctcatctccacctgtaatccccccatgctgggggtggggggcattacctggtgggaggtgactggattacggggtggtttcccctatgctgttctcgtgctagtgggtgggttctgagcaagagctgatggtttcagtgtttggcattacccccctttgcttttctctcttctgccctcatgtaagaggtgcctgcttccccttcgccttctgccacgattgtaaatttcctgaggcctcccccagccatgtgggactgtgagtcaattaaacctcttttctttaactacccagtctcagcttgttctttatagccgtgtgagaacagcctaatacagatcggcagcgggaatgggggctggaacagaggcaaggaggtactaggcagcagcagccctggagagccgggagacacgtccccagaaggcacctccacagatggagaagccacagtgggggaaggacgggccagcgggtctgtgaaggagaggagctgcttaaagcctggtgtgcagtctccagtgggaaccatccccagagcttctcaggggctgtgccttcctggagggcacaggggatcccagacggagcgacaagctctgtgtgcgtcccacaatgagagctacagctgactaaacctctgtgctaggtcctgggcatgggacctcgcatctgcagagcaaccttatgagttgggtattgcccccattctacaatgaggaaaatgaggcttgaagaagtgatgctactagcccccaaatagctgatgagcagcagagcccagctctcactccagcctggagacgtccaaggagctggatctttccatggtgcccgctgtatatactagctgcaggaggtcgtgtttcaggcactgcgaccccattgcaaggggcacatatataattagatttaaaaccagttcctgaccgggggctgtcagatcagcactgaacagttcggggtggagggagcaaagtgggtgaaagtcaatcagaggtcctccctctatgaatccagcagctgcactgactcgtgtacaaagtcaaacccatctctttggggatgtctacttcaatagtacagctggtattggcagaggatcatgagacatcccagaagcttccagtgggatgtggcagcttgagccagacctctcccccaacccacccacctgcagaagggccccaccgcaggcaattgggcaacaggtgctgtggccgtgcggaggtgtcccccgtgcagactcaccctgtgctgccactcttcaacttcatcctccttgcgcctccgcgcctcttccaggagggcaatcttggcagtgtattctgcaagctccgcagcctgggaagggaatgccaagctcacgtcagttctgatatcctttcaacggagtccagttgtgaatgagtgttcatgtgtgttggcaagcagtctccaacgtgacacctgagtccccgccacccccactccatggccagcagggtccattgtgcacccccggcatctcttcctggatgcccacacccaccttcaatgggtgaccctggcaacagcccagccccttccccaccagctgccttcagccccccagcagatcagtttacagcttccagtcatgacaattattacaaggcaggtgtcacattttccatcctcagaagcagcctctctataattcagcatcttgaaactcaggccattcctaccagctgctcctggctctttatctgatccaccgcctgtctctccagctcctccttagcccgcagtgcagccatacggtcagcctctaggcgctcggcctcctcctgtgcccgcttcctctcctcctccagctgcagggccctctgaatctgctccgagagctctgcaaagacacaaagccagagccattcaaaccctcagcccagggacctaggagccctcgctttccattcccacccccaaagccacagagccctagaccaagtcacaggttgaggggatgtcttccagtgaccctggaggaaagcacttcacagagctcattgctgctgtatccatgacaacttcctcaagatggctagaaacccgtccaacgccagccaggcgccctctctctggcatgcctgactcaaccctcttggcgctactctccccaggtcagccgcccgctgtgctggtggtccacactccactcagaacacagaacacccttcccatgtgtgctgtaagggctgccagtgaatacagcatctgtggcgccttgtgtaatcggcccagctgctggggttgttgactggagctgtgctgggaagtctggctctgaacacgcctttgggttttagtctagaggtcgagggcagtgcagcatggccctgtcagtcatgggctgggggactgtgggcaaatcactgtaccgcaccaaaccttactgtcctcatcggggaaactgggtgattgagcacttaccgcaaaagactagggaaattttaaaatacaaagtcttagaacaactagcatcaaagttaaataagtacagaactgttttccaaaccaaataaccattttatcatttcggctgtgagtctgcgctgtgggacacgttcttggtttccttcctggtgagtgggtgggtgggtgtggcccctgctactctgtggaaatgcatgacccagtgtagagtgccagccccagggcgcctgacctctctctgccttctttgtcttctcctcatagtcctgcagccgcagcatcaactcctccttctcgcgcatcatctgctctttctctctctccacggtttctctccttttcttctctgtttccagctgttgcctggtgcagggaaaaagaggcacagggagatttagactctggcaggaaagtgaggggtcaacacacttcacgggtacttgaagctccaggatggacttggtatcctgagggccaccctggcctgctgccagcctgagctgcctgacggagcagccgctccagggctgacaacaggctcagcaccacagcaaccgcccagagacaaaggcctcgaagatcccagcgtggtgactgggttccattccaccacactctccccatcagctccacagtcacctgacaggcactggggctgccagtggctgagttgggagaacacaggccccccccactctggcctcacgcgctcaccgctccagctgcttctgatgcttctcctcccgggcctgggccttcatctgctgcacctcgatggtgtcaggcttcctgcggcgcatatacaactcatggttgcccatgcagagctgcaggatccgcttgttgattctcagacgtggggcataaaacacaaagtcctacaaaacagaacagggccacctggactcaagctccttcgtttggttttcttctccaaaccatccttcacaaaggtccagaacttttctaaaagaacaaatgtagcagaacagggatggcagcatctcggcactaggaatgtgcattctccaggacagatggaggaagggcacgtgccgcgtgtgtgtgcggttatgtgtgggtatgtagcactgggaaagtgcattctctgggacgggtggaggaagggcaggtgccgcgtgtgtgtgcagttgtgtgtgggtagggacatcctgcatgcacactgaaatgccactgcacgttaactgcaaagcttttccaaggtgagaactctcagccttgggaaacctttcaagtctcagagctgcctgctcttccaggtagccacctttcatgatgtcctctccagcctcactgctgctccccatccccgatgcttgcctggactgcctctgcttctatttgggcttcctgtctcctctgccacagcctcccctcccacactgttattgctacactgactgggtcaccaccccgacccatcactgccagcctgggagctccaggatgagctccagggcctgggcccaacccacacagagaccttccagctctgggcccagcctccgctgtgcactcggttctctctcctcaaagctatccagccctgctcctgccacaccagctacaggtactcgccgcagtggcactgtcacttcactccagtgactcctttcagcatctcactcctatgaggccatcagctcccaagggcaggggccacacattcactcatctcttatcttcccagggtatttgaggtgtgcagtacctgccaggcactgccagctcgtgcagcacagacagccacgtgcgagctccacagccttgagcacatcccttcaccaggctcagtgccttcaaccataaggcagggatgccggtatctcaagggacttcagatatgggactcaatcctcccagcagtcccattagatgctggcgtccccgccttatcggtgacgttcaggaggtgctcggcgcaggaagagctggctgacacacacagcggtcactccaattgctagtgccttgcaagaccacaaccagaggagcctcctggaaaacaaggcagaatcacagccttcgggaaactcgtgaccatgactggaaacatttgggacacagctgacaatcttggtcccaactccttgctactgctgtgattagcttacaagacagaagaatatggtttagaaactcccatgaaaagttatttttcagtgactctgttggcttcctcttaacctcagggcccccagcatccagcttctgaccatttggaacagagggacagggtggctaaaacaaaaaaacagtgcgatatatcccacagcaacttctgagacctaac

SEQ ID NO: 12235 - DNA, 65481 bp, Homo sapiens
  misc_feature (1)...(65481): n = A,T,C or G, or insertion/deletion polymorphism (see Tables 1-2)
caaggcgggcagattgcttgagctcatgagttcgaggccagcctgggcaacatggcaaaaccttgtgtctacaaataatacaaaaattagctggtggtggcgcatgcctgtagtcctagttacttgagaggctgaggtgggaggttggcttgagcccagcaggctgaagttgcagtgagcccagactgtgctgctgcactccaggctgggtgacagagccagaccttgtctcaaaaacaaaagggggcaagtgtgggtgggggaacaaaacaatgatcaaggataagaaatcataataggctgggccggtggctcacgcctgtaatcctagcgctttgggaggctgaggtgggtggatcacctgaggttgggagttcaagacccgcctgaccaacatggagaaacccccgtctctactaaaaaaaaagaaaagaaatcataataaagaaagctgtcctatttgggagtttattagtcaaacaggttgtgtgatcatcagtacttgttcttttttttttttttttttttttttttggtagagacagggtgtccttctgttgaccaggctgctctcaaactcctgggcttaagtgatcctcccacctctgcatcccaaactgttggaattacaggtttgagccattgtgcccagccactagttctcttttacacagaagttattaaggatatttgtgcaaattattaaataagccaaggaaacaattaaaatagaacagttagtggccagaattcttcttagcagacccaaattatgtaagttgtgccatcaaaacagtaccaagacactcttcaaaacagtaccaagacactcttcaaaacagtaccaagacactcttcctagcttagtatactataaagatccttaaacattttttttttttaaattgagacagagtcttgctctgtcatccagactggagcgcaatggtgccatctcagctcactgcaacctccacctcctgggttcaagggattctcgtgcctcagcctcccaagtagctgggattacaggcacgtgccaccacactcagttgattttgtattttgagtagagatggggtttcactatgttggccgggctggtcttgaattcctgacctcaggtgatctgtcctccttggtctcccaaagtgctgggattacaggcgtgagccactgagcctggccttaaatattccttctgaatacaacgtatttggactccaccgaacggccayttatcagcttgtctgagtccttagttgttcctgtgcttgctcacccactctgaaaggattggtcacccttcccaaagtcaaaaaggaatgttagatgatattaggaatttgcatgccaagttcatagaactttatgattccatgaaatgtttctctgtagctatcatctcagccaatgaaatgcttactgtcttttttttttcttaaataaacatttcaggccaggtacagtggctcccacctgtaattccgacactttgggaggctgaggtgggtggatcacctgaggagttcaagaccggcctgggtaacatggtgaaaccccatccctacaaaaaatacaaaaactagcccagtgtggtggcgtcgcctatagtcccagctacttgggtgaggtgtggggatctcttgagcctgggaggtggaggttgcagtgagcagagatcacaccactgcactccagcctgggtgacagagtgagatcctgtctcaaaaataaataaaatacaataaaataaaaatttcagaccaataaagaggtaggaaggaggctataaaggaaacccgtggactaccaggcaccttagtcaagtattaccaagacagtggaaacctctatgcttctctcactgtgtcatcgccctatcctccagatttagtcaccgtcttgcattttcccccaaggttattaagggtggaaaataaccccaatccttgttttgccaagagtactctttatgtatttccccactgcctactgactgttcttttgaagtgactacagctagatagagctttggtcacttttttgttactggttgagattaacccggcaccagtgtggagacaggctccaaggtgatttgatagaaatctcctgtatcagtggatgtgactgttctgggtacaatggttctagtccgtgacactgttctgagcttccgggagggctgcccttcctcactttagttttaaccttgtctgaagaactcccaggaaattaccaacagcccttcaccaggctcaagaggcagacttaggattacccttctctagctgaaaaactggaaaatggaaacccggcaatgaagggtcattcaaggtcttatacctaaactaacagcagggaagtttccagtagtcctggctccagtgtttcctcacttccttccaaggcactgagtatcatatattaacaaaaggatgactttcaaacacaaggaacagcttcacaaatgagggctaaaaggagaggcaagtgaaatatgcgtcaaggtcctgccacatcctaagtcagttgttctcaaattgtggtgtacatcatcaaaaccacgtggggacttgttaaagaaacagattcccaggggctgcctgagacttagtcttagtgagccataagtcctggagaagggcactatgagtgattctaatgcatattcaagtttcaacacagctggagttgagtcttctgtgtgtgtgctgggggcaggggtttaggttccaaaccctgatgaaaataaattacccttagaaaatcttaaaacattcataagatacactgtaagtgtttccttggtgggcagaacagtacagtaacatgtaaatgctatgtgtcatacttacagtaatgtaagatacatgataaggaatgcatgtacaaatatgackttatactattttaacttatgtaagaaagattatatagcatccctctgtatccacaggggattggttccaagacctctgaggataccaaaattctccaatgatcaagttcctgacataaaagggtacagtatttgcatataatgtacaaaatcctcctgtatatcttaaatcatctccagattacttataatatgtaatataatgtaaatacttgttatactatattctgtattggatttttattggtattttaattgtagtattatttttattttttattttccaaatcttttccatccaaggttggctgattccatgaatgtagaacctacaaatacagagggctaattgtacataaaagttgagtgagtcaaatgctcatatgatatgattcagtgacacaagaataccatgaaatacatattatcctttccattttacagatgaagagatggatgctcagtcaggttgacagacttgcccgaacggaccaggttggtcagtttgcaggaagcagaattcagacttagctctgtttgcctcaaaaacctgccatcgtttcatttttattttattttatttattttttgagacagagtttcgctgttgttgcccaggctagaatgcaatggtgcgatctcagctcactgcaacctctgcctcacggttggtttcaagtgattctcctgcctcaggctcccgagtagctggggttacaggcgtgcaccaccatgcccatctaattttttgtatttttagtagagatggggtttccccacgttggccaggctggtctcgaactcctgacctcaggtgatctgctcgcctcagcctcccaaagtgctgggattacaggcttgaatcatcgcacctggccgtttcatttttaccacactgccacaggccacttcattttttggcattcccctaaagggtmaagttcagaaatgctcttcaaggtcttggggcaccgctatttcaaacattcaatttagaagacagtatacttcaaatggagcgagataaaaattagattagaggcatatcctattatgagagttgggaacccaaactggctaaccaggctccaggcagtgataaggcagtggaggtattgatgtccagttggaaacattatcagtgcaggtaatttaaatatctttcatagttttctttctactgcagttaccattatatcttcattttatttatttatttatttatttttgagacggagtttcactcttgttgcccaggctggagtgcaatggtgcgatcttagctcactgcaagctctgcctcccgggttcacaccattctcctgcctcagcttcccgagtagctgggactacaggcgtgcgccaccacacccagctaattctgtatttttagtagagacggggtttctccatgttggtcaggctggtcttgaactcctgacctcaggtgttccacctgcctcggcctcccaaagtgctgggattacaggcatgagccacagcgcccggcctataacttcattttaataaaaaagaaattcaggccaggagtgatggctcacgcctgtaatcctagcactttgggaggccgaggtgagcagatcacctgaggtcaggagttcaaaaccagcctggccaacatggtgaaaccccgtctctactaaaaatacaaaaatttagctgggcttggtggcgggtgtctgtaatcccagctactcaagaggctgaggcaggagaattgcttgaacctgggagatggaggttgcaatgagctgagattgcgccaatgcactccagcctgggcaagaagagcaaaactccgtctaaaaaaaaaagggaaagaaaagttcagtctttcagagggaatacacttacctgaatagaggtcaaaatctcagaagaggcctccctcctctctctgacctctgaaatgccctggatctgcaagtgggagataacaggccctgacaaagggttgcccaaacagcagtgtgtccctaggaagacaggttaagcatcaattactatgaggctagcacgagttaagcattccrcatgcacgatctcatttaatccttacaagtctatgtaggtggggctactagtatgttcactcaacaaattgggaaacagagtttggaacttcgcccaaagtcattggtttctctttctaccaggatagatttaagtgcttactaagtgtcaggtactgttcaggcatcgtacatgtactaactcattatcctcattagaaccctctgatacaggtgccataattatgccgctttacaaacaagaaaactaaaagcagaaagggaggagtaaacccaggagaggaattcaggagaagctctggtctcaacctttagccaacatcacaatcacccgaagggcttgtaacacactgattgctgggctcagccctagagtttctgaatcctaaggctgagcaacacctaatttccacttatgcaagttcccagtgaatgctgttgctgctcgtctggaagccagacgttgagaaccccttctagagtgagctctcccgcagcaaattctactggcccccaaagtatgtgttttgtgtgtcttaaaaatttgttgagaaccattagcaaaaaaacaaacaaaaaaacttaattcctagaatttcagagaaatcccatggagctttttgccagtcacgtcaaaagaggccacaaacgtgccacttaaccagagcttcggaaaggcggcggctgggccggccacgtgcaccgagactcggggccaggtgcagccgccccagggccgaggcctcggaactggcccccggtcccggccccaagcggtccagcgattcccccaagccgtccgcccctccagatttatttacgttttcctgacttccccctgcccgctgtgggacaaacagcctccccacttgcatctgcgaggggagtagcgcgcacttccgccaagttccgcccccacccagcccgaggcccggctgccgccatcttgcggggggcgcacctcacaggtcgggagctgggcgggaaggggcgtggtcccgggacccgccgcgccggggcttttgggagcgcgggcagcgagcgcactcggcggacgcaagggcggcggggagcacacggagcactgcaggcgccgggtgaggcgtgcggcggccggggtcgggacgggggttctgggcggggggttcctggtggagggcccgggcgggcggcggggttcggcggcaggtgcggcgggcagcctagggggcgcggcgcggggttctcgcccggcacccccggggcaggtggagctgagccggcccgcggccccgcgaccttcccctcggcgccgggtcccctcaggtctctcccgaaggaaacgcggagcctgggtgcctgggcgccgtccctcggcggctcccgagcggttgcagtttttgaaagagtttctcaaaggcttgacggttgtgactgcagccgcggggcaacggttgctacacaaagtgaaacttgccgagtgctcggcttctcacgggcttcctggcagccccgggaagttcctcggcggaccccgagcccgcgccccctctccacggatccctccccagcgagtgcccccccgcccgccctgtgccccctctcccctgacccctccctgtcgggtgccccgcgggctcgcgctggctgtcccgggactccttcctcctaggtgttcctcctgcccctcgccctctctctcccaggcgcgcgctccctctccccgggcctttccccgccgggtatccctgggcccgcgccccctcttctccgcctctctccgctgggtgcacctcgagtgtcccccagacccctccccgcccggccggcgctctctcccctgaccctcctggccgagtgttccccggggcccgcgccccctccccccgatcctccccactgagtgttccccctgccctctctctcccgggcctgcgccccccaccagccccttcatgctgggggtcccctgggtgcgcaccccctctcctcggacccacccccaactggggggcacctccagtgcccgccggctgccccttgggcgcgcgcccccgctctcgggcgcctcctcgccgggggcccggcccggccccgccccgcccgtgccccctccccatgcccgcagtgctgggcggggcgctgactcacccgggcccgggctggccggttcttaagcggcagcgcgctgcgggcgccgagtgtcgggcgcggcaggaggacgaggcagggcgggcgggcgctctaagggttctgctctgactccaggttgggacagcgtcttcsctgctgctggatagtcgtgttttcggggatcgaggatactcaccagaaaccgaaaatgccgaaaccagtaagttgcccagtttctgggccgggcggacgggagaggcttcattggagaggggaggcacctgctcgaggtgttggggcagttcctggggaacagggttcttctcacamgcagaagacgataggaataggaggaggttttcgccgctctttgttacttgttgacccttttgtggagcgttaggaaaacaccattttgatgcttttctctgcagtctttttctttgtgagccccctccccagtagttacggtcttttctaaaaactagaggcctttttacactgcttccgtctgtttttaaagggtatagtaatacaacttagaagtttcttaaaaagtccaaatcacagggagactcagatggcttccgaccacacacaccagttctcagagctcctaagggtccgaaaccacaggcgccccagatccaactggggagatattaaarggcgtttgggagaggagactggctttcggaagttgcctttcagcttcgcttcctactaggcccatgaagcggtgccctgtacaccagcaaacttgctggctgcagcagaatttctgtctctaacagaaggttagccatggacttgaattgtagatgcaggcagccggtggagtttgataagaggttcctggcaggccgggccgagcactcctggtcagctgatgaaagggytgtgcctgcgcctctgtctccttgaatctgattgtgttgagattgctggcgagacctgggggttgtaggcacaaggcaggttctctgggactgacgcttcttagaaagttgtatgtattctacctgcttttaacactggggaactggtgactagacattagggggaaggtttaacattttttgagttttgaatcacaatggacaaaatatcaggattcattacaaattgggattacagatacatctggaatttttttttggtttttcaaacaagttggttctgtaatcaatgcttgtgtgccttttgtgggggatgggggagcggagtctctctctgtggcccaggctggagtgcagtggcatgatctcggctcactgcaacctctgcctctcaggttcaagcgaatctcctgcctcagcctcccgagtagttgggattacaggcatgtgccaccatgcccagctggtttttgtatttttatagagagggggtttcaccatgttggccaggctggtctaaaactcctgacctcaggtgatctgcccacctcgacctcccaaaatgctaggattacaggcgtgagccaccacacccggccttgtgtgcttcttctsttacattttatgttctctaagatctttgttagaggtattaattttgctgttaggataaagaatattaatatgccagtagattcagaagccaatataatttttgcctaagttacatcaagatgattcatttgtgatgcagagtattttctatacaaaatttttctttttaattcaaacttaaaagtgacacgtgacatcgaggcttgacagtgcatgtggtatgaaactgacctaagtacaaccccttactcaggcagagctgagtgcaacggtatgcggaggagtggtcaagaagattacccttctgggtgtggttttctttatttcactaaaagaagaggtgcagagctcagctaagatagcactcaggaaaaagttaacctgttctccgtcactacttttctttctcatttctcataatgaatggtaatttatttttatggtttcttttttgtattttggtaaaatatacagtttatcctcttacttttaggtttacatttcaaggtattaagtacatttacattgttacatagccatcaccaaggtccatctccagaactttatcttcccagattgaaactctgtacctattaaactctccctccccatycccaccaccagcccttggcaaccaccattctactttctgtctctatgaattcgacaactttagatacctcatgcaggtggaatcgtgatagcatttgtccttttgtgacagtctcatttcctgtagcataatgtcttcaaggttcatccatgttgcaatgtcagaactcccttctstctcttatttcttatggcaggtatgttttcatttcattttgttttagaggtcttttatgatagatcagaacttaaaagatgtttctgacatttgataaagtgaagatagttgtgaaactgttaaggaaagacagtagccatcaccttgtgtattagagccagagttactctttgaaagactgtattctgtataatatctacaattaaaatttttaaactttttttgaggccaggcgaggtggcctgattacaggcacgagcctgtaatcccagcactttgggaggctgaggcaggcagatcacatgagcccaggagttcgagacttgcctggccaacatagactctgtttctacaaaaaatagaaaaattatctgggtgtggtggctggcgctctgactgaggctgaagtgggaggattgcttgatgagccctggaggtcaaggctgcagtgaactaagatcaagccactgcattccagcctgggcagcagagtgagatgttgtctgaaaacaaacaaaaccccttttttgagaggcttccttttaggtcagccatacctgtctgccatgggaaatttctccctgccccctctttggcagaggagggtcttagagataagttaaacacactaagcctttctgtgtgtagattatattagagccatcccacaaatcactgagaagagcatmgtaggttgcacatatttgaatatgacatttcttaaggctgttagagaggatccagttagttttggtttggtttggggtttttttgctgccttagtaaatgttaaaatgaaacatccaccaacagctctgtggatgtgtcctttaaacaaaggtttattgattctaattattcaagcctaagttaagaatgttagcgaagaatgttaggtggttttcttgggcttaatgtttaacaactggattaaggggcaaacacacttaaaggatggatacctctgagtagttggccttccacctgattcattgcaactgttaacccttgaattcaacgggcaaagtatttttgattgatttgcctgaactgagtgagtggatgactttattcataaaacagtataactgaaaatactcatttcctgtgttttctcctaatactgtttcccaaaagcaacagttacttaaaagactgaggcggtacacagtggctcatggcagtaatcccagcactttgggaggccgaggtgggcggatcacaaggtcaagagatcaagactatcctggtcaacatggtgaaaccccatctctactaaaaatacaaaaattagccgggcgtggtatggatgcctgtagtcccagctacttgggaggctgaggcaggagaatcgcttgaacctgggaggtgaaggttgcagtgagctgagattgcaccactgcactccagcctggcgacagagtgagactctgtctcaaaaaaaaaaaaaaagactttattcatcagcaagcggagtgacctgcacagagggcgaggcagaccttgttctctggaagcttagtgtctggtacctgggccaagatgcggggtaaatgctgaaattgaaaacccgctaagtgctgtcagactgggaaagagcctaggtaacgtcgagaggaaaatctgatggggaaaggaaaatcatctgatggggaaattggcagactgtattgagaagtaacacttmagctgaatcttgcttgasggctggggggcgcacgcggcagcactccacagggaggaacagctgtggtttgttgtctggttttgcttttcccacagctgcttagggactctattcatgtgtgactggctgacgtccaaggagggtgatttggggttccagagggagccttggcctctgttcaggccagtccccaggacatggtgtgctgtgtggccttgtgggtctgccccatctagggagagttgtaggagttggtgctcagatcattggtcccggaagcatcctctctgcccgccccttcatgttagggtgactgcggagcgcctttctcccacacttgctttcttctgcccagtggaaagaaggcatggggagtgagcaaggaacactgctgtagttaagctctggaaggaaaaggggattgtgttcagggctgagatctctttaagctgtcatgagaaccatagagctgaactgcctttaagtggctccaacacatcttacctgttcatttctgaagtgttatagacatttctaatacaaaagcaggtttacctttcattaggaaaactctgaaagtgtgttcacatttctactgtgccaaaattttaaggtaatttctgagattaccttgcctctttgggaatacataaccttttctattaaatattttaacagggacagtttactgaatgtactcccccctcacaatcccctcgcaattgaggaggatgcgtagcatctgtttccacccctcctcctccacgaggggcagtggtgaattaggtagctaacattttgccatgtggcagtgagaggtgctggtaggatgagtgatttgccatgatcacgctgtaaggcacaatgaatgtatttggatgttcacagacacagtccctgtcagtggatttacagtctggtttcggggacagacagcaatcccagagtaaatgtaaaactgcagcttcagagagtatgcctgaagaggggtacatgaggcctgagagtagatgaagtgtgtatgtgctggtgggggtgcaaataggggaggtcaggaaggcatccttgaggacgtgacctccctgggcagaggtaacaacgtgtgcaaaggccctgtggtgggaggaagtagtgtgagtttggggtttcacatgaagcccaatgyggctagagaggaagacaggtcaggccatgccttgtaagccattcttgggtgttttttagtttaacttggggttttgactgggaggtgacatgatcagatttgccttttgaaaagttgactgtgatctgtaataggaaaatcacaggaggcaggagacagcaagggtagttatggtagaccattgagggagctcatagcttggaccaaggtggtggtggtgggaacagaagtggatgcatttgagagttctttgggaggtagaattgatagtgcctggtgatgggttggatatgcagggccaagggtggtgtcgaggctgacttctcgtttctggcttgcgcaagtggatgtgtggtggtgccatcgctgaggtaagtaatcctggagaaggaccaggtgtgggggaaggtggggagtctggatttgttgttacatgttaataagtttgtgacaatcgttgatgaaaaaagtccttgccttctttcattactacatccactgccccccaaaatattaaaggaccagactccttaaactacgttatttttaaatccaaataattcagtagctttttgttttccctagtatatgtacacaccgtacatacctaaagttaagaggaagggttaatttagtgcagtgttctcaaaattttgtgtacacaattgtctggagactgttgattcctgggtcccttgaagaactaatgacttccatctctagggtgaggtgcaggctgggtgcttatgttttaaataagctctccagatggtactgctgattcaataggaaaagggcagttattatatattcctttctcctgcaccccaatcaagcccagtgtgatttcagagcacccatttgggtgaaagcagtcacttgatgcccagccgccttacagtccggctgaaatgccaggagtgctgttattggtatttgggactcgaataggggctaggatgactctgtgaaaaagagccataaaaataagaatttcatagctaatttactgcttacctatacttgggcaggccattcaacataatattcttctgacttgagtttctctctgcagggagtccagtaacagagcttcatttggcagtgcccagtggtctctcacattttggctctttgttttcaaagagaaaaaaagaggctagaccttccctataaatggtagggaagtaagagatcccattccttgttcctcttttctcttttattccttccacactggcctcttttgttaatgaaataatgtgaatttttttttttttttttggaaacagggtctcactctgtcacccaggctggagtgcagtggcacagtcacagctcactgcagcctcagtgccccggcccccacccttggctcaagtgatcttcccacctcagcctcctgggtaactgggaccacaggcacacactaccacacccagctaattttttatttttttgtgaaacaagatctcactgtgtggcccaggcggctagtctcaaattcctgagctcaagctatcctcctaccttggccttccaaaatgttgagattataggtgtgagccaccatgcctggctgataatgtgatttctaacaaatgttgaataattatagtttgggaaaggaaaacagtatcatttagtgaactataatttttttcttaatttttttaacttaaacttttatatctctttgacaatttggagattcttagggtggtttgatatacctgctttctaatggtagttagatgtttcagctctattctgaagcagtgaaattcagtctgctttcaaagtcagtgaatgcattttgaattatcccttatttcatttcagtagtaactaccttgagactccccaagtactccaattagtttttaatttcagcagtaaatgtgtgttgaaaagaccaaagtttgcattattttccttctgatgtatttaccatccatgcctgttgacataaaaagatttttccagacttgggtagttttcagaaccaaacaaaacccttgtgctataatgtgacttagagacttttgactgaaatgcttgatatagttaatacacataatttttttcaaaatgaaaccacaaagagctataaagagaatttcatagctaatttactgcttacctgtatttggggaagccatttagcatctgtgaacctaaatttcatcagccgtaaaatgggagttagtttttaagtggaaagaatgttacataagataaacggagacaaagtttttatcagtgaaatccaaacaactcatcttaagatgctgtaagctttatgtgtttcttttgtgtttccctaccccgcaaatgtttttcaaacttaaccctgttaggtaaaaactctgggttcctataaacgggtaaagtttgtccattggtcttctcaaggaaaaagcaatatgaacagtttgggttatcttagtaaaagggaggactctgattttgtctcatgtccatcctctctctgtgtgttctagtcggaattcccttatcagtcacatgggtaccaccttcatgttttgaagcgctattatatcccattatgtgcttggtgcagggacaataaaaataagattggttttgcctttaaggagttctcagtctcctagtgaaagcagatrtgtaagcaattacaatgcagtgtagtgcatgatagaggtcttcacagaagagaagtgtgccctggagaccagggagggcctcccggctggtaagatcctttgggtaagtgtggagggatgtgggcttcccagtcagcagtggtcagttctgttttcctttattcattaacccgttcttaacacttacaggcaaacagtaatgctgtttcaaaggaaatgtaaaacttcattaagttatccttttaatctaatatacttgaaaacaaaaccttaaaagcaaaataaaaaatatctcaccatgacccaccttttattgataggagaggaaccagtatcacctgaggatcaaactctagtagtcagtatatcagattttgctcatatttttmagttagaagtcacttctgcaacctaattttgttttccatttttgcctgagagatcaattttaaactgcctgtgtggacagttgtcatttcagatactgtaaataattgtttttactttaggatggggtaggtaaactatcatcttagggccgagtctggctgtggcctgtttttatttggtctcccagctaaaaatggtttttatatttttgaaggattttaaaaacaacaatatgcaacggactccaagtaagaccctcaaagcctaaaatacttactggctggctctttagagaaacaaatggaccaactcctgcttctagcataaaaataattattgttaagcatttattmtaaccttgtatatattttatggctggactaatatttggaagcagatccaccccattggttccagtttttaaaaaattgttctcaaagaacagaatgtgttttgttagccartgttgagcacatcatggactctgagcatggactcagaaactactgaggagaggcatcgtggtgctgaggtaatgttttaaacaaagctggtgtttgggtgggtctttgtgtagagaaagtggcagtatcttgtgtcacacttgctaagctattgtgtaatgacagatttctggcatatgctaaaagaaagcaatttgtacctgatgtttgagttggaaagagaatgttatgtaaatgaattgcttttttcctcattgatagtttaaaatgagcttttgatctactatagtctgtatgtgaatttctgactgcagatgttttgtaagtccattcctgattcagaacaccctgtctaaagtacagctccatctctgtctgtgccgtgccccactttactgcactcatagaactcggtctccacctataacgctgtcaggtgcttgtttatttgtgctttttgtcttttctggcagcaaagcaagaggataggtgttgtttttgtgtttttgagatgcggtcttgctctgttgctcaagcacgagtgcagtggtacaatcatagctcaccacagccttgaactcctgggggaccgcaggcgctcactaccacacctgactaatctttttatttttatttctatagagatgaagtttcacactgttttgtgcaggctggtctcaaacacctggcctcaagccatcctcctgcctcagtctctcaaagtgttggcattatagccatgagccactatgcctggcccaagtttgtttgtttgttgtttagcattattattttatagcaaactttaaattcttgtttattggcaggataaatagagggaagaaggacgagcaaataggtaaacatacctgcctcctagtgggtaatcttgggcaagttttttcacctccctctgcctcctcatctgtaaacaagatcctgcgtgcccgcctgggatgcctgctaagatggcacatgggaagcacctggccttatgcctggccctggtcagtaagggctgtgcggttccacttgtacctgataaaattctaatctgattaaaagctttactagctcgtgatggtcattcttttcctctaacttagcagcccgatgaaataatgtagtaagtaaatgtaaccttgttgtttgtccttttgctgccacgatgaacacagctgtcttgctagacctctgttgacttcaacagggatagcatcaggtttattggaaatttacatatgggacagtccagtggtggtgggttggacagaacagcaactgcttcccgaaagcttggaaaaagcatgcagtttacacagcattcttacttaacatactccccctaacagcctccacctggcagccttaaagtgcttgtgggctgggggttcagatgttccccatagataaggaattgatttcagggttggccactaggattccttagctcggaactccacacacrcattcttcttaagttattgatgttaggtacacctgtacaaccaccctgcataaagttcattcattcaacaaatagagcacctactttgtgccaggttttcaggtactggggagacattggtgaacaaaaagaggcttttaaaggattatcacctgcttggttgacagtcacatccagtgaatggtggaacccatttcctgctaatgtgtatttgagcctgaaatgcacattgtcccacctttcctcaatggcaaaatgctctggaaaggagatgctggtctgactaaataaaatgggctttctgtttggagttgtaaagggagccgtgccttcctcagcccctcctgaaagaaagacctgctttcaagaagcttatattgcagggggaaagacacatgtctaatacatygtcagggggtggtgagcgtgctactgtaaattttcacctaggctttggcaagagctagaattaactttcattctttactgactctttgaagcgttaaaaccactgggcagagtgacttaggagtgggcccactgtgatgtgtttttgttggttttctggtaaatcacttttgggttggacagtgaaccatgatggtctttcttcaagaacttgtttttgcaagggtttggtgataagtccatcatttccaaacccacttactcttccatcctttctcaggtgctgtggttcagggaaatgattgttttgatagtattttacctattgcaccattacttcatctgtaaatttcttataaaatatgtcttgggatccagccttgtcttttttgtttgtttgtttttttttttttgagacggagtctctgtctgtcgcccaggctggagtgcagtggtgtgatctggactcaccgcaagctccacctcccgggttcacgccattctcctgcctcagcctcccgagtagctgggactacaggcgccagccatcacactcggctaattttttttgtattttttagtagagacggggtttcaccatgttagccaggacagtcttgatctcctgacctcatgatccgcccgcctcagcctcccaaagtgctgggattacaggcgtgagccactgcgcctggcctgttatgtttttaaagagaaaattgaaccacaggtcacttggttaaagcttagcacataaatatgagattggaatcactttatttgtaaacatatatgtagtgtatattggtacagtattttcattaaggtgtgtttcattgcctcagttaaataattaagggtgttggctgctgggatgttgaagtatttgcttacataatccattgctgtttgggtgagactctyaaatggatttagacagataatggtgagaaaactggattttttatttagaacgtggctgaacaaggcartgtggaaatagtgtgataacaaggtgcattatataacttgaacaaatcaactgcaaaaagacattttcaaagaaatggaggaaaattgaataatatttactgaacttgacgtattaaggaattgttttaaattatgttggatgtgataatggtattgtgatttttttttttagtgctttagagcaatatactgaagtttttacaagtgaaataatgaatgagggccttaaaatatgccagcaaaaaaaaaaaaagtgaaagtggtagagtagaagaaagaatggtgttgaagctgaaaagagagtgtggaggatcatggtactacttattctctctacttttatgaatgttttcaactttccataatagaatatttgcttttaaaaagcatgttatagggtagaaagggagagatgctttacttttgctcgtcatgaagtgcctgagtgttgaggtgggaggatctcagggcgagggcaggtcccccattccctgctgctggggcaacctttgtgctctggatcaaatgagtaactgatttgatctcatcaaatggccccacccgggccatctcaccctccatgcacatgttttaaaaggaggtcactactcaaaattgcagctgacttggaaacacatagaacgatttgttcccagttttttccactattactttgtattcccaatgttttggggggcccataggaatggggcacagtgctgtgacccaactgggaacaggtcattgtcttaatagcgattttctcagacttgaaaattgaaatgaacaaaataaggggcatctactgggtagggctttagccattttaagagatcaatctacatactggggctgtgggcagggatgggggaaggaaatacagcaaaccatgggttggggttggggtgagtgatagggttgtaaaatgtacaccatgtcttttccagtcaagtaatgatgtacaaattataatgccatttcagatgtaacatacttgatactgacagtataaattgaagagtttttttaattttaatttagtataatttcagaaatggtgattttaaaagttttggcagggtttgcttatttaagcaaattttgtaagattactgatttagtttggattttttaaaagaagctactttggtcttgctaatttttgacacatggcaaaagtaaagactggggtgagttcaaatcttgtctaatcgaagtttcttacaggagaaatgttctttaacattgtataatattgctcatgtgatcttaactaggggcaaaaatttatctcagcaatggcacaagacttaagtatggtttatgtcttatgtcctctaaaaaacaggttagcaaagaaatttttcgacctttttttttttttcctgagatggagtctctgtcaccaggctgggagtgcagtggcgccatgtaggctcactgcagcctccgactccctggttcaagcgattctcctgcctcagccccacgagtagctgggattgcaggcacacgccaccatgcccggctaatttttgtatttttagtagagatggtttcaccatgttggccaggatggtcttggtcgcctgacctcgtgatccacccacctcagcctcattgtttcctagactcaccttctcactcccaagatcagaaattggaaatcatcattctcagtaaactatcgcaagaacaaaaaaccaaacaccgcatattctcactcataggtgggaattgaacaatgagatcacatggacacaggaaggggaatatcacactctggggactgttgtggggtggggggaggggggagggatagcatcgggagatatacctaatgctagatgacgagttagtgggtgcagcgcaccagcatggcacatgtatacatatgtaactaacctgcacaatgtgcacatgtaccctaaaacttaaagtataataaaaaaaataaagaaaaaagaaaggaaaaactcttcacaggcttctaaatttgcagagacaaccatgcattccaggtgaatagtgatgtttaatctataggcctttagttccctatsttttctgagcctacaattaaaaccgactctagcatataataagccatcttggccttgtcccttacttttgtttatgtgtgtagttactaagtttactargtagttactaaacttaagtttctgtgtataattacctgcacatttcagtgaagcatgttggtgatgaagtatttatgatatacctagtgaaactgaaatcacatggtatacaatcaagacttagacttcaggagtttattagataaattcttgttcaaggtcmctttctctttattttgcctgccctgaggtaaggagatgagaaggatgtagattgtgtttctagaaagaatagtttcttttgctgaatgtaacatcctttgattatttcttttccctttcttaggggaaagtggtgtctaagaaktccagtttacttccctgttagataacacacaatgtatgttatttccartgtagaagaagttggttcttaattagagacactcaccaaaaagggccttaaaaactagcagctaataggtatcaggagcattattttcatacgccatcagcaggtcggaaatggccatcagtgttactcggcagtgcaggcttggaactcgggcatgactagcagtcatttcattgtcagacctatggaaagcagctcctttctgcctcccagatgcagtggacagtagggagggcttagcacagaactcttcccaacctggttttaaaatgaccctcttttgaatgtgaatgcccagaargttcccttctagttctaaggtcatgattttcttgctgataataatgagcacagatgggactggtttgtccgctttttgtgtttgttaagcagccttggtctgacaggatgtgggtctaggggcaggaagtggcttactctcagaggaaaaaggagagctatttaggatttgagatttcattacatgttcttgaaattatggggtggctattattctggactctctctgtatattttatatattatatatatatatatatatatatatatatatatatatataatgttacataatatttaccctggagttggtaaatacaaacttttcaaaagcataaaaccattggcatctatttaaagatactattttaggagtaatgttaaagagccagagctacacagatattttggtagctgattaccagaagttgagggtctcagtttttgtaaccattaaaaaaaggtcatcagacgaggataaccgtatacctcgtatcgagtactcatttggagtcactctaccagttatacttcatcactattctgattggctacttaaaacatacgtttatataacataaaaatgtaacatcatgtagatacgtgaaaagtcagttactaggaaattcccagcccccacttctgtgtcaatactctgccctgttaacgtctgctgcacattaagaatttagccttgacattttaagtttagcctaatggtggtgctggaggaagtagtaaggagaacagtttagaaaaggaggtgygagtggcatgtagtgttacttttcatcatttaaattactcaraaagttccttaaagtgcttctggcttctctgggaaatgagttcctgcttccctgtggtgtcaggagaatcgcagggtaggagacacggcccctaggatactggacatgggctggatgctgtattcgagggataaaccatgtatggttcttgtgcttaaataagcaaaaacctggccgggcgcggtggctcacacctgtaatcccagcactttgggaggccaaggcgggtggattacgaggtcaggagatcgagaccatctaactaacatggtgaaaccccgtttctactaaaaatacaaaaattagctgggcgtggtggcacatgcctataatcccggctactygggaggctgaggcaggagaatcgcttgaacccgggaggtggaggttgcagtgagccgagattgcgccactgcactccagcctgggcaacaagagtgaaactccgcctcaaaaaacaaacaaaacactaccaccaaaaacctaactagccatagtcaagtagaagtatacaaatattccagaagaactaaactataaggtgtttgtaaatatttagatgtgaatgagtataaacaacgcatcwaaaaatcataaaaattgatatttggtaaattttcctttctgccagacttgctggcagttaaaatttgaaacagtgactgtaccgaaagcctttttattcaggttaaaagttgtactcccatttcctaaaataaggactgaactgagaaactctagctacagctrcttggttttccatagagttaagttggctccttagatgctgaagtctgtagttatgaccttgctttcattagtaattagcacctgggcaggtactaaccaatgaatgccctttacacctggcaagaaggaatgggtggggaggccagattgtttcaatctaaagggcactacgttgtggtgggttacgttttttggtagacagacactgcctacaggcaactaagtcattccattaactgtcattatcaatccatgtgtggccaagcttgaattgtcctgctggtttagcttcctgatggggaacaacagctgtcgcaacgcacagtgtctgcagctccatcatgggccccaggacgtcccacagcagctaacactggtctgtactcggaactctgccacctggccagtgacttttgtgcgtcatgttcctgggaatagtatgactgtccatgattcctaggaaagctagaggaataactgaggatgaggagctagcactttgacccctgtggggagtgctggttatagtggttatcagggttgtgacaagtggactcttgtgagttccaacactggatgattttattattcctattactcaggcagtaaaagactagtacatatcctggtgttatataattatatgaaaacttatcagaatgagttttataactagcgtacccatgtttttgttattgtgctgcagataaaatggcgcactgaaatgttactgaattaygtgacaatttttgttacaattctgtgcactttttacaagatttgtggagcttagatagatggctggcctttggcatctgaacattttcctgagcccgatagacaagcagattttttttgtttgtttttggagacagggttctcatgcctgtaatcccagcaccctgcctagttcaagaccagcctggctggcaacatggtgaaaccccgtctctaccaaaaatacaaaagttagctgggcatggtggtgcacgcctgtaatcccagatactctggagactgaggcaggagaatcgcttgaacccgggaggtggaggctacagtgagccgagattgtgccactgcactccagccttgacagagcgagaccctgtctcaaaaaaaattaaaaagacagggttctgttacccagtgtggtggcgcaagcatggctcactgcaggctcgacctcctaggcccaagtgatcttcccacattggccttccaaagtgctagggttacaggagtgagccactgtgcctggccaagatttctttgcctttgcgctcatgttcttctttaaccttaaaagaagaggtcatataaaataatcaggtataatttaagatacagaaagcttgatagaaaggagtagccgtgttctacatcttcatccattgcatttgcagatatgcctcaggattattttattagtacaatttttttttctttttgagacagtctcactctgtcacccaggctggagtgcagtggtgcaatctcggcacactgcagcctccacctcccaggttcaagcgattgtcctgccttattccctggtgtatctgggattaccaatgtgcaccaccacacccggctaatattttgtatttttagtggagatggggtttcgccatgttggccaggctggtctcgaactgctggtctcaagtgatccacctgcctcagcctcccaaagtggtaggattataggcatgagccaccgtgcccagcctagygtcatgtatttatactgttatttccacctcctaaaagtcaacaaggacacttagctcaagaaggctgatgttgagagagaacgcttatcagaacagggatctctgaggaaaaagggagcttaaatgtgtgtccctggaatttcttctagcccttcctttccttrgtgacatggccactgctatgggcgggaattagagaagagccctgaccagtggtgttgatgtctttgccaagtatactgtcaggtcagtgtcataaattgatgatatatatagagagacttcatttaatagaaaataatattttaaggaccaccttgctattttacttctctaataatgttttgaatattttgataaatacctttagcaacatagtggttctcatctcagccctctctgtccttgaaagaatgttatttataacagggtggtttctggactgcccttctggagtaaaacttgggcattctaaccatatgcttgctggaaaccataataatgtaaaaagtcgtcattgggttttcaattgcaattacattgatataattttgtatataaaacagtrtgttactgggagcagcattgttcatgtaagaaagatgttcgcttcatataatacatggaaacaaagttatattttcaatgttagccattactgtgacactccaaaaaaggctggtyatggggagaaagaagagctttaaaaaaacctacagacaattcacttgcctcttgggcttttctgctttgcctgccttgaccgaattagagtatctgcatttctgcactaagctggttgaggtttgctaagtcaatggtaatgttttacagagcttggctgttagccagcatttgtggaaaacgaccaatgtctgtcatagctartgctataatttattcagttggcatattgtttatggagacagtgagataaggggatyaggatccagagagactattaaaatatgtgagtccatctgttgtgatctgaggtttcattagagaaaacctgtctgctagtacaayaaatggagacttagtaaggatgtttttatataaaggattataaatcagcagaggtaaatacattaatcttggccaaacaggtcatgtccttttgcgttttcctgatggcaggttctgccccctgccgcccggrcactgttggtcatagcrtgaccttggcatcagctgtgagccggtaaacatggaaatgtaggcccctcccaacctgagtcagacccttrgcctggggtccaggaaactgttttaacaagcccctgggtgattttttttcacatgttcaagtttgagcgcctcgagggcctgtgaatggctgcatataaggtacagctggccatatgtcttaaatgacttcaaaggggtgtgagccaggcctcttcccacaccagacttcatgaaccatgcctggtattgtcatgtttttgtgagcagccgtgaatagggctgggggagagagatgttcagccaagaaagtctaaaatagaaagggaatgttcagttataacaaaacaaatttttgtaattagagtgctgggttgtgctcagcatcattggagttaaatgtggagcagtggcttacacttgtaatcccagcactttgagaaactgaggtgggcggatcccttgaggtcaggagttcgaggccaccctgggcaacatggtgaaactccatctctacaaaaaatagaaaaattagccggctgtggtggcaggtgcctgtggtcccagctaaggaggctaaggtgggagaatctcttgaaccctggaggcagaggttgcagtgagctgagatcacgccactgcactccagcctgggcaacagagcgagagaccctttctcaaaaaaaaaaaaaaaaaaaaamagcggagcagcaaactaagtcccttttccatcgagggaggtctctgaagcaragctgagccagcctctcagctctgccctggtggggcaccccatagcgcccagaagcagtgagggctaaggcggcagagtgcagcatggccatgcatgattggagcgccgctactgtgttggtgtcagtttggcagccagcaacttctaagaacatagaatattttcatttagaacttaaaaacagtaaacccaaaaagtttagtttttaaaaattcattttgtttctccctaaagatttttattcttttgaaaatgaccacagtctagtttgaatgccattgtttttcagctgtttcttatttgcaattgctaaaagccaacaaggagcaagttaaatgtccatcacctgaatgggtagacagaagtgacagccacacaatggaatattcctgggcagtaaaaaaagaatgaagtgctggtrcatgctacaacatgaataacccttttaaayattatgctaagtcatgggattcagtcatgaaagactgcatattacaaaattctgtctctctgaaatgtccagaataggccattccttagagacagaaagtagattggtggtttccaggggctgagggatcaggaggaatgcagagtgactgccagtggccatggagtttctttttgggctgacaaactattccaaaactagatagcagtgtcagttgcataactctgaatatactaaaaaccactgaattatacattttccatgggtaaattttatggtaagttacatttcaatagctgctatttaaagyacatagtgactcaacatgaaaggaaaaatatacagttttgtctctataattacccaattaagtgaaccaaaatagctgcaaagtttttaattcatttatcattggttgtaagaattttccctatcatactcccatttgtgggagaaaatttactgtatctactttctatcagagcatttctaagtatttgaaaggtcttatccaaatatttgaaagctgttaaaagttgctgaagtggcaccttcggaagaaggctggaatgttggaaaacagcgttgacattttaaatgatatggaaggtcaagctcgcaatgtaatcttggtggtggctggatggctctactcagactggtttttgagtaaatggcaggtgtgataatatagggattaatctgttaaccactgaatccactgcctgaaattcagacattcaaatgctcccatttgaatttccctttcttattttacatggttttcctgatttttgagtacataaaaaaattattgcaaacttttttcctgcagtgttctggccactgaaattaaatctggttcttttgtctaagactcaagggttgctctcctgtaatgtttgtggaggaactgatcttggacttttccctcctgtcttgggcttttattacagtttgaatttatgctgtaaaaagtgtgattgtagaggtaayctataagtttaaaatattcagaggaaatggatgcttcccaaaggaaaaattgcatacctatatttatttaccaaaatgaggaaaatacctgggaaataatttggccaaatattcagcaattatattcatagattagaagcaaaatacaaaatttgattgtcaacttggtacctttttcattccttacactcttagaaggcattttaagatgccattttgataaaattaaactgggaagactcagaaatcatgttttcccaactatattctgaaaaatcctagttccctgggatgctccgtggaaataacctgtgggcagaacaatctgtgaagtggagactgtggccccgtcttggactgccactgttggcatcaacatggcagacaggcaacagcctttcagctaaagaaggaagaaacagaaaaccccaccttaaccactgcagagttacgtgacctccaaacactgccccccacagcatatccccatttttgtccctttccctttcaaagccaaataatttcaaagaggactacatagctgctggcttgggatggtgtcaaaagccaggcaagatgattttaagtcatagaatgatygagctggaagatgctcacagattaaatggtctccagccactcaatatcagcagcaagggagaggaacagggttggcctgagtgaggctggggccacccctgccgccaggcctgtgtgccaggctcaggtgctccagggaatgagcaaagaggatgttgggtttattttgttttaataaggcgaattgttactgagtttatttaaaaataaagcagcttggggtttaacaccttgcatgtcggttgcattggagtggtaacacctgtgctgtcgtgtgtctgcctggaggggtactttccttcttgggaaagtgaacacaggtgtgttgtcccttctccgtgaaaacactctacttgctggccttgaatagcattctagtgggttacttttctcctagtggtcagagagtatttattggacctctggttccattggcatgtgtcccctaaggagggagacccttcagggggtacttacacctctactgtccgatggcactggctgtgtcacacctggcctgtgggctttgaacctagcatttcagagtgggaaaaggcctcaagccatctagtccaaactctacctgcagatcaggtagaggcccagtggcaggaagtcatcagctaggggtcctcagattacagagctagctctcaaacccaggccctctgtctcccgtctcttgccttccagtgattcccaaatttggcctcctcaaaatcacttgtggaagtgacagcttcctgggctgcgggtgtttgaaaagcttctgtggggattctgatgstgaggctgatgtgggaagcactgtggtgtgtgatcactgaggcacacccatcttcattaatgtgtaagccactcggggataggaagggctaatgcctctctgtactcacagtgcccatcgaggtgcctggcacaccttgcagtagttaattggtatttgtggatcgaatgaacatgttaggtgcccactagcaggggttggtcctgtagtctgtggccatggaacattagaagaataaagctattgtggttcatcctgtagtatagtaagttcgagctgagctaacctgtaataacacaaatataattttttttttttacgtttttaaaagttagagatgggttcttgctatgttgcccagggtagtctcaaactcctcgccttgagatcctcctgccttggctccccaaagtcctgcgattacaggcctgagccattatatttggccaacaaatagaattatttatttatttatttatttattttttgcgatggagtctcaccctgtcacctaggctggagtgcagtggcgtgatcttggctcattgcaacctccgcctcccaggttcaagcgattctctctcctcagcctcctgagtagctgggattacaggtgtgtgccaccacatttggctaatttttatatttttagtagagatggggttttaccatgttggccagcgctggtcttgaactcctgacatcaagtgatctgcctgccttggccccccagagtgctgtgattacaggtgtgagccactgcgcctggcctagacttttttaaagagtagattattaagcaaagggagagtataaacagtattggtttttcattagcttcatctgtaccgtcaaccacatggttctttttgtcttggtagtggtacaggagtaaagttaaacttaaatcaccaccaacacccccaagctaagcataacttttaaaagtttttaatattttggcaagcctgggagaaatattgcccttttttgggtagatcttggatgactaactgcttactatacacacacctgtactacacgtgattgcgttgccttcactgaacaccgtttttgataactgtgtaatctgaggggaattactaagacaataaaaactgcagaccacgcgctctttttctccagtctgcacatagtttggatatgtgtggtggtgtgtttaagcccatggacttgagttttttatgggacaatccttgtgtgtatcagaatcatacagtcccagtaccatcttattcctctggcattattgaagatacaagaaccagttggcattcaaatatgttgagttcactaaaaacagttgctgatgagggaaacctaacaccctgataataaaatgaaaagttgggatttagatgtgttttctcaattgmcaaagcctggtggtggtggtgctggtgctggtgctggtggtagtgctggtggtggttgtggtggttttgagtcttcgctgtatcacccaggctggagtgcagtggcgcgatcttgctcactgcaagctccgcctcccaggttcaagcaattctcctgcctcagcctcccaagaagctgggactatgtatgggcacgtggtaccacgcccgggtaatttttgtatttttagtagagacggggcttcactgtgttggccaggccggtctcgaacgcctgacctctagtgagccacccaccttggcctcccaaagtgctgggattacaggcgtgaaccactgcatgtggccccaaagtctgttttttttccccaagcccttggataagtagacaaagtatgtatgtaaatggtcctgtcatctcagtgaatgtctcattttaaattttggtgaaagcttatgctgtattgtagcacattattttatctataacattgaaaataattggcctttctaaacatggaactgtttatcatgcagtagggtaaggcagtgccatgctgtggtccttaatctggggaggatctcctcccttttccccatagagcatttggaaatgtgtgtgtggatggggttgcttttagatgttccagtgactggggacactcagtcattggatggcttaaggatgctaaacgttcctgagtgcttgggatagtcttgcagaatgaatacttgtgctgtccagaatgacaagagcacccccagtgggaaacactagtagggtaatgactaatcaagtaacagacatgccctttaacttaaagcagctcattaacatagtattcatttacctgtttagattttgagtatcttctcttcaatctctatgtaaagatacagattgtagagcctgccctatgtatgaatatatatatatattaaaactgtgattctaagaaggggttcttaaggttctggtgtgtccccaaatcagaactggaaattattccttttaacagggccaatggattcctattgctggtcctagttttattactgcagtgccagaacaactccctgatcatcatttttatttttttaaaagaggatctcactctttcattcaggctggagtgcagtggctcgatcatagctcactgcactccagcctgaatgattttttgtagagagatggggtcttgacttgttgcccaggctggtctcaaattcctggactcaagtgatctgcctgccttggtttcccacagtgctgggattacaggcatgagccaatgggcctggcctccctgatctttagacttgcaataattgtttgaggttgcgtaccatagggaatgattgcccatgggtgttggagcataggtaaaaaattttgtggaatgatcggaccagctaagagttggcattgtgttggagctgctggtgctcagatgaagtccttttgttaggaggtgtagatttgttgactcatgcagaacttctcagtagcttacttttttttttttttgagatggagtcttgccctgttgcccaggctggagtgcagtggcccgatcttggctcactgcaagctccacctcccgggttgatgccattctcctgcctcagcctcccgagtagctgtgactacaggcgcccgcacacctggataatcttttctatttttagtagagatggggtttcatcgtgttagccaggatgatctccatctcctgacctcgtgatctgccctcctcggcctcccaaagtgctgggattacaggcgtgagccactgtgcccagccaatttttaagttcactttctacacgctactgggttgttaaaaccaacctcagtaaaagtatccgttttacaagttacttgctttttcaggccaggcacagtcaggagtttgagaccagcctggccaacatggtgaaaccctgtctctactaaaattacaaaatttagctgggtgtagtggctggcatctgtaatcccagctgcttgggaggccgaggcaggagaatcgtttgaacccaggaggcagaggttgcagtgagctgagatgatgccactgcactccaacctgggcgacagaggagactccatctcaaaaaaagaaaacaagttaattgctttttaaaagggttgtgtgaactttcagtcagatatgaaactgtttcagaaccaaaaataagttattctaaattcctgctagtcagtttgcaaaatgcttaatatctttttaatgttaattattagctttggtttcaggagatgtcattttcacactgtcttcaaacttagaagagactcaggtttagaatttggagtctgggccgggcgcggtggctcacgcctgtaatcccagcactttgggaggccgaggcaggcagatgacaagatcaggagattgagaccatcctggctaacacggtgaaaccctgtctctactaaaaatacaaaaaattagctgggtgttgtggcgggcacctgtagtcccagctactcgggaggctaaggcaggagaatggcaggaacctgggaggcggagcttgcagtgagccaagatcacaccactgcactccagcctgggcgacagagaaagactccgtctcaaaaaaaaaaaaaaaaaaaaaaaaaaatggagtctgaaatctcgtgtgcatggactctggtcatttgtctttgtcctaaccagacagtggccttcagttctaattgtacttggggttcccacttctgaaccagtagatagcagagaaagaaaggtggcatatccagggttctgcatttgtgagcaaacgcccctccactttagttttagtgtgttatgtcattgttggcttctgtgtatgtagctggagctgcatttgttattgagatatttgacttggggctggttttcccatctctaatacatgcccttggaaccataattgagagaaatgcgtgcttttattttatgcttcataacagccattttgtgattttaaaaaaattaccagcaggaaatgaaagaaaagtaggtttttatattttagtatgattaaagactttaaaacatgtctcgttgcctcctagtaaacttgagttctttaacttctggacttggggattgtggagaaaacttttgaaacaagatctggaaaacgatacttctgtacttgttgtaccagtcggggagcctttaaggcatattggatgcatgttagaggatctctcagtcatagtcttaaatgttattgggacggggtgggagcggctggggagactaattatgttcctgaagtaggaagtgacatttggtgagtgcttaatatttctggttccctggctggataacgaaacctctgtcgccatatactggcacaggtaatacgtccttattacatttacacctgtgttaggaagaatccgggataggtatctctccagcttctgtatatttcacttgaaaaatggtgagaagcaagcatttcttaatattaagcattatagttgctatgtggctctgctgttttctttgggacagtgacataaagtagccagatttgagtgtttttcatacrctttagtaaatctgggttttctcaagtgataaatttgaaaactgccttgatgtaagtgggttgttttgttgttgtggtggtgggtttttttgtttgtttgtttgttttgagatggagtcttgctccggagccgaggctggaatgcagtggcacaatcttggctcactgcaacctccgcctcctgggttcaagcgattctcctgcctcagcctcccaagtagctgggactacaggcgtgcgccactatgcccagctaattttgtatttttaatagagatagggcttcaccatgttagccaggctggtcttgaactcctgacctcaagtggtccacctgcctcggcctcccgaagtgctgggattacaggtctgtgagccaatgcgcccgacagtgttttgtttttttaaaacaactacatggcaacattagaaatattttaaggccctcccatctccacctcctcaattctgtgtctcaccatcctcatactatttccatttttacattttattttcatgtcttgtctaaacagagttcacatttgcattgagtgttgcttgtcgtatttttkatttcagaagcaatttgcccagtttctactattttcgtaattataatttaatatcactacataatccatttttkatgtgtctttggacatttcaccatttctctctcactatggtttctaaggttgcttcaaaccttctgattcaaagctctttctctcttcccttctctgacttccttggtgccttgggagccctcctgcctcccttggctgtcgtaaggctcatatgagatggtgcatggaaaaataggttaaagtattgttttaacaaaaaagaaaaaaactgcttaggttgggcagggtggcccatgcctataatctcagcactatgggaggctgagatgggaggcttgcttgagcctaggagctcaagaccagcctaggcgacatagtgagaccccgtctctacaaaaagtaaaaaacaaaacgagctaggcatggtggcacctatagtgccagctactcaagaggctgaggtgggaggcgttcgtgtgagcctgggagatcatgactagtgagctgtgatcgtgccactgcactccagcttgggtgacagagcaagagcctgtctcaaaagagaaaaactgcttagacctaagtgtcagtgtgctttattaaagcaaagaagctgcgtttggtttgcactgtgtgcctcctgagacatccccagccatctgcagtcaggagtggtgtgtggcttcctgactagcacaggaactgatgtcaggcatatgccgtcgccacactgaggagcagcttatgtagaaggtgcaggaggttattagaagaaaagaatactcagttaagcgtaatttgtttcattctgtttttcagatcaatgtccgagttaccaccatggatgcagagctggagtttgcaatccmgccaaatacaactggaaaacagctttttgatcaggttggtctctgaacttgagagttaactccacctasaraaaaaaactgttttgcaacatttcrgttattttgtttgcgaagcatattaccttgttttactcacttgaggtaatagatgaraaggatcttttaaaaggtgaaagtatttcatgatagcattataaaatgcattaacagacaagtatatcatgcctrggaagtgaggtgtatgaaagcacacakctgtctgttgtataaagtcaggcggattcagtgtgttaccaggcatggaagcaaaggactgaaaagagagttattgtgcttgtcattgtaaggaggtgctggcctgtgtgtctctcaccctgtattagagacgcggcttcctacccgcagctgcctccacctcmagagtagaacccctctcrctgcgtggatgagtgagccttagttgtctcagttgctgcagcttctcatttctaagtgatcgtacctgaacatctatgaaaggaagaaatgaagatttagagaaataattcactttttaaaattggaagatttttttaaatcaagtatttattagtgatattactacttacttattaaatacttttttccccaataacagctgcttcaaatacagcgttgttttttttttttttctttgagactgaatctcactctgttgccccggctggagtgcaatggtgcaatctcagctcactgcaacctctgtctcacaggttcaagcaattctcctgcatcagctccccgaatagttgggattacaggcacatgctaccacgccctgctaatttttgtatttttaatagagacagggtttcgccatgtttgccaggctagtctcgaactcctgaactcaagtgatccacccgtcttggcctcccaaagtgctgggattacaagtgtgagccaccacgctcagcttgcagccttcccccatcccttttgggtgagtgggaagagggggaagaacaggtcagtcctgggcatttaataaacagacttctagagctttagggagcctctggcctccctgcacccttcagatgaagaaacaggcccagatcaggagttaatttggaattttaggatttactttaagcaaatgytctgtatacctgagttgtcatttctaatgtattcaaccctctttggcattaaatatgatagaagccatgtatttgaaggatggtagcattttttaaagtttaacattatatatcatgggattttaaattagacatctatgtatatgtaaatagtcgaacttgtctgggactcggtttagatgatgttcaacaaatgtccacrgcaagttcgactatcactgcttttctgtttacaagacagtcgtgagactaagcagctcaggactcctgtaatgcacaacagaggcttgaaaatgtgaaatctttgctgtgacctagggtcrggattctacctttgctgtatcagaatgtcccatttctggaggtctataagatgcaggttcctctgggcacccctgtgcattgacacccttccgtcccagaagtctgccttgyctgttttcctgcctttcctaggatttctttgtccctgttcctagtaagtcagacccctgggccagctggctgagaggcagaggcaggcagccagaggaggctcaggtgtggcactggatgctttagtcttctgcatgagcacacctgacsggcagcgatgcacccaccgcactgttccctggggggctgtgggctcccatggttctgtgtgtgctggccrtaacccgccctgctgagtttcatgcaggagagcatcctggagtacaaaggagtaggagtgagattttctaagatttgaaggtagaaccctgaatctgctcaaatttatatyaaaaataagtcgttcatggctttgagataatarcctcagttagtaacaagttatttgagtgcaaaaaaagatgttgcccagtggttggactgagcagatgtcctggtttcctggggactctgctagaccatgtgatgaacgacagccaaaagctgttgcccttttgagtgagtttctcatgagtgttgagcctctctctctctcacgcaggtggtaaagactatcggcctccgggaagtgtggtactttggcctccactatgtggataataaaggatttcctacctggctgaagctggataagaaggcaagtcaggattaactatttacaggctgtggattgggtgttggtctgcttcatcgataaggaaactggagcaactcaccctgtcttttgttttctgttcctttttgtttgtgtaaaagtttttacagacaaaaaggttgcaggtttccagtaaatggagatatcgattggaaatcagatctggcatttctccatagtgctcactcattggagcatatgatggttaattgcatagcttttagttgaccttagttttttcaatgagattgttaatcttataaactgtgaatcatccaccatcttgtaagaacctgttattgctttgtttgaacctgtgacagattatcttccaactttaaagagtggataattccattaaccaaccaaaaagaaaagtagtaagataaacattttcttcaaactctgaaaattatcctttttttttttttttgaaacccccactgtcctcccaagtcacagcaacaagttaaaaagatgatgggaggtggggaagagtggaggagcaggaggaattcttaacagtaagtttyggggtccagggcccgattggcatgtggccccattccaggtcactggggtcatttccaaatttgagttctccaggattgatagcatcatcccatgaggactggggcttagtgaggcagtagctttgatttccagctgagcacaagagtgtgatagtacttgtttgttttttgttgttgttgttttgagatggagtcttgctctgtcgcccaggctggggtgcagtggcacgatcttggctcactgcaacctccacctcccgggttcaagtgattctcctgcctcagcctcccaagtagctgggactacagctgcatgccatcatgcccggctaatttttttgtatttttagtagagatggggtttcaccatgttggtcaggctagtctcgaactcctgacctcgtggtccgcccacctcagcctcccaaagtgctgggattacagtcgtgagccaccatgcctggcctgtttttttgtttttgtttgtttgttgttgttttttaagaagagacagggtcttgctctgtcacccaggctggagtgcagtggcgccatcatagctcactgcagtctcgaactcctgagctccagggttcctcctgctcagcttcttgagtaactgggactataagcatgcatcaccatccccagctaactttttttwaaaaaatgttgtagagatgggatctcttctacgttgcccaggctggtcttaaactcctgggctcaagtgatcctcctgccttggcctcccaaagcactgggattataggcatgagccaccatgtctggcctgtggtagcacttttgactaacctttttttgtctggagtgctaaaaagatgactttaagaataaatatctcctgaaaactggcttgagggccccattgagtcttggttagaagcctgtgttggggacagtgggccttcgtcttccggatttgtgtggagagtgtggcttgtttcgtgcaggtgtctgcccaggaggtcaggaaggagaatcccctccagttcaagttccgggccaagttctaccctgaagatgtggctgaggagctcatccaggacatcacccagaaacttttcttcctccaagtgaaggaaggaatccttagcgatgagatctactgcccccctgagactgcygtgctcttggggtcctacgctgtgcaggccaagtttggggactacaacaaagaagtgcacaagtctgggtacctcagctctgagcggctgatccctcaaaggtgagcacaggatgacccggcctgggcaggagcagtcwtgccgtcctcggcagggagaagtgattgccttagaagcacagtttaaaaacrcaaggacttcgccagtgtcaagtgctccttcatgctagtcattaagtcactgaccagcgacctgaaacatagccagggaaggcgagctgccattcctcatggaaactaaagcgtggccgtgtcctgtgggacatggcatagcaaacttctcgacctgactgctcagctcctcctggggtatgataggttgcccctgtgaaatctgtttttatttagtaatggtcacaaaaattaccccatttggaagaagaggccacttaaaatacctcttagtttttccagcagaactgagttcttgttcaaaatgctaagtcttccagattaactgtcataaatagaaatgctgcacatcaggaaatagaaaccaaagctctttgggattgattgatttgaatggaaagtaagggtttgaatgtgggtggtaagtgggcctccttccttgcctgtcacattccttaaggatgacagtgctgtttccttttgcattccagagtgatggaccagcacaaacttaccagggaccagtgggaggaccggatccaggtgtggcatgcggaacacygtgggatgctcaagtgagtgntgtgccctgctgttgggatcttgccatctccgtgcrctccagcatgtcttttcctgtgactctagttagtgctttaaagggctctgtgtcaggccttgtgaagaccttgagggaaccgagttaaaagtggggttttcttagggaagaggttttttttaaacaaagccaggtgtcttgcctggggaaagaagcggtttagctcaagccttcaggttctaaaagcttacaccctccctttgtagaaagtgttgtgtctaaacttcatcttagtcagaggggcattgttcacctgcaatcagcattattctgtcaaagagatgctggtttgctcattatatgaaggtacttgtcttacaaagtgtatataaatgaaaaaggatcccaagtgagaaatgctgatgtcagagaacctggacgtggggctgttaatgtaagacatggccgagccacctgattctgggtgttctcgtcctagagccttgtctctggcctagtcttgcgagtctgcattatttcagcctctgaagtttgtttgaggtttgagcctcagattttgtgcttcagggtttcctgtctggcccaaacatcctttatggaaggaaaacaactcaaagcctatgaggagggttgtgggaagacatgtgtgggcaagagaaaaaggaggattgtgctgagtgataaaacttaaaaacctgttagagaaaccagtgtgaatcagttcttcttcaaagtgtggggtttggtggtgaggctccagggcagcacggaccccaccccaggcatagcttctgggctgtatgggtcccctcctcaccggtcggctgcccggcccctgcctgcctgcacgcagcacacagcattgagcccatcctacacaaggcrccttaatttaaaaatactggaaaggttttactgttctagatattgagtgctmccagtgactctgcctgtttcmctctccccaattagagataatgctatgttggaatacctgaagattgctcaggacctggaaatgtatggaatcaactatttcgagataaaaaacaagaaaggaacagacctttggcttggagttgatgcccttggactgaatatttatgagaaagatgataagtgagttgaagttcacagttatcttcagtaggtagggtggtgggcctggaaacaatggcaaaatggcaaatttgtgggttatttttgaagtatttatttagcaacttactatcccaaagtaggaawctttttaaagggcttttggactgctgtggccctctcaaagggtggtccagaggtgtgggttatcctctctcatggtgggcggggccgatagtgggctcagtcctggtagaggaaggcagaatagagcagaggctgcctctcctccccsctgcctctgagattccaccccagctgcctgcaggtaccagcacatccatccatagctacttcgcaggcagcccagccagtgctcgactcctggctygaggtttgtgctaatccaaccaagaatattgatggtgtgatgagagacttgaaaagctgtaaacaatagcctgtacgtgtagacacttgagctaaatgctgggagtctgcaggagatatcttaattgcctcgcattagttacgttgtttgttgagtgagggcctgtaagcaagctgggtagagcagcagagccaggcctctccacagggacaggcagttccgctttcacatacagggcatttgccttctttctgctgaggataaacagggaaagtcatcctagttcatgagggcaagtttsccatggtgagtctgcgacatcagcataatcctagattctggattgatctgatcagaagctacctgaawttaagaggcagaaggaaactacctctggaaagagaagggagaggctcctgactgcctcctgactaccgtctctgccctgattgtccacagtcagcctgattgctctgcagggctccccgaaacaaatcatctgatggccaccaggttcaggggcctggcagagaaggtgccagggcaagaatgctcctggggtctttttgccaagccctgccttttggcctgggttcctgctttccacgtaaagagcagagtggcccagagttcctggatgtaccggtttccttcccagcctcatgctgttccttgaaatgacagctctccccatttcccacttgaggctcacccatctcatctgttctcagatatttttgttctcagcatccccacatctcaggttcccccaaaaccctctctggagttctcaaagggagtggtgctgctttccacaaatgacctgcaygagtccatctccatttgcaaccacgcggattcctgccagaccccagggcacagatctatttcacttgggcaagtcagggacctgtgccagctgtgcccaacctcctctcacctccggggcccacgtggtgatactgcacagggagggaggcaggcgctgtcacaggagctcctcagagaacctggaaatgagatattgaggactctcrgttcgctcctactccaagtgtgctggatgcagcattggtaaagaagcacggaaaagccaggcacagcggctcacacctggaatcccagcactctgggaggccgaggcaggcgaatcccttgagctcaggwgtcttgcccagcctggggaacatggcraaaccccgtctctaccaaaatttaaaaaattagctggctatggtggtgcacgcctgtggtctcagtcaggtggctgaggtgggaggatcacttgagcctgggaggcagaggttgtagtaagccaagattgcgccactgcactctagcctgggtgacagagcgagaccgtgtctcaaaaaaaattttaaagaagtggggaaagtgggtacttggaaccaggacaccatctttccgggagaccctagagctgaagccgtggctattaagacagccatgccaaggagcagtgcacaaagtcctcgtgggaacgtatgtgggaaactgcctctgccttggaaatctcttcaatgaccagattttgtaacgtggccaggccagggctgtccaaacaggtttttcaacctgcaggaaaacagccatgggcaggaacttgctgatgtcagcttgtaactgccccagcccacgtaagtgtccatttcttccaagtaaaaacgtgagctgtgtgccctatttagtgctgtttttgcgctctgctccccctcccccaccattgagcgatgaacgtggcaactctctcagatggttctttccccacagagcatgctggggtgttgggcaggctcactttctgcctctcttctccccattcctgaaggcacacccctctcttcatgaaaaaagcatttatgtagatattcagtcatttaataggcccaaattctttcccttttgaacaaatattgacaasttggtagcagcataagcaggagactgtcctgaagtctgaggagtgctgagaactcrccagctgttgcgctgttacctctctcggtagaactaggagaattagatatgcctgaaacattgttcaggtgagaaagctgatctattgaatatggaaattgagctctaagagatttatactctgcaagtaaagtctctattaaaacacctgttttagtattaaatagggtctggctgggaaatctgtctcttggggttcccttttcattgtacacataagcattaagtgggagcatgtaggactatttgtcatctttctttaaacccttagcttggaataggtgggagtataaagagggcaaaaacaggtaagcgccctcctgacaggcattgtaagcttgtgaacagagaaagttcagtttagctgggttacaatttgaaacctgacactcggaccaaaaacaaaaactaacaaaaactagaggaacctgatctttagtcctgtaaaagcactttttctcccttagcttcatccctctttgggcagatttcatcatagaagtccttctgtaggtaggagtttctggaaatgcactaggtccagggcttccaccttaaagggaaagggtgcacggggagcttggggactgaaacaggagccacagaacatgtctcttctttaaattccttgcggataggtactcagggcttcgcttgctttctcacgtctctttccgtatgcactccactgtcaccctctggccctctaacacatttccaagaaaactgcaggcatccatatccttcctcaaaatgaaagtgcatatgatatactagaggttggttatgttttgttcttttgatgtaaaatttaaatacaatgaaatgtaatcttaagtgttcatttgttgagttctgacaaatatgcctgaaaaatgcaaaatcttaagacatgtagaacattatcacactcagctacatattttggatttacattttttaatcattcttggttttttttttttttttgagatggaatctcactgtgtcacccagggtggagtgcaatggcacattctcagctcactgtaacctctgcctcctgggttcaagcggttctcctgcctcagcctcccgagtagccaggattacaggcacatgccaccactcctggctaatttttgtatttttagtagagatggggtttcactgtgttggccaggctggtctcaaactcctgacctcaaatgatctgcccaccttggcttcccaaagtgctgggattacaggtgtaagccaccatgcctggcccattcttgcattttaaagtcatttcaggctgggcatggtggctcatacctgtaatcccagcactttgggaggctaaaacaggtagatcccttgagctcaggagttcaagaccagcctgggctggtctttgccaacatggcaaaaccccgtctccaccaaaagtacaaaaaattagctgggcgtggtggtgcatgcctgtggtcctagctacttgggaggctgaggtgggaggatcacttgagcccgggaggcggaggctgcagtgagccaagattgtgccactgcactctagcctgggtgacagagtaagaccccatctcaatttaaaatatatatattatttcaaactttaaaaagattctaaaaatagtacaaataattcccatatacccttcacttagcttcctcaaacattaacaccttatgtaaccgtagtccaaataccaagataagaaaattaacattagcagtctctagacctcattcccattttaatcagttgtctcactgatgtcctatttctgycccgggaccctctctggagccacacagttagttgttagrcctccctgtctccttcgatgtgggatagttccagtctttttttgtcatgaccttggtatttttgaagagtactggccattgactttggaaagcccttcagcttggattgtctggtgttttctcattatttggagttttacatttttggtaagaataaagtgctgttttgcccttccaggacctctttcaaggtggcacatgtggtcggtatatcttatcttaggtggtgctaattttgattattagttaaggtggtgtctgccacgtttctccactgtaaaatcactatccttccctttacaattggtcagtatatttgggggagataattttaaactatgtagatgtcctagttctagctaccattgatgagattactgtggtatttgagaaattgtgatttttaaaaactttttacgtgtattaattggaattctataaggagccaatttctgttctccatttattcagttayattaatatggactcatggatatgtgtttcggtctttgggttatgatctatgagtatgtatcttcttgctcaggttgtttgagatttggcctttaggagcaccttgaagtgtgagccstgcattctttgcaggcttccttgctgyctggctcctcgagatgcaccaggttcatcctttgtgttccctgttctagtcctggaatcagccatttctccaaaggcctctgtctggtccctgttattggagaatcacgcttttttaatgtgtggcctaagcaaggacacttataaaccctgtggccaccttctctgtagaccctgttcatgtcctatatgtgatctcttaggaaaaaggaaatccttgggctttaattttscaactttggtcaagaattaaaagttctttaactcaaaagtgagtcataattttcatgtttaacctttttgttttgatactgcagttatgcttatgagtggctatgaattgttatatgaggtttcaaagtcctaagaggaaaaactttctaggcacaccagagagccggaggcctaaattttctaaggtcagaacctgttttgagagtcctgtgtagagacaggagccggagasgggatcccagccccttgaagtttcaggatgcggcacgctggctcacagtgctatgtgctgtgggcgragcctccggagcttggatcctagcttctctgttggtgccagcaggctgctcttgtgttttgggagaaagtgctccagaagcaacacatgcctacctggtgccactttcacagcctttcaatgtaaggaggacataggctgaagtcagtagcagggcaaggtggtatctggagttcccctttaatgctctgaaacctgtaaagaaaattacatctcgaagataaaagaacaaactcattgcatgtctgtttgaatgccaggtgtgttttttttaatggggattggtgattctagagcatagcactgtaaaagaaaggatgtatacaaaagctttgacatttagaaccatggtctggccagtgtcctgccatcattcctgcaggcacaccatgactgactgcgctaattccccagaagggccatgtcaggcttacatgtttgccctcagcctacagagtccaccccactgccttgatctagttgatgtgrtcataacgaaacctgtattgctcrtcagtattgaagctgttggtaggccatagattgcttgaccttcctgctacttctaaaatgaaggtttttgtgggatgttggaaaggactgctttggagggcagcattgttggatggtggttttgaggatttgtcgttatttccagaatggcattatccctggtaaaatgtgttggaagaatagggtgggaagtgtcaggtgagcagagcaatgtggtcttgaagtcacatgatgaacttgggaatgctaataaaagccagagtctggccagtcatggcattgcattggttaagtaggattagccctgtggggccttcattagggcsgttagtttgaaggctgtcctggaagttggagagtgacatgggaagatgtctgtccagccaggagaacacacactggaatgagaaccagaggagcagaatgcatagcaaggcctytgtccrtttctcttggcaagctctgttgagtrtggcacgtctaggaacgtgatgggatcttggccctccctgttggtttcatagaactaaatgatcagtaacttaaataacattcaacagtctgtagcagaagagcctgtatgttaagagaggcctcaagggaaagggaggcagccctggggaactgtgtgttgaaaggtgggtctgaaccgtggagtttggggctggatttgacagctcttggatgctgagttaaggactgtgttgacatgggaggagaggaaattaatcagatcagcagactgaaagtagggctgctccagcacacagcttgagagtgggctctggcaggatgagaggtaggtgagtgtggtgatgtgatgtgggaatgaacagcagaagatacctgagggggagggtcaaggtacctgggtaggaatttcagttgacctcgagatcaccagcctgggtaatcataggtgccctagactgaggaaaaaccaaaggaaatgggaacagattaaggttgcagatgccttgcagccaaccacttggcttaacctaggacaggtgggaactattkgataatagcatataacacattgtgcctcttgggttagcttcatattattttaattgaactaataagaattgatttgcgaatctctcttagccaatccaagaacatatgtatacatctaaccatccacttcttctttttaacctcaggttaaccccaaagattggctttccttggagtgaaatcaggaacatctctttcaatgacaaaaagtttgtcattaaacccatcgacaagaaggcacctgtaagttccaaaggattctattcaggggctactgtttttcattcttatacttgtcagggtaacggacargttatactgtgacgagtagccagtgatagtccaaactcctcatgaggttacattgagggccagagatcctgtgggccaggcaattgctgcaggggagaccacttaacttttcaaatgattctcattccttatgaagaaaagggcagttctgagccattggccaaatgataagcatttcccaaaatgctrtgtttttggtgtggagagccagcctgtccccttgaccacctgggtgcagggactctccccggcacctgacggacagtgggacctgcgagtctcaagggccagatttgcctttcagagctgtcctggaacttacccaagatagggacagtcagacttgcacccaagcattgctggtscccaaggtttcatcggggcttcacccacttctgttgtcagaggtgtgcatcctcacacaggtgacactggcaggcagtcattttgggaggacatggtaagaaggcgacactttatgtcctgaaatctgatagtattgattgtaatagctgcaaagaccagtgcattatgtaaatttggttttatttattctgctgacatttaaacttttgttaactcagaatatttgagacatacgcacataactgtagcattgtagaatgggtaaggattttgttatctaatcagaaatctagttctctaaaaaattgccacctgaagaaattctgttaccaccttagagcctgttctgaattttacgaaaattatagattggaaaggactttgtgttctcatgtaattttggttccttagttacagtgttaagcttggagaggcaaacatgggctgtggtccataccttggttgtcttgttaacccttttgggactgggtactgcttagcaatggtaaatccacttagaacagtatgtggtgttattgtcctgttacttctccccacatacaggtttgtctagcataatttaaaatcagcaggtcttgacaattttgtgaaagtattttcttctttgttaaaaacgtcttggccaggctcagtggctcacgcctgtaatcccaggaccttgggaggctgagatggccgaatcacgaggtcaggagttcgagaccagcctggccaacacagtgaaaaccccatctctactaaaaatacaaaaattatctgggcgtggtggtgggcgcctgtaatctcagctgctcgggaggctgaggcaggagaatcgcttgaacccaggaagcggaggttgcagtgagctgagattgccactgcactcaagcctgggtgacagagctagactccgtctcaaaaaaaaaaaaaaaaaaaagggctcctgctgtttgcaaactmttggctgctactctgtgggtagttgcacggttatttaaaattaaacgcgtattgaatgcagactctaaggctccatggcagcagttcatattatgcaacagcatgaatggagggtcatagcgtcttcatgtcacttgggtagtaagattggcacagtttagaagagcaagaaaatgctgaaatctcttcatcagtaggctactacgtactctgtgacgctactgccttttcagaacacttattaaaaatttgactagagcagmagctctggactagactgtttcagaatgtttgtgcgtgygtgtgtgtgtgtgtgtgtgtgtgtgtgtttgatgataagtccatctcttgaaaagctgaagaatattttcataataagccccaagcagaagccattgtaacgcatctcgtgcatgtgcctttattatagagtagcctcatgtgaagccatctcgtaagcaaaagaaacattcgctggtggcacgctgtcccaggcactcttccagggctgtgtgcaccatcaacaaggcaaagctcctaccctggtgagcctacatttacgtgaaggaaagggttaaaaaggcaactgagatgcttcctggtagtaaatttaacagwacagctgtgattaaaaactaagccggatcagaagatgggggtgagattcctttargcaggttgggcaggagccacactgaggaggcagcatttgccttgagtgggcactgctggtttgaggaggtggagttctgtcacccccacagcaccccagggctgctcgaggcactgccccacctcagtctgtaaactttgggcagaagaagttcaagttttcgacatcgaactttcwtgtaaaaaagaagaggcccaaagtttgaggcggtgggattccttatcttgtgttgactttcacgggtcatcttcaccccaggcggtttctgctgtgaactcacaaatgagtctttgtccagttctcacccaacaactggcgtctcctttttaaaagccagcttctcttccctgccaaggtgcatacagcagtttggggccacactttggctctttagatgggaccttgtatacagctgacacggcctgcccaggtgacactatgaggggctgaggcggctgccttttccctttcaaaagggcgttttgttcctgtggccttgtggaaaaggcagaaggctctgaggcatctgaaatttggagaaagtaagcagcgtttccgctctgactcctcggmcgcttcccccacgtgaccttcccaggagccccgctgcctttttgcctcccgcggctgcctcctgccatctctgcggccagatgagccttgggattggcctcttgtgggagagtttcytggcatcctggggacttgaaaaggggctcttttaccttctctccttctgtatttgtagggtcttgggtttatttttcttgaactttccttgtgcctggtttgcatttttaccttgctggtcctcggccagtttaaaaaccctgctccaggtcttgtcgtgttgtggttctgcatcaggaagctgcatcctgcatcaggttagggacttggatttagaaacatttcagtatgagtctttgttttaacttgaagtgagaaaccggcttccttcaaaggcactgggagagatttcctgccaggcaccatcctccctcacccactggcagtggactccccaaattctggttcccgttgctggcaggacctgtcttctgcagggaaagggagagagggagacattgttatgttaaccattgaggtttttcattgatccccccacccatgcacccccacaaccccataaaggggagttggtgctaatcagcgttttctgagtcagggcctatttggtagagtcctccaaagctgtaatgcaggattgtttcctcttgtgtaataagggataggtgggtcataaaaatgccgattgctcccagctccacagactcctccctgggaaacccaatgacttaacagcaagggtgtgaaaccccaaagacagccccacccaggaagttcatgggctctcagggcttggcatcacctctcaccctaggatttctggaacagatgaaaagactgaagctaaatagattcttctcsgatgtgttgatgagcccgctcagccggttcctcgttaggtctcagaagttgctgtgggatatatcgcactgtttttttgttttagccaccctgtccctctgttccaaatggtcagaagctggatgctgggggccctgaggttaagaggaagccaacagagtcactgaaaaataacttttcatgggagtttctaaaccatattcttctgtcttgtaagctaatcacagcagtagcaaggagttgggaccaagattgtcagctgtgtcccaaatgtttccagtcatggtcacgagtttcccgaaggctgtgattctgccttgttttccaggaggctcctctggttgtggtcttgcaaggcactagcaattggagtgaccgctgtgtgtgtcagccagctcttcctgcgccgagcacctcctgaacgtcaccgataaggcggggacgccagcatctaatgggactgctgggaggattgagtcccatatctgaagtcccttgagataccggcatcccygccttatggttgaaggcactgagcctggtgaagggatgtgctcaaggctgtggagctcgcacgtggctgkctgtgctgcacgagctggcagtgcctggcaggtactgcacacctcaaataccctgggaagataagagatgagtgaatgtgtggcccctgcccttgggagctgatggcctcataggagtgagatgctgaaaggagtcactggagtgaagtgacagtgccactgcggcgagtacctgtagctggtgtggcaggagcagggctggatagctttgaggagagagaaccgagtgcacagcggaggctgggcccagagctggaaggtctctgtgtgggttgggcccaggccctggagctcatcctggagctcccaggctggcagtgatgggtcggggtggtgacccagtcagtgtagcaataacagtgtgggaggggaggctgtggcagaggagacaggaagcccaaatagmagcagaggcagtccaggcaagcatcggggatggggagcagcagtgaggctggagaggacatcatgaaaggtggctacctggaagagcaggcagctctgagacttgaaaggtttcccaaggctgagagttctcaccttggaaaagctttgcagttaacgtgcagtggcatttcagtgtgcatgcaggatgtccctacccacacacaactgcacacacacgcggcacctgcccttcctccacccgtcccagagaatgcactttcccagtgctacatacccacacataaccgcacacacacgcggcacgtgcccttcctccatctgtcctggagaatgcacattccyagtgccgagatgctgccatccctgttctgctacatttgttcttttagaaaagttctggacctttgtgaaggatggtttggagaagaaaaccaaacgaaggagcttgagtccaggtggccctgttctgttttgtaggactttgtgttttatgccccacgtctgagaatcaacaagcggatcctgcagctctgcatgggcaaccatgagttgtatatgcgccgcaggaagcctgacaccatcgaggtgcagcagatgaaggcccaggcccgggaggagaagcatcagaagcagctggagcggtgagcgcgtgaggccagagtggggggggcctgtgttctcccaactcagccactggcagccccagtgcctgtcaggtgactgtggagctgatggggagagtgtggtggaatggaacccagtcaccacgctgggatcttcgaggcctttgtctctgggcrgttgctgtggtgctgagcctgttgtcagccctggagcggctgctccgtcaggcagctcaggctggcagcaggcyagggtggccctcaggataccaagtccatcctggagcttcaagtacccgtgaagtgtgttgacccctcactttcctgccagagtctaaatctccctgtgcctctttttccctgcaccaggcaacagctggaaacagagaagaaaaggagagaaaccgtggagrgagagrragagcagatgatgcgcgagaaggaggagttgatgctgcggctgcaggactatgaggagaagacaaagaaggcagagagaggtcaggcrccctggggctggcactctacactgggtcatgcatttccacagagtagcaggggccacacccacccacccactcaccaggaaggaaaccaagaacgtgtcccacagcgcagactcacagccgaaatgataaaatggttatttggtttggaaaacagttctgtacttatttaactttgatgctagttgttctaagactttgtattttaaaatttccctagtcttttgcggtaagtgctcaatcacccagtttccccgatgaggacagtaaggtttggtgcggtacagtgatttgcccacagtcccccagcccatgactgacagggccatgctgcactgccctcgacctctagactaaaacccaaaggcgtgttcagagccagacttcccagcacagctccagtcaacaaccccagcagctgggccgattacacaaggcgccacagatgctgtattcactggcagcccttacagcacacatgggaagggtgttctgtgttctgagtggagtgtggaccaccagcacagcgggcggctgacctggggagagtagcgccaagagggttgagtcaggcatgccagagagagggcgcctggctggcgttggacgggtttctagccatcttgaggaagttgtcatggatacagcagcaatgagctctgtgaagtgctttcctccagggtcactggaagacatcccctcaacctgtgacttggtctagggctctgtggctttgggggtgggaatggaaagcgagggctcctaggtccctgggctgagggtttgaatggctctggctttgtgtctttgcagagctctcggagcagattcagagggccctgcagctggaggaggagaggaagcgggcacaggaggaggccgagcgcctagaggctgaccgtatggctgcactgcgggctaaggaggagctggagagacaggcggtggatcagataaagagccaggagcagctggtaggaatggcctgastttcaagatgctgaattatagagaggctgcttctgaggatggaaaatgtgacacctgccttgtaataattgtcatgactggaagctgtaaactgatctgctggggggctgaaggcagctggtggggaaggggctgggctgttgccagggtcacccattgaaggtgggtgtgggcatccaggaagagatgccgggggtgcacaawggaccctgctggccatggagtgggggtggcggggactcaggtgtcacgttggagactgcttgccaacacacatgaacactcattcacaactggactccgttgaaaggatatcagaactgacgtgagcttggcattcccttcccaggctgcggagcttgcagaatacactgccaagattgccctcctggaagaggcgcggaggcgcaaggaggatgaagttgaagagtggcagcacagggtgagtctgcacgggggacacctccgcacggccacagcacctgttgcccaattgcctgcggtggggcccttctgcaggtgggtgggttgggggagaggtctggctcaagctgccacatcccactggaagcttctgggatgtctcatgatcctctgccaataccagctgtactaytgaagtagacatccccaaagagatgggtttgactttgtacacgagtcagtgcagctgctggattcatagagggaggacctctgattgactttcacccactttgctccctccaccccgaactgttcagtgctgatctgacagcccccggtcaggaactggttttamatctaattatatatgtgccccttgcaatggggtcgcagtgcctgaaacacgacctcctgcagctagtatatacagcgggcaccatggaaagatccagctccttggacgtctccaggctggagtgagagctgggctctgctgctcatcagctatttgggggctagtagcatcacttcttcaagcctcattttcctcattgtagaatgggggcaatacccaactcataaggttgctctgcagatgcgaggtcccatgcccaggacctagcacagaggtttagtcagctgtagctctcattgtgggacgcacacagagcttgtcgctccgtctgggatcccctgtgccctccaggaaggcacagcccctgagaagctctggggatggttcccactggagactgcacaccaggctttaagcagctcctctccttcacagacccgctggccygtccttcccccactgtggcttctccatctgtggaggtgccttctggggacgtgtctcccggctctccagggctgctgctgcctagtacctccttgcctctgttccagcccccattcccgctgccgatctgtattaggctgttctcacacggctataaagaacaagctgagactgggtagttaaagaaaagaggtttaattgactcacagtcccacatggctgggggaggcctcaggaaatttacaatcgtggcagaaggcgaaggggaagcaggcacctcttacatgagggcagaagagagaaaagcaaaggggggtaatgccaaacactgaaaccatcagctcttgctcagaacccacccactagcacgagaacagcataggggaaaccaccccgtaatccagtcacctcccaccaggtaatgccccccacccccagcatggggggattacaggtggagatgagatttgggtggggacacagccatatcaccatcccaagttgcaagcggaagactttggttcttaggtttttggagaaagtacctgttaagtgaggagagctggctacaaagcagatccacactaagctcaactctagggctggctgggatggaggcgggcgggactgggtgtgtgtgaagctgttggaaggactgcaagtggcgagcaggagagcacttgataatgactgtggcatgaagggaggctaggaacagagcccgttactcatgctaacaggattttttttctaaaaattatrtaatgtctagagttacaggtaaaaaaagaaatggtagttttaaaactgcccaggttccggcatcacagttcctcttcctgtcttggacgcagagggttgtaaaccccccatgcaccctgagggtgctcctcttcgaagccacagcccagcacagttcagtgctgccttagcctgccaggacagagggaggtgacagtctgttctcatagccaggaggataggacttctgggtgagaagtcctcttattaatttgctttcyaaaggccaaagaagcccaggatgacctggtgaagaccaaggaggagctgcacctggtgatgacagcacccccgcccccaccaccccccgtgtacgagccggtgagctaccatgtccaggagagcttgcaggatgagggcscagagcccacgggctacagcgcggagctgtctagtgagggcatccgggatgaccgcaatgaggagaagcgcatcactgaggcagagaagaacgagcgtgtgcagcggcagctgctggtgaggcccamggggctctgtctccagggagcctgcctsgcttttggagcagacaggcttggggagggcagtgatgtgagccagccccacccagcacccctcttgcccttcctgttttcctaggggacgggccgggccatatggggaggaagggactagaccaaygctgcttaatgttacagacgctgagcagcgagctgtcccaggcccgagatgagaataagaggacccacaatgacatcatccacaacgagaacatgaggcaaggccgggacaagtacaagacgctgcggcagatccggcagggcaacaccaagcagcgcatcgacgagttcgaggccctgtaacagcyaggccaggaccaagggyagaggggtgctcatagcgggcgctgccagccccgccacgcttgtctttagtgctccaagtctaggaactccctcagatcccagttcctttagaaagcagttacccarcagaaacattctgggctgggaaccagggaggcgccctggtttgttttccccagttgtaatagtgccaagcaggcctgattctcgcgattattctcgaatcacctcctgtgttgtgctgggagcaggactgattgaattacggaaaatgcctgtaaagtctgagtaagaaacttcatgctggcctgtgtgatacaagagtcagcatcattaaaggaaacgtggcaggacttccatctgtgccatacttgttctgtattcgaaatgagctcaaattgattttttaatttctatgaaggatccatctttgtatatttacatgcttagaggggtgaaaattattttggaaattgagtctgaagcactctcgcacacacagtgattccctcctcccgtcactccacgcagctggcagagagcacagtgatcaccagcgtgagtggtggaggaggacacttggatwtttttttagttyttttttttttggcttaacagttttagaatacattgtacttatacaccttattaatgatcagctatatactatttatatacaagtgataatacagatttgtaacattagttttaaaaagggaaagttttgttctgtatattttgttaccttttacagaataaaagaattacatatgaaaaaccctctaaaccatggcacttgatgtgatgtggcaggagggcagtggtggagctggacctgcctgctgcagtcacgtgtaaacaggattattattagtgttttatgcatgtaatggactatgcacacttttaattttgtcagattcacacatgccactatgagctttcagactccagctgtgaagagactctgtttgcttgtgtttgtttgcagtctctctctgccatggccttggcaggctgctggaaggcagcttgtggaggccgttggttccgcccactcattccttytcgtgcactgctttytccttcacagctaagatgccatgtgcaggtggattccatgccgcagacatgaaataaaagctttgcaaaggcacgaagcagcacgggtgtgtgcttgtgtgtggggtgggagggctaccgccgactcgtctgggctctatgctgtcctctggccaggtttygtgaggggccgtggtgtccctgggggtacactggtaagttggagctgaccaacccaagacatggtgctccatgggtcacctaacctcctcgagatggtttccacaggagagaaagactgctccaacactcatcaggctcctctaaaatgctcctcatagccgggcacagtggctcacacctgtaatcccagcactttgggaggccgaggtggtcggatcacgaggtcaggagatcgagaccatcctggccaacatggtgaaaccccatctttactaaaaatacgaaaattagcctggtgtggtggtgcatacctataatcccagctacttgggaggctggggcaggagaattgctagaacccgggaggcggagcttgcagcaagccaagatcgtgccactgcactccagcctggtgacggggagactccgtctcaaaaaataaagtgcttctcacagcgaagctgtgactcccccccccgccttgagacagggtcttactttggcccaggctggagcacagttgcatgatcggggcttactgcagcctcaacctcctgggctcaatcctcccggttcagcctcctgagtaactgggactacaggtgtgtaccaccacacctggataattttttggtttttttgtagacagggtatctatgttgcctgggctgatctcacacttctgagctcaagccatccactgcagcctcccaaagttgctgggattacaggggggagttaccatgcccaccagccggccttttacctcatttgataagcactggaggacatgggtaacaacgtttattaaaatctggccattttctacatctcaaagaggagataacccaccagaggcttaggtaacataattgtgtttaacgtaaatatacacagataccaataggcggttaagccatgggacagggccgcagatggagactgctcaaggtcaaaggggtctccagctgggaccctgcacctggttcgtagcccctctgcagacgcacagtgcctcacgcctgctgcaacctggaaccttgaggccttcatgtcagtgcaggacaagagtcatgtctgtccatagattggggctggaaaggactttctgccactggagcttcgatwgtgagcatgcatccccgccaacagctgtgtctccctctgtaagagaggaagacaatttagccatggtcggggagggcaccacttcatcccctctcatccctttaaaaatgatgaccagccagaagtttttcaccttaagtccacattaaaaggccaaccactgatgacagacgccgccaccaccactcccaccccaacaaagctggtgttgagactgggattcacgcaggcatcctctgctctgcgaggctctaacagcctggagttctgtagtttgaaagtgaggcgaggactctggtttggtgggctgggtcttcaccaagggagtggatagttgcacaccagcatggctagctgggtggggccgtctcagactgggggctgggcttgcccatgggaagggattcttagaggaagacagtatgctttggacaaaatatctttgaaaagcaatggagcagtgaagcttatttctcttcagtcactggttctcagttggaggtccttggagatgtgtgcaggtgtttttggttgtcatcatgtcagggacactgctggcagccagaagcagtgccaggcacagaacctcacagcagagggctgtccacctaccatgccggcggtgccctgccgagcggctctggacagcactgctgttctgaccacttttgatgaagtactttctgaattgccatttgtttaagaagatattttcatttaagaaaataatccttttatgattgacgccagaaacaaaagcaaatactgtacctagcccgtttggaggcctataatttttgtttctttagcagatctaaatctgatttaaattgtcaaaatacttggctgtattatggctcagctgtagagtaaaaactagrcttargcatttccaattaaggcaggctaggcaatttcaaaaccagttaagtcactgccctggtggaagcattttctttgcacggtacccattaggataatcacaaagtataaacgtttgggctcaatgtctcagacttacttgaaccaagtctggttcctccaagcaagcggtcrttcattccaaagagggcctgatcccagacagttaactccaagctygactgcctcagctgagctggggttaygccactgaagacaaatgagtgtttccactrggggcaagcctgcttcctcaggactggcgacttcagtctcagtttttgttggtctggcagagtgagacagctgaagagggaacacaaaccctgcaatcattgccatccacacggccttctctcctgaggcctgtgcgtcagtgcagacgggaagcactaagaaaagtgccaagtccacaacatccacaccctccccagtgaagcagggtgggaaccacaggactcggcacatttcccttagggccgaattctgcatcaggtatgaagggcgagctgcatgctgaggcctcgtggccctcatcttaatctttcctccttggggtgcctcccaccatgactgcagatacacgttatctccttttaaccctgttctcaggaaaatcaactcagacaagcttgtccaaggccatgcagataagcaacaagattagaacataagctcagttctcctttttttgagacggagttttgttctgtcgcccaggctggagtgaagtggcaccatctcagctcactgcaacctcctccccccaagttcaaggaagactcctatctcagcctccagagcagctaggattataggtgcccgccaccacacccagctaatttttgtatttttagtagagatggggtttcatcatgttggccaggctagttttgaactcctgacctcaggtgatccacctgcctcagcctcccaaagtgctgggattacaggcacgagccactgcgtccagcctgagttctatcttgaccgtcatttttccctatgtcactgacggggagtttgcaattcaatgtaataatggtatttgccttacttttagaggggccaatgcacctgtactgaatgagaatgaaatgtggacagtcatgcgttttactgttggtccaagaggagatgttaagcttaggaaatatttactgaccacaccacattttcatgcttgatttcaaaactggcttcctgatatcacagaactgagaagattagggtttcgagtactccagcatgtacacatcccgtgaatttttggaaatcagggtctttaatgtgtgttgttagattttcataggaaagctaaaataagacgttttaagtggcttacgttttttagtgttcgctgcaggttctgggccatgttgtgatgtatactagatcaccaataaatatttgattacatcgaatacctaccccttaacaaatgagttcaaggtgccatctggccgcacaggtaaattcttggctcctagcactaccaaacaaagttgaccatgaagtgatggctgatytgtccctggaaggaaagccagtattcactgtcaaaccatgtctcctgatacgttagtatgcagtaccaccaccccaaaaccgagagctcagctagagaatctgctacagccctcagaccccgagagagcagatgggagtggtgcagtgggctctgctggccctgcccacaggctgtggcgctgcccacaccgtgccgctctgtggtcaggtggaggacaggatggagggattactaagatcctagcaaagagtaaagaggaacgcaaggagagggaagatgccgaagtttgagtctagttgtagccagaagtttgggggaaagtgagagccccgagaccctgtctaggaggttgggatggccatggggcacttgctgctggtctgctggtgaccccgtgaacttgggtagcagaatttcctcttctagccaaatagggagtcagcaaaatacacaacagaaatgtgcattctgggccgggcgtggtggctcacgcctgtaatcccagcactttgggaggccaaggtgggcggatcatgaggtcaggagatcgagaccatcctggctaacatggtgaaaccctgtctctacttaaagaaaaaaaacaaaaaattagccgggcatggtggcaggtgcctgtagtcccaggtactcgggaggctgaggcaggagaatggcatgaatcagggaggcgaagcttgcagtgagccaagatcgggccactgcactccagcctgggtgacagagcaaaactctgtctcaaaaaaaaaaaaaaaaaaaaaaaagaaatgtgcattctcccagtcctccttccccgccctcctcctcctccaccctcctgctttccacacgccccacgttattgaaggagtaaaatctccatagggtccctgaggaccctccctcctgacctacttcttttgctgggcagcagctacccacatgcctgggggcggggatttatctcgtctgagccctgcaggtaccagtgctcttggctccacattgtcatggagcctctgctcttcaggaggggccacggtttccccagagaccatccaatctgcccctgggaggaaggcctagggcagtgtccttagaggagcgtagagagggcatcagaggccttgtctgcttctggtcacccgtttcccccactacgggctccagagaacctctcccgggctcgctgcatggctcagaaagaagagctgctggagctgggcacggggacgtagaaaggaaatgctagaaaactttcaccccacctcagtctgcctgcagcaccaggctctgcagacaatgacacagacaatgtccagggagctggaggccactgaccttcttgagcctcttggagttttctgggccgtgaagggagaaccagcttagcccggactgtgagctctccattactctgaggaacgctgtcttcgtatttctccgcctggggacaagaggcagagcttagggacaggattccccaagtcccaagaaccttctgggttcctctggttgtctcagcttcgtccacagatgcttccccctggcccctgcaaggccctgggtggagcaggtgtgtccgtggcaggactggtcttccttccatctatggtttcactcccaccctccccaaccccagcatggggaggaacagcttggccaccccagcgaaccagagccagatgagcctgaggaagtgaagggactcaagggcactgcacactccctaagacatttctacgaaaacccagacacagcctgagtttgaaaaacagaaatgaactcaagcctccaccccatccaccccacccaggtcagtagagattcacgctgcccttccatgccaaggactggcacagacactggggacagcatggggtgtagtctctgtccagagccacagggggtggcccctcagggtgtggtgagtctgaggacacctccctgcccaccgaggcacttctgtcatgagtggttttaccagaaagtgagtgaagagagggccgggaaagagatgagcctgaaatccacaccatccttctcccagtggggtgggaggagagtattgggaagagtctagagcagggtgtgtccagtcttttggcttccctgggccacactggaagaattgtcttgggccacacataaaatacactaacaacagctgatgagcttaaaaaaaaaatcacaaaaaaactcatgttttaagaaagtttatgaatttgtgttgggttgcattcaatgccatcctgaggccaagcatggtgactcatgcctgtaatcccagcactttgggaggccaaggtgggatcacctgaggtcaggagttcgagacc

SEQ ID NO: 12236 - DNA, 88459 bp, Homo sapiens
  misc_feature (1)...(88459): n = A,T,C or G, or insertion/deletion polymorphism (see Tables 1-2)
atcacttctgtgcaaaggttaaatttttttaataaattaataatggaatgtttaagccttcctcagtaatgagtataatcttatctctccatctgatctgatgggtcaactatatagtaactaaaatagactgtaacagctgtcttcatcattagtttttattttcaccatgcatgtagaatgctttatattgtagtcccttattatctgaggtttcattttctgatgtttcagttacctgtgttcaactatgtccaaaaataggtaactacaatgatattttgagagaccacattcacatataacttttattatagtacattgttataattgtcctattttcattgttaatatcgtactgtgcctaatttataagttaaactttatcataggtatatatgtatagaaaaaacatagtgtatactgtatggggttcagtattagctgtggtttcaggcatcctctgtagaggtcttggaatatatcccttgtggataatggaggactacatatttgactggttggtggagttaacctaaggagaccttttcatgactctttaaacttttaggtttaaaggttgactcggaaaagaaaaacaatttatatcaataaatctaaggtaggcttatatgaatgctgcatacttttcatcactgcagtgttgtggaatgaaaagtaattgtatggattttatactatacaacattaaactcatagttatttggaatatgagcaaccaggaaaagaaaataaccaggtattttgtttgatttacatagtaatctacttttagtagtcatgacaggatgaggtatggcattttaaaaaaagtaattcctagtattgcctaggtttggtactactcagattaggttacatttgcaggagtactatacaacaactgttcactttgatgaatctgaggcctttaaggttcagaactgctttccctatatcaatttttttttttcaaaaaaggctttacaaaataatttaacattgagtatttaattttacattgcaggtactggaaaatatttgttgaagaaattaattattccttaaaactttattattgagttaaccaaaactttaccaaatctcagtccttagctattctgttgcgaagaagtgagagtttactaccattaacaaggctgcagatgtacactgctactggcagaactatccctagagtggcaaaactctacatttcccaagggaacatatctgtgggtcatgttttgctttggagacagtagtaactctaggaggtgaacacagaacgttctacatatttagaaatagaaaaaagaaatagcccttaacaattaatcccacactctcaccctcattacctcttcattctatagatgctctcaagcttcttgtgacttttgttgcaagatgttgtgacatggcatctgactccctattgatcagcagggttaaaatcctcctgggttttcctatccacaatgttctgtgaattgctatatttaaactagcttttttttttgagacggaatcttgctctgttcccaggctggagtgcagtggcacactgtagagtggcaaatgaagacatatttatctgatcctctgatatgaaatcccctattaataaacacctttcttaaaagtgctatataaaagtatgcttataataggaatgtttcctttaatttgtctagaattgaaagggaaataggcaggggggttcaaaaaacaaaagggaaattgaaggcatccagaaacttattttatttttgagaccgagtctcgctctgtcacccaggctggagtgcaatggtgtgatctcggctcactgcaacctccacctcccaagttcaagcgattctcctgcctcagcctcccaagtagctgggatgacaggcacctgccacggtgcctggctaatttttgtatatttagtagaggtgggatttcaccatgttggccaggctggtctcaaactcctgacctcaggtaatccgcccgcctcggcctcccaaagtgctgggattacaggctgagccaccatgtcctgcctaaaccaacttttgtgaaatggctttttaaggtaatgtcatgaaccacttcattcctctgccagggtcttatttaacccttcaaaaacatgggtgggccctatataatgtgacttcattctacattggatccccacaaagctagtcttggcttttcacttggaacatgcccaatgctgatacaaagtaaagattcactatagatcttattgctatccatcgtacgttataaaacttgtctaaatatttaaaggtttaaaacaagcctgcgcagtggatgtcaagagtaaagtacgtttcatagtaaaattaaaatgccattaaaattttgttcttgtggggctgggtgtggtggctcatgcctgtaatcccagcacttgaggaggctgaggcaggcagatcacctgaggtcaggagttcaagaccagcctacccaacatggtgaaacccctgtctctactaaaaatacaaaaataagccaggcatggtggctggtgcctgtaatcccagctcctcgggaggctgaggcaggagaattgcctgaacccaggaggcggaggttgtggtgggccgagatcacaccattgcagtctggcctgggcgacaagagcaagactccgtctcaaaaaaaaaaaattgttcttgctttgtaaatgctgctttcttttcttcattttggagcggggagccttgccgatagtcagtgacttgtacatttgtttactggcatttgataggctgctccttatcttgcatgaaaaaataaagacctagccagtctaatcctgctgggattcatatcagtggccccagggggttgagatgcttcaaagctactgtttaaatggcaaaaccaagtatcttacttggataatactaaagtatgtcctttatggctttattggaatctgaattgtaaacatttggtacagtggattaaagttctgctttaaaattaatttctgagtatgtgagatatgccttttctttgtgacttttgcagtgcagtgaattcaggctgtttttaaaaggtcaagtttttaaaaggcaggggcattagtgctagggctgcttgaagatgaacagctaatggagaaatcctacagtgaaaggggttgtttttttttttgttttttgtttgtgttttgaggtgtcattctattgagtgtttatatatatatatatatatatatatatatatgtatatatctccatcctaattgttggcataacattaaaattagtgacacaacacaggtttcttgtataggttttcagaaactagcagtcctcaaaataacagaccaagcaatgtagtttttgctaatggcacttgctgtgactcatgatagtctactgttgatgagcattccaactaaaatagctttcacttcaccattgattaacatggctaccttgctaaaacattttctgaaaccaaaagctagagtgatcattcatagcattgtcttattaaaagactatgtcatactgtatcgtagaaaaagccattctgggtagtaggatttgcttcctggtctattaggttatctgttctcccttctaacttgaggtaatgtctgaaaacagtgccattcaggtattgcttaggtaactaaaccagtgaaaccagtgaaactgcctttatactgttaccaagaacagcagactcccattaaaaaaaaaaaaaaactcttattaccctactcaaattattcatctttaaaaaggcatagggtttttttttaatgtttatcatcttgactttttttttctcttgaaaatttttggattaatttgaagatcatttcaaaatgacccaggatatcacgatctatttttcctcttcctaaattatttctcaaaacagtgtaatttctatgtgtgatgacgtagcagtcactaacaacctcagcgcactttttggttagatattccactccaaatagctaaaatcaactgcttttgggattctaaatgtacttaaagttacagggtctgtatgaaaatgccagacactaattaaattttggtggcccattcatgatacggctcttttatctccggattctgagattgaaaaggtgacttgatcaagctattgaattactgtaataaaacaattactcccttagaattttaatttagaatttgtctacttccaaaaagggtttaaagcagttattactagactggcattaggttatttcaaatgttgcggaacagaggatcttcgtgtatttagcttaacaatacaaaaagaaattttgcaagcataaatattcactcttacaacatggtggcaaggcttttctttgcagaacaatctttgccctcttacctgccagactcttctctcatgctcagtatgtgagacagttaagtaaagggaaaaacactaaaagcaactaaaatgattggcaaacttctcactgtaacctaaactgcttagcatacaaaattatcgtctacccaatagggttttatgtcctttaactgaaaaggacactaaaaataattattgtggacttgagcttttctctttcggcggggcggggggtggggggggagaatcacctctcttacaaagataaaaggcacagaactaacgtctttcatcctttattgtattggtgcgattatgaaatattattatggcttatactttagcaagaaagtaccaggaaggttattattaatcgacaatgaatgccgttgataccttcatgctctttgaagacaggatgctccggctttgaagcgctacatttctacattgctaacctacaggaacctatgttgaggtggtcccaccgaaatacacggctaatagttcatctctttcctccaggaaccttcaggtttttttttgtttgttttttttttgagacggagtctcgctctgtcgcccaggttggagtgcagtggcgcgatggaaccttcrrgttttactaagcatccttaccctaattatctaaatctttgagacgtaaattatttgatgtggctaaaaatcctcctgctagaatttaggtccaatcctttaatgttcggatactcaaattctttaacgaaactgatcactgagctaggccgacacaagtccgccaaaatgtccgcagaaacgttaagaaaagctgtcataaggccagcttgaaagacatcataaaaggccttcgctgtcctttgagttaattatctaacacccgaagagagtgccagttctagttagaatccgcgcgtcaggttctccaacagtcagaagggcttgtgtgagggcagggaagattttaaaccccgtttcaggccccctccctrggctgtaggaaaycacccactctgaagcccggcgggggaggagtgctgcagccagctgccgaggragcgctctgcggcgaggccgtttccctgagtcacggagagggcgggaggctgcgcccgtctgcccccgccacgtcctcctgtraggggctcagtcgaaacaggcagcggtcgcagggaaacgaagcggcacccgtcrtgcctcaaggtggcccaaaagcctcttcactcccaggagacgccgcatttccttaaaacgagctctccatttctggcagcaatcagccgacccttccccatcagtatcacgtgcacctggaagtacgtgsgtgggacctaaagcgyccacggaagtgacgtcggtcgccccgagtcgcatgatgtggcaaaatgaaaaaaaaaaagtggggggagaaagagaagactggcgaaagtgatgagtctaaaaaagtagtccctccggttcctctgtttccccccatgtggcgtcaggaagcgaggcaccgggcgcactgcgccccgaattcctgcgcccgccgcgcgcggcgctccgtggaggggtacataaggcggagggggtgaggcgactgggcggagttctgtcgccgggatccttccgctgggctcagccgtttccggagtctgcgctgcgcccggttccgccattgcggctctcctggcccctggagcctccgcccccgacccgagctctttcgtctgcctgccagtttcctgcgtccccggagaggatcctgctgagcccagcctcccccctccccttctcctcctctcccttggagagcccgggcagccactgccccgcagccccagtgacaggaggagaccataacccccgacagcgccatggcccagattctgccaattcgttttcaggagcatctccaggtgcggccgggcccgggctggtgagggctgtggagaaggtggtaggaaggatggaagacgctggagtctgggcccgagcagtatcggagctggaggggcgggggggttgtcggtgattggggtaggtggaggagggggcactatcttggaaagcttaaaatattaaatgatgtggggcttggatggaaaggacaggagttggggtgcaaagagctgcaaggaccaggcctggatccaaaggcctctcgatcttgcttcctggatggccagaactgcgcgtacaaactctctccccattttattcatttcattcatttgggtaggggagtgggagggggattctcccttgtttctaccagagcaaggattcttatcccctgggccagtgcggggctgtcaccttccattgctctcctctttccctcatcgtgtctgcacccaggagttgtggggcgggtgggttggggaggagcaaccttttttttccctccctctgcggctctcaactgagaaaggcaccttctccggtggtgggggttgggggtggtggtgaggcggtggcttttctcttgccttccctgaggcagtagggacagaaggtcactgaaagaacggaacgagggtagaatgggagaacgcatttcttagagctatgtcaatctcagagtgtgtgcggtcaaactccctaaggaaactcgcctccccttccccctttttttatttctctggggatgttgtggctcttaacccctctttggttctggaaggtaggaaagagtgatacagaggttatcttttagtcttctcgagtagtagcaggtagttttgaatatcttcttcaggatcgcatggaattgaacagagccctggggacagcacagctgctctgagacctgcagggctatttggtctgtgactggcttccctttagtaagttctagagttcttccccatggttccttatcctggaggcaacatattgttatctggcaacatgccagtggcgggcctaggcaggtgaccattggaaggcttcactgaattaaacctcttcagagcttttgattttcctgtgtcaccaatcctgttttttactgtagcttaaataatttattcctattaatttgctttcttcccaaatatccccttaaagaaacctgcctcagctcagtcgtctgaagggctaattccataatgacagrgaatgcagtggtttgacatgacactgatatcagtgacctattagacactttaccattgaagaccatttttatttacatttcccyattggcatagcatacataaaggattcttgttaataaaaggttttaacattcaggctataagtaacataatttcatatttctttgcaagtattaccatgtttgcactagcaaggacttattttcctttaaggcttgaaatgtaaagaataataaatttttacccataaaatgagttaaataatgcactttcctcagtcatytataattttcaaataactcatctgaagtaatggaatataccttggcaataaaaacacttttacagagggttaaaaatgttaaataacaaaatggacatttttttttgatcaatccaagtttagttgctgtggttgcttttgttaaagtggggtggcaaatgaatgtggagagttgaggggtgctgttcttaagtgtgaggggaaaacgsgggcttattttcatattaaactgcatctgaaatatctttctgcagacaaatgtttataaaccacacagagaatcaagtacagctgctctttattttccacgrcagatgtgtagctcactactaaatcttgtggtggttggagtaatagcttttcatttcttttaaagaggagacaagaattgttaaatgatcccaaagattcgaacccaaccttgtcacttattaaagacaaatttaatacatgtctgttttgtaactggatcaaagtttctgcagatgcttgaatgaagccattttcttctcaaataatttgaagattttgaatataaagcgatttgcaaattgaaaaattcagtcctctgtgttttggattgctatgtcatgcctaaacttaagcttgcttagctaatatgactgtgctccagttgattaattgtggagcccaaataactacagcctctttcatgataatatatctcctaacttcatatcattatctcctccctttttaaaaattaataagcattttgtttttttgaggagacagggtttttgctggaggtcagtggcaccatcacagctcactgcagccttgacctactgggctcaagccatcctcccacctcagcatcctgagtagctgggactacagccaygagccaccacacctggctaatttttgtattttttgtagagatggagtttcatgttgcccaggctagtctcgaatgcctgggctcaagcaatcctttgccttgrcctcccaaagtgctgggataataggtgtgaaccaccgagcccaactaataaggattattttaattggcatctttggtctttgacctctgagcttctaccagtttgctaagtagcagaaaactttctgaaacacgtaggataaaaactggaaacaagaaatggggaacttaagtgtgagtgtagagttaccttgtgaaactgtaaatgaacttatttttataccctttaactacattgtccaactgaaggatctcttgtcatcaaagcttggacctacagcaaatgaatgtgaatatatraagatttctcttttcctagactgtttagactgatagcagttaataaatgagtgcctatttgagcaagatactgttggaattgaagattctataaaaatcctaggctacatatataaaatattgcctgtgattcttaattttttggtgattttcaattttctggcacattaagtatctttaggccacttgacacattccattgtattcctagattctttgggtcttcaattaaaaatctccctaccctgttctttcccctttgatccatagatgcaggcatggaatgtgttgttgagtcaaatgttaggggttcttgctatagttagttcggattgtgaatagaaagcaatgctaagtactgggatttactacatgcttagttgtactctctggaagaggtagacttcctggaattatgcggcagtctcctgggaatagcttctaagtttaaaatgtatcatattcttcagaattttcttgatggtcagtttacccagcttaaagtgtgtggttaattttagtgaaagtgctttcactctgattaggaaataagacacagaatggtgtgtatgtagaacacaatcattttcatttgagtatttaggaaaattcacatttcaggaaccatggtagttgctcttgaacaattgtttctgaccataattggaatttgtaccttgcttttaaaagattccatttatatcgaatcctcagcttctttgcaaaattgttttttccatacatatgtttatatgttattcaaattatatttaacaaggtgttttccctgtcattgttaccgttgtggctttttctctttgagttattgtccagtagaactttcttcaatgatggaactgtctacyagctacatagggatattgagcacttgaaatgtggctgatgtgactgaaaaactaaatttttgctttaatttctttttaatttaaatgtaaatagccacatgtgacaattgactcctacattggactgcacaattataggccatgctgatgtgttttgtaagtttgaagatttatctcaccactcatgtttatgtatttagaatatttcgttagctaaaattaaaacactcattgttcaaaagttttaactgaatactgtctgtcttggaaagtggtggtgatgaacaatgactagcagcagacttcttgagaccttattatgtgctgtaaatttggctaggtactttcagatcttcactcaatccccccagacacctttctaaaaagtgagactcataaagtagtgggaatgctgtccgaatgggatgtgtacctgagtcttctgacacaaaatatttcaaagaaattggataattgaccttaaaaaaagaagttatacagtatcctagagtgctttttgtctgttggacttaggcccagagaggtgagttctctctacttgtttatagattaacaatgtggtatagtagacagaacagggagggctttaggggttgttgaaacaaatgctgtccaatagaaaaataatatgagccacatactttttttttttttttttkttttttgagacagagtctcactctgtcctctgtcacctagactagtgtgcagtggtgcgatctcggctcacagcaacctccacctgccaggttcaagtgattctcctgcctcagcctcccaagtagctgggattttaggtgtctgccaccatgcctggctaatttttccatttttagtagagatggggttttaccatgttggccaggctggtcttcaactcctgacttcaaatgatctgcccacctcgacctcccaaagtgctgggattataggcatgagctgctgctcctggcctcatataaataattttttaagttttctagcagccatattaaaagtgaaaaaacataaaattaattaattttgggtttttttggtagagacagagtcttgctatattgctcaggctggtctcaaattattgggctcaagtgatctgctcgccttggcctcccaaagtgctgggattacaggcgtgagtcaccatgccatgcccagataaaattaaatttaatatattttatttaacttgggatatgcaaaatattatttcaatatgtaatcagtataaaatttactaatgagataccttacattctttttcatactaaattttctaaatctagtgtgtgtggtttttttttctttttttttgagacaaagtctcactctgtcgccaggctggagtgcaatggtggatctcggctcattgcaacctccgccttccaggttcaagtgattcttctgcctctgcctcccgagtcgctgggactacaggcgcgtgctaccacgcccagctattttttttttatttttattttttggtatttttagtaaagatggggtttcaccatgttggtcaggatggtctcaatctcttgacctcgtgaaatgcctgcctcggcctcccaaagtgttaggattacaggtgtgagccaccgtgcccggctatgtatattttgtacttagagcatatatcaattcagaccctattttctttggaaatcctggtccgtakttagagttcataaaatttacagttagaaaggcagatttggggctgggggtagtggctcatgcctgtaaactcagcactttgtgagccaaggtaggagcattgtttgagcccaggaattcaagaccagcctgggtaacagagttaagacctcgtctctatattaaacaaacaaaaatgaagaaaaaggaaagcagatatgcaatacttcagtgatcccaaacatacttaagttttccagtaattgaatcacttactggttattatttaattttaattactttaaaattacggtaaccacatttcaagtgctcattatggtatgtaggttgtgacttgtggttaccatattggacaacacaggttaagtctaacctcttgcttttttttctctgggaaatgggcatacttatctcacaaagttattatgaggatctgagatcatgtatgtgaaagtactttacgtagcattttaggagcattaattattggctaaataatttttgtccagtacattttattcaggtatctcaaccaatgacacaatattcatttacagatccagtgttttatggtgtataagtatttggggttaacacatttacctaagatttgagtacttactgcagatgaggaactgtgttagactytagggacaaggtggtaaacaagatggactacaccttgcattcatgcttccattgatgagttggcaaaggctgtacacttgttattccaaccattgatgttgtctacttgattgtggatcttttatgtgttcgaacatttgatattgtgcacagtttaatacaaatattgatatgatacaaagttgattacactctgaaactgccccccaaaaagaaacttttaaataaatcttttattatgttccacgagtctcattgtgtgccactggtacattttaaattagggttccttgaacagacatatttgaaaaaaaaacttaatgaatcatatcggataaaatacccatatggaatgccggtcaggcgattgttagagttattgtatgtgttgtatgtgtccttttttagggtggtagtgttgaagtgaatcttctcacttagatgagcagtaggttcatggctgatattttagtcctgtatattagaatgaggctgtttctctaagttcatgcactatatgccatgccaaaactacttcatgaaataaacctgtcttctgagccacagcaaagtttacagctctgggtgtcttgtctttgcttcttggttaagtgcctatggctaatgctcttaactcaaaagatggctgaaagcttggacctaaatgtgttatgcaaaacccatctgtcagacttttgtgagtctcttcttttgtattatctccttaaattaagacataatttaagatatttttgtcctactttttttggggggtggggacagggtctcactctgttgcccaggctggagtgcagtggcatgatcaaggctcactgcagccttgacctccctgggcttaggtaatcctcccacctctgctccctaaatagctgggactacaggcgtgcgccaccaaacccggctaatttttgtattttttttgtagagtcggggttttgccatgtttcccaggatggtctcaaaatcccgggctcaagcagtccacctgccacagcctcccaaagtgctgaaattacaagtgtgagacaccaagccttgtcctatttttgaggcagtaactattcaaatcttaattgtcctgtaatctaatccataaaatcaaaatacatgggccattatagttgtttgagcacctattacgtgccaagaactgtattaaatatttaatgtttattatctcatttaattagcaagagaacccttgtgcttaggtcagattagccttattgtagagattgggcaactgaagttcatagtaggtaacttttagagtcacacagctagtgagcagttagacttttaatatttattctttcatttggctcattgcctcatttggtaaatggtctgtatcatttgaattgcaaaatgtaccacaattgtttatatctatgctgtgatgttctttgattctagyagtactgtcgtttgtttatcgtgaaatattttttatattatgagaaaagtaggagacagcaaactaacatctgactttatgccttgaatgattatttagctgtatcttttttaaggactttatcctgtttcctattggaaaattgtgcaggatgattgggatccggttaacttgtaaccaggattgtctgcatccctctcataagactgaacttgtcacacttttctatagactttttcttactgaaaagaatgagtgtgttccagtctgaagccacttgtgaaaggaggaaacttctgctttctattttactgtaaattcatgtttttgtgtttatgccaagaaatagaagcttgaactcaacgaaggcagttgtgcatgaaagggataggaaatgaaggtgacaatggaatatatttgctcattttgagtagcatcatggtagaaaggaaaatggttacagacttgtagggttgtgctttggaggcagactgccagtactgttaatacttcttgttcctaatccttaggtaaataaggattttcttcaagttctgaagtaagacggttttaaagattattgctgaaagaataggaaccagatccattaaagccatattttgtcacattaaaaaactctgcagtgtgctattctggaaaatgtctcagatgtttaatctgggcttatctattgattatgtcaggttttcaacttgtctcaacttcctcatttattaaaacaatatttcctggcaattttaaagttagactacagtatgtttttgtatttgtagtataatatttagccccttaaccccttacaggcactcgaatattagttcttcccctccaccctggaagagtttccctttgtccacttgagttgaatatatgtgccgtactaaaggagaaaaactaccatctacccagttattgaagccaagatcttgaagttacaccagactctctaatttctcattttctgcatccgtcgatttctggagttcctcagtgatgcacactgggggtctcagggatgacagtttttcatgaccctaggttgaaactgggagtcatagaagacgaaaaaacgagaattggattgggagttgactctgttgcccaggctggagtacggtggtgcaatcttggttcactgcaacttccgcctcccaggttcaagcaattctcctgcctcagcctcctgagtagctgggactacaggggcccgccaccaggcctggcgaattttttttgtatttttagtagagatggggtttcaccatgttggccaggctggtctcaaactcctgacctcaaataatctaccctcctcagcttcccaaagtgctgggattacaggcgtgagccatcgtgcctggccaacttgcatttatttctgattagctgctcatctgagaaaggtggcttaaaaaaaaccaccaaagtggacagactgaagctaaagactgtcagtatatatgctctgcttggcaaacagctgactttggatagatctcattatttaaagatgaataataagggggaaaaacgtgtagagagaacatggtttacaaaaacccatctctttctccagtctctgcaatattctatatttggtcatattgaactatgaaaatctaaggcaggtttctttattttaccacagatatcctcaggaaagagtctccttattaaaagccttactgaatctccatagtattgtgtcctctcacagttgcttctgttctgagcaccagaatgctgtttggcaaaggctgctgtaggcttgaaatcaactggattagtgagagacaaattttacacatctaaaattctcctgtgtatggcctcacagttggaactgttggatgttataagcagatgatttaaatatcccgtgaaaagcagtccattcgggcatgtttctagagatcataattttttttttttttttttttgagatggagtcttgctctgtcgcccaggctggagtacagtggcatgatcttggctcactgcaacttctgcctcccgggttcaagcggttcttctgcctaagcctcccaagtagctgggattacaggtgcccgccaccatgcctggctgatttttgtaattttagtacagatgggatttcaccatgttgtccaggttggtgttgaactcctgaccttgtgatccgcctgctttggcctcccaaagtgctgggattacaggcatgagccaccacacccagcctagagatcataatttacatagaaagataagagaaaaacaactctcctgataacgcaaatagatttgatgttacaaaactgcaccattatgattgctctgtaatggatttttgaaaagcattgtgaaatggagatgactttccagtgctgatgtcaaaaatgcatatgcagagtttaaatataattttgtgtgttttgttttttgagacagggtcttgctctgtctcaagtggagtacagtggcgagatcatggcttaccacagcctcaacttctcaggctccagccatcctctcacctcagcctcccaagtagctaggactacaggcgtgtgccaccacacccagccaatttttgtatttttttgtagaaatgggctttggccatgttgcccaggctggcctcgaactcctgagcccaagcaatctgcctgcctcggcctcccaaagtgctgggattacaggcaggagccactgtgcctggcctaattttataattttaaatgtctgtaaagtaagcaaaatgactagttgaattgtacattaaatatatctaatccctaagagtttataatgraaagggatcaaaactttttcaattgcgataaaactcacataacaaaattaaccattttaaagtgaacaatttagtggtatttagtgcattcacagtgtcgtgcagccaacacctgtatctagttccaagacattttcatctccccaaaaggagaccccatacacgtgaagcagtccctctcccatccccctcctcccatccgctagcaactgctaatttgctttttgtctctatggatttacctgttctggatatttcacataaatggaattatacaataaaggaccgtttgtttctaacttctttcactaagcatccatgttatagcatatatcagacttcattcctttatgactgaataatactttgctgaatggatatatcagtgttttatttgtcctttcatcagttggtggacatttgggttctttctaccttttggctattgtgactagtggtgttgcaaacattcatgtacaagtttttgtttgaatgcctgttgtcagttcttctagatatatacttagaagtggaattgctgggtcatatggtaatttctctgtttcaactttttgagagaccacgaaaccgttttccacagtggtggcaccatttgacatgcccactagaaatatatgagagttccattttcttcacatcttctgacagctttttggggtgttgggatgattcgtctaattgggaaaataagtaccttatttgggcctatatggtatttttaattctgtgtgtctgctcccaaactctgtagccctgccctcccttatattgtgtatcctgtttcagattgtttccgtttcttctgagacactgcatatacccctacatgtatctgtgctaggcatacatccctgtaacttcatggcatttttgtaattgctgtgtacctgttacgtatactgagtgggagtgtctcatttgctgtagaactctctgcattagtgtagtgtctggcacacagtagctgctcaggcattttttaagtatatgattattgggaaaactacagagctagggagagatctgaagaaatactagaaatttttttctgcaaagaaaactttagaaaattgttgacatcatctgtggcatgcagcaaaagttgatgtaaaaggaacagaaagacctatggagataatgggatgtaataacagaaaacatacakaaacaattggttctgaaatcagttaagagcagaactggaattcatactctgtggaatgaatcagcaatgtggaaggagtaacaagattttttaaaaagattttgaatttaggctgggtgcagtggctcacgcctgtaaccccatcactttgggaggccagaataggtggattgcttcaacccaggcattcgagactagcctggacagcatggcaaaaccctatctctacaaaaaataaaaaattagccaggtgtggtggcatgcgcctgtagtcccatctacttgggaggctgaggtggatggatcacctgagcctgggaagtggaggttgcagtaggctgaagtcatgccactgcactcaaacctggcggacagagtgagaccctatctcaaaaaaaaaaaaaaaagattttagtttagaagtaaatcccagaattaagtaaaagtggtgtgtgtgtgtttgtgtgtgtgacagaataggttacaaatttaagaattttagaaaccgggctgggtgtggtggctcacgcctgtaatcccagcactttgggagggtgaggcgggcggatcacgaggtcaggagatcgagaccatcctggctaacacggtgaaaccccgtctctactaaaaatacaaaaaattagctgggcgcggtggcgggtgcctgtagtcccagctactcgggaggctgaggcagcagaatggcgtgaacccaggaggcggagcttgcagtgagccaagatagctccactgcactccagcctgggcgaaagagcaagaatccatctcaaaaaaaaaaaaaaaagatttttagaaaccaaaataattggaatggaagctcttttcaatgaaagaaaacttttgtaatttgaaaraaccaaaattaaaagggcttagtgtttggaacaggcctgaagaagttgtaataccatgaatttaaaaaaacaaaacaaactcgggaggccaaggcacaagaattgcttgaacccaggagccggaggttgcagtgagccgagattgcgccactgcatgccagcctatgcgacagagcgagactctgtctcaaaaacaaacaaaaaaatccctaaaactataagcatctagggcacatcctcttcctgaccaaaaaaatcaaagtaatactagttttttaaccctgaattttagatagtgaagcagtgtctatagtttttgagatggaaagtgtcttcacttgtttttagaagacatgaatcacaatttgaacccccaaagagcctctgagagcctaaaacctgttttttctcctataggttgtttcctcactagtaatgacaaagttataatcttagcacaaaataagcaaaggggacagtttcacacaaaaattgtacttaaaatattgagtttgtgttaagttgctaaataatggatgctcaatatgtattaattgaaagcaaatcatggtggttgtcattttaatcattttaatgtcattttaatcattttaatgtcattttgaactccctgaatttgttaatattaaatcattttgagataatctgtaactcctcatgctgattgttagttaattcattcactcatttgaaaacagtatttgtggcatttaagctcacaggaaaacactccaggctgggtgcagtggctcactcctgtaatcccaatactttgggaggccaaggtgggtggatcacttgagatcaggagtttgagaccagcctggccaacatggtgaaaccccgtctctactgaaaaaatacaaaaattagctgggcgtggtggtgcatgcctgtagtcccagctactcaggaggttgaggcaggagaatggcttgaacccgggaggcagaggttgtggtgagctgagatcatgccattgcactccagcctgggcgacagagcgagactccatctcaaaaaaagaaaaaaaaatactctagtgactcaattgtaaaataaaatggttctagtcttataacttgtagcacctggtagactgagtatgccttaaatgattgatctaactagaataatgtgggatagagcataatgtctaatttcctggcaggtccctcagtatagggtagaaagataacatgaatatgtacaatagtgatggggttgacagaatgtaacactaggctcccacttaaatgtacattttgtgaagtcgctgggaagttgtgtcatagaatgaagtttatcaaggatctttataacttgaatattaaggagactgtccagatgttttattcatatcaggaaaccaagcctttaatgtctccctggttacattcatttataacatcctttatgctaagtcagcaataagtattatatatattttttgagatggggtcttgctctgtcacccaggctgaagtgcaggggtgcagtcacagcttgttgcagcctctgcctcctggactcaaacaatcttcccacctcagcctgccaactagctagaactacaggtgcacaccaccacgcctggacagtttttttattttttgtagggacagggtctcgccatgttgcccaggctggtcttgaacacctgggctcgagaggtcctcccaccttggcctgcaaaagtgctgggattacaggcatgagccactatgcctggccttgaaccctcaaagtaagcccatttggtaggtttggatatattctgcacaacttctcacccctgccattgaatgtagctgtggttgttttgtgctgctgaattgcatttatacggggggcataatcttggtaagtcatatccatctccaagatttggggcataaaaactcctgtatttccctgcagcttggttaacattggcctaattgatctgatatcatctaattattggcttattttttaagaatgcattaaatataaagtttttgaaaatttccaatcagcagttgattacaagtaggaaaaattctttgagtctcctggtagtttaccaaagctaataatagtctgacaacctctctccaactgtggttgcttcctgaatatattgcttaaatttggagtttgtgaccagaatcaaaaattctaagagccagtgattctctcaaaggctaacatggagtagaaaaaaactatatgtttaaatgtggggacagcaagggttaaaggcatttttatttgttgcttgaaatctgtggagcctacagaaaacagtggttggtatcctgttgatggaagaactaaaggaatgctgcattctcagcatttcttatttcctgtagaatacagcaactgcagtttttatttgacattctgctagtttccaggaagggctcaatgaagtgactgctgtcagcatcttttttcaccgcgactgatactagagaaggtagaggatgtttaggagcttttaaaggaaattatgtttagtgaaatacttgggttaggaagttaaccaaatctttaagtactgacttaaaaatgcttgtattgagagatgaatggtatcagaatgacatacaagtatcagcaggtctctcagattgttgacctattaactctacagtggtaacacttctaaagtccttggtaagatacaagattcatttgcagaaaatagctccatctgaaaaacagtagctcatacatacttcctttacattttccctattcagatgaaacaaggaggatctggaaaatgtgaagccaagcaataattgtgaaacataagtccttagtaatgctgtcataaaccagttttcatgtagtttgattttcagctgataaagctggtaaatgagttatactacaaatctatgattcattaggaagcaaactccttaggtatacttacagagaagccaatttccaatgagtttattcttaactaatcagatgtgagaactgctggttgaaattagtaggctcaaagcaaacctattactcctttaattatgtggcgtctgtaggcacaaacagatagattatgaatgattgctgagagtgtgccttggtgctaatggagagttgtctttagatagtttaagaattgggccttgaaaaaattatggttttatttggttgtatgtcttaagctagcattttctgcccttcttaaggtatatagtattgaattaaatatattaataggaccatggcctctttggtcctcttaacaatattttcatagtttgatcactaatatattctgttaagatgctcatacaacaccattaagtttcctgattccttgatgtatcagggtttccccattctgtctttaggagcatgtgaacaaagcgaattggcccaggtaaggtttgagtatataacagtagcatgatgctaaaaccagtctgtttaagaacagtctatatcggccaggcgtggtggctcatgcctgtaatcccagcactttgggaggccgaggcaggcagacacctgaggtcgggagttcgagaccagcctgagctactccggaggctgaggcaggagaatggcttgaacccgggaggtggaggttgctgtgagccgagatcgtgccattgcactccagcctgggcaacaagagcgaaactacgtctcaaaaaaaaaaaaaacagtctatatcataataccatagtcccagaactagaagttcatcaaataatggagtgctctgtgctcccacactaagtgcttgatgtgtgttaaatcaccttaacctttcatggagcacctaggcatgctgctttgctccctctcaagtaaggatggatactttttttccctttccattttccatatttacaatcaaatggagtatatttttaaaaccaagacaggaaaaacaaagtttaaaccattaaaaactgatgagcattcaacgtagatttctgagtctcattgctgatgtgttttttatttttattttttatttttttggagacagagtcttgctctgacgcccaggctggagtgcggtggcgcgatctcagctcactgcaacctctgcttcccttgttgcccaggctggtcttgaaccgaactcctggcctcaagctatcctcccatctcaacctccaaagcactgggattacaggtgtgaaccaccatacccagtcttgtatttgcttgtatttgtttcttttgcttaaacattttaaataaagtcaggctatcatattttacctgtaaacacttcagcttgcatctttagaaaataaggacattttctttctttttctttttgagatggagtttcactcttgttgcccaggctggagtgcaatggcacgatcttggctcactgcagcctctgcctcccgggttcaagcgattctcctgcctcagtctcccgagtagctgggattacaggtgcccaccaccatgcccggctaattctttttttttttttttttttttgtatttttagtagagayggggttttgccatgttggccaggctggtcttgaactcttgacctcaggtaatccacccaccttagcctcccaaagtgctggaattacaggaatgagccaccgtacctggccaggacattttcttataatcataatattatttatagctccctgatatttaagaacaatatcagaaaaccagtccatattcatattttcctcattgtccctaaatgttgtttggtttaaatcagaatccaagaaagctcatactgctttcagttatgtctctgaagtttcttttcttttttttgagacggagtcttgctctgtcgcccaggctggagtgcaagtggcacaatctcggctcactgcaagctccgcctcctgggttcacgccattctcctgcctcagcctcccgagtagctgggactacaggcgcccgtcaccacacctggctaattttttgtatttttagtagagacggggtttcactgtgttagccaggatagtctcaatctcctgacctcatgatccgcccgcctcggnnnnnnnnnnnnnnnnnnnncaccgtgcccagcctgaagttttttaaaaaaaaaaaaaaaattttttttttagccgggtacagtgactcatgcctgtaatcccagcactttgggaggctgaggtgggaggatcccttaagcccaggagttggagaccagactgggaaacaaagtgctgcctatctctacaaaaaaaaaaaaaaaaaattagctgggcatggtggcgtatgggtggtaccatctatttggaaggctaatctattatcagtagttaaaagaaattcacacccagagtttcagccaacctatggacagctgaattaagcagcccaggaggttgaagctgcagtgacccatgattgtgccactgaattccaccctgggccacasagcaagaccctgtatgagaaaaaaaagaattggaagtcctaaagtgtaatttccttttctcctcacttccccaacaaaaacaaacttwaaaaaaaaaaaggcatttcatagtgtctgaggcagttaagcacccagagaccactaatctagtatcagtagttgaaagaaattcacacccagagtttcagccaacctatggacagctgaattaagcagataataaaatgcaaatgcaaaaaagctaaccttgagctggcttaaagtactgatatgttgtatgtattaatagttaatatcagtgagctctgggttgcttgatcccaggagtttaaggatacagtgagctgtgatcacatcactgcactccagcttgggtgacagagcaagaccctatctcttgcactccagcttgggtgacagagcaagaccctgtctcttaaaaaaaaacagaaggcaatatctgttgagctgttagatgtcaggcattgttctttgcattcacattaaatcttcacacctctgagatagatactgtcatctcaaatgtttcatatgagaaaacataaacacagcctgtgttctctagatcagtggwccacaacctttttggcaccagggaccagttttgtggaagaaaatttttccacyggttgggggtgggagtgggggtgggatggtctcagatgaaattgtttcacctcagatcacaaggcattcgttagattctcataaggagtgagcaacctagatccctcgcttgcacagttcacaatagggttcgcgtgcctatgagaatctaatgccgtggctgaaatgacaggaggtagagctcaggcggtgatgactgctcattggctgctcaccttcttctgtgtggcccagttgctaayggaatactggtctgcggcctgtggttcgggatccctgctctagattatggggaagccgaagtactattttctcattataaaaacagaatcctaccttttactccccacctccccctgttaatagaagttggaatggagaaggaaggagatgcattttaaaatcatttgtaacatgtaactccagggtacttcagagttttaaagaataaatagggaataaatttgtttaattgcctttttagatccaggtttaggtgtcaagtcctaaagtagtgccacttgcagaccaaaatcgaatctggaaaccaaatgagttacaaagtttgggtgcttttctgtaaaaacaaggaagcagtttatttgtatacttttgtgtcttgtgccattctgttggaaaagggcggaggaaatacatactttcatatgctacaggataactctgaaatgcaaaagtatctctaattgcttaggggagaagggtattactggaaagacggggtgggtgacttttcatagtataaccttttgtaagattttagtgctttactgtatgcacrtgataactattcaaaaaaacaagcccctttttttggacccagtttattgactccatattcttataacagcaaaataaaaattcttttaagttaaaaaaaactttatcataggaatttccaagcatatgttaaaataggatatctccagcttcaacactaatggcattttgcagattgagaggataataaaatgtagctgtagtttggatacatgtatccagatatattacatgtatttcagatatgtcctctgaaaatacctgcaagtttatagagaatgttgtatatgtcctttgactttatccatgcttagttccatagtgtataattcagtttatggctgggtacagtggttcatacctgtaatcccaacactgggaggtcgagctgggaggattacttgagcccaggagttcgagaccagcctgggtaacatagggagaacctgtctcttaaaaaaaaaaaaaaattagccaggcatggtggcgcctgtagtctcaggtactgaggaggctgaggtaggaagatcacttgagcctgggaggtcgaggctgcagtggtaccactgcactccagcctgggcaacagggcaagaccctgtctcaataaataaagaataaaaatacaattcagtttctgtggtatagcttatatgccatcacacctttataactgactgagaatactttatggttactatgtgctgttttgaaaataaaacctgtttaaaaatatgttgcattttaaaagttttaatctatattgatattactagacatagttatatagtttggccaccctgttacatgctcctactgtaagggtatacctaaaccagacttgcagttaataagagtgacttgtcctattattgtgtgctttggcatatttctcttttgagtatataacaggaaaatatgggaagaattgctgagtgttctagacattctcactcaaaaggaacatcagtaaggaaaacaatcttacctaccttatttgaagaggtggaagcaaatttaaccttctsttagccaatacggtcacttgaagttcttttttttttttttgccaaagtcttgctctgtcactcaggctggagtgcagtagggcggtcttggctcactgcaacctccgcctcccgggtacaagcgattctcctgcctcagcctctggagtagctgggactacaggcgtgtgccatcatgggcccggctaatattttgtatttttagtagaaacggggtttcactgtgttagccaggatgatctcgatctcctgacctcgtgatccacgcccccttggcctcccaaagtgctgggattacaggcatgagccaccacgcccagccgaagttcctgtctttttttcctcacaattaggaaggctatataggaaggagcagggtcctgttcagttgtgtaaatgaccaccacttaagtgtgcttttttaatatgtttaaacatgtgccattattaagaatttgacacggctggacgccgtggctcatgcctgtattcccagcactttgggaggccaaggcggacggaacatgaggtcaagagatcgagaccattctggccaacgtggtcaaaccccatctgtactaaaaatacaaaaattagctggacgtggtggtgcacgcctgtagtcccagctacttgggaggctgaggcaggagaattgcttgaactggggaggtagaggttgcagtaagccgagatcatgccactgcattccagcctggtgacagagcgagactcggtttcaaaaaaaaaaacaaaaaacttgcaacttcagaattatgttcatgtttgctggtgttttaactcaaactgggacataaatcctagggaagtaacccatatcactgttgttctaataactgcattcgtagtagaataacactacattcactagtagaggctgagggagagaggaaaagaaggaattacaggttacaggctacttttctgttcttgtctagactgaggctgactgacttgtctagactgaggctgaggcaggtggaccatgaggtcaggagatcgagaccatcctggccaacatggtgaaactccatttctactaaaatacaaaaaattagccgggcatgttggcgcactcctgtagtcccagctactcgggaggctgaggcaggagaatcacttgaacctaggaggcagaggttgtagtgagctgagatcgagccactgtactccagcctggctggcgacagagcaagactccatctcaaaaaaaaaaaaaaaaaaaaaaaagagtttgtcacttgcctcctgtttaattttgcattttttaaataaagtatatctattccacatggactattttgattagtaccaatacattcctgaaggagatcaaagatatatatgcatagctctcttggtagcatatgtttaatgagaaagtaatataaggattacatagattagggttgcaggcagttctgtcactttaaagccagatcttttatttaccttattttttaaagtttttgcagagatggggtctcattatgttgcccaggctggtatcaaactcctgggctcaagtgatcctctcatctcagcctcccaaagtgctgggattataggtgtgaaccaaggtgccaggccaaatctttgttgtttttkttttttttttttttttttacaagtaaaataccctgaggctgaaggtcattgctaactgatgcagcgtgtttttcttactgctttttttctggggatctaacaaggaattggaaacacaggtttttgactttcctttttcctcctcattgttttctgatagtgttttcttaaagtcatcttccacctgcctctgaagttgagaagtaggaaggaatctgttagaatcacttggggttcagttagtagtgtctgtggtttgcttccttttgtggttttgaatttaatttcactatttgactaacactatttttactccgacttcctcaaacactgtgggacttaagctgtgacaggtgaaactcagtgccttagatgaaggcttggtagagacttagaaacatagaattcttacagggtagcttaggattcttacaksataacttactgcttttaggtatatagctctatgaactttatgagcccactggaatgttttctccaattatcggaaaggmtaattatcaattaaacttaaggagtctaaggaccctctactcagaaaaatagatgtgagatcctgtctcaaaagaaaagttaaagtcaggaagaagttaaaattaatggtttataaggctttactataactaaatacattataagttacatactttaaagctagtgtatttgccttgcattacagcatatacttgagcttgtaaagcaggttaatctactttattacgatgtttgtattaatggttagagagttgtttgacttcttgcccctatattcagtgactgagttactgtaactacactttataactgagttataacattaataacttaataccagtagtaattgagatagaagagtgaagagaaagtaaaatgtagccttgtagtcttatgttatatcttattcagagcctggcctggttatgtttaagcactattagcagaagagtttcagaagagaatttaaataaaatacagttaacttggctggtttagtccataagataatagtgacagtggtggtgtttgtggaggaaaactgtattgctagaggacaagggtgacagaaagacttgatttttttttttccatgctttttcttttctggggkgtgtgtgtgtgtgtgtgtgtgtgtgtgtgtgtgtattttgtaccatgcgaatttattatattacctttggaggaaagggggataaaactagtctggccaaggctaataaaataaagcctccatgtagcttcttttagtaggacttaatctgttacaacatagttagtcacccagagtattaataacccactatggtagagatttcttcctagtaacaagtgacttttgttcttacatacttaattggtttgcaaagacctaccatctttagatccactatatttgtttagcagatactttagtattttctgagtacacaaagcaaatctaattccattattttccttgttaaaatccttaagtagctcccttcgcctgtagaataaactcaggattcttactgaggtatgtttagcttgttggtctggcccttgctcatttctctaaccttaattgtgtactccctcaatcctatagtgttacaaaagtacttgtagttcccttagccaaccacacttttacgtctctgtgctttaccacatgctctttctgttgagaattctctcgcctgcctcctttgaacacattgctttagctgtgtagcctttgacaagatccctcttacatatctttgttttggcactttttgcacagaattagaacttgtttgctcttgctattcaagttcctttatttagatcaagaattctgtgacattttagatctttttatgcttgtaacttaatttttcagcttcttgaagcgtgaacaaataactgctacatgttaaggggggtgagagaggactggtccaatagttccaaggtcttaaaataaatcaagaaactcaattacctcaaatcccttgaaccatgcatgctaccttgcagatgttgctctttcctttaacttcatctgtatttgttctgcctcttatttgaaacagttgaatggcatgtttgtttgaagaagagaaggtccaatacttggctattaatagtctctctttaattaacataatgtagatgttattgtgaccttgaagcattaatgttaagtgaggatttgtgttgatgagcatatatgaatgtcaagtctttggaatccacttggtaacatggtttcttattattttttctagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaaggtataaaagaatgtgggttttccttaaaactcttcctatgtttttgtttttttttgttttttttttgtttgtttgtttgtttttgagacggagttttactcttgtcacccaggctggagtgcaatggcacgatcttggctyactgcaatctccaccccccaggttcaagcgattctcttgcctcagcctcccgagttgctggaattacaggtgcctgccaccacaaccagctagtttttttgtatttttagtagagatggggtttcactatgttggccaggctggtctcgaactcctaacctcatgatccgcctgcctcggcctcccagagtgctgagattacaggcgtgagccaccacgcccagccagctcttcctatgtatttatgcaagtacaataactagggtttacctttttaagtatattgattaagtttggttaaagaaaatagatctgctaataccgaacttgatttaaaccactttaattacttttacttggaatgtatctgtggaatgtcttaacatatatctacttagaataattttaagttttagaataaatgcatttaaattttgtatctggtataaaactgtgctaaacatatctctctacagaggaaagaaattagtgattcatattctggaatagaacatactttactaatattagcacctaaacattgcagaattttgttatgatgataaacttgcctttgattctgtgcttttttttttatacttcgggcttgtgtttcacttagattattgggttctagaaatggcttgaatttacagtaattgtttaaagtgtgtttgtatttaggtggatattaaagctcttgagtgaagggtatttgagtttattcagactaactttttaattgtcccaacaagggaactgtgcagcttaagtctaaacagagttcaaagactcttagactgtcacggaagctgtattcctttgaactttagaatgagactaattgaccctttaaaacagatgtttttaagagggctcggtgacaaactgactcttaaaaaggcattcgattgcctgctttgtttttcattttgatagaagaaagaagagttcaagttcgcagtaatttgttgataaatttgtgactaagttattagaggtgctgaactttgacttttctttacatgatttaaactttgtatatagtaataatactagttggagagtgaatagggttgggtaggactaggatattcaaacaaataagtcactatcacatatctaagatagaaactcatctcatctcgaggaaaaatggtccagctttcacataggaccagatgttttgtgacagtaagtgttttacttctattacttctatttagggtattaagcttccttcagactctttaaagaatttaaattcaggtccttagcaattcccatgcctctctattaaaaggccatcattttaattttgccaaaattcttttctatttttaatgttattgttatcttatcacatttcttaatgctttcttatgtgtgcagatggtgagttatcttaaattagattgtattagttattgtcctgttctataaaaagaataaattgaaaagattttcggagcattgtacaataacatcatagatttgtccctatatgtctgcactatggagtcaagctgtcatcccttgtccccctccccaagaccaccccacttatgtatatattccaacccctaataatctgggagttgaggaaggcagcaaaggaaagtaagtcattccaaaatactgcttccctctgaagccagttttgaaccccttggcttctttttataaacaggactgtaactctcacaatttttcaagtctggttgtggtttacatactgtgtgggatgggaataacattcttcattttatgaaagaaatttttgcacatgtgttacggagggttgtagtacaaagctgtatgttttgccccccttctttgtccccccagcacccgaatcttaaaattttggtccttcaggagccagattctctgtgtctcaggaatggtgtttttcttagtctttaaagactaatcttgatagcctagtgatagttgtaggctttggcctctattaatttataccaaatcacattttgaactgatggatttcaaactacaagtacaagcctttgcatctgactcagtggactcttaacactcaaggcaaatttcatccttttttaactaaatgcttgctttcttaattggatgaagcttgcactttgttcttatctccagtatattaacagcatctgaaactatcctcttcctttgtctccctctcctttcctccagcacctctaccttccctttgttatcttaagccggttaaatgtagcaggcacttctcttacgtgctagtggcaacaagacagaattgaagcagatcctctttttaaaaagcagtttccacaagatttatttagatgagagatgactgcctttaaaaaaatacattttctttcccccatgtgtttgttatcagagttgctttgtcttgtgtacatgcaactaagtttatgtgtaaagtaaacatacttaattacaagtatgaaggtgacagctttgttttcaattattgttaagaaaactattcattaggcttattttcagttgggatttagaattccatggaagtcatactatctgtttaargtgtgtttattagaggtaatgtagtttttgcttaaaacgtagatgtagattgtttgcttagtcttagctgttacctctttaatggttgctgctgtatcgatgcaactcgtctcgtaatagaactatttttgtttggaagtgacagagctagtctaggtaggtattcattctaaactttactcttttaatgatttataattcttgattttgtttttagctgggaaaactcttcagatttttaacattgaaatgaaaagtaaaatgaaggctcataccatgactgatgatgtcaccttttggaaatggatctctttgaatacggttgctcttgttacggataatgcagtttatcactggagtatggaaggagagtctcagccagtgaaaatgtttgatcgccattctagccttgcagggtgccagattatcaattaccgtacagatgcaaaacaaaagtggttacttctgactggtatatctgcacaggtaacattttaactakttttttatgaagaagaggtttagaacacggttgtgcccagaatgcagtttgattttgaaattaggtctttctatactcaatcctgttgaatttcacttattttggaagactttttttttccttcctcccatcccttctcttctccttcctccctcccttctcttcttcctcgctcccttgctatactgacatataatttcagaatgctcttaccaagcgtttttagctcttctgtggagattgagtagaaattgagtttctgtaagaatgatttgggatttattatggagtatttactgcagaatgaatgcttctatacctttttgtttaagacgtatatgaggcatattttaaacatttatgttaggctttaacaagataatgtttggggctgattttaagttaagaagtatcaaatctacagtgagagatgaagtracaaataattataaatcctgctaaagatgacaaagcattctaattatttcattacttgatgaatctgagagtttttgatttatgggtcttcaaacgttattctctttgatcctttatagcaaaatcgtgtggtgggagctatgcagctatattctgtagataggaaagtgtctcagcccattgaaggacatgcagctagctttgcacagtttaagatggaaggaaatgcagaagaatcaacgttattttgttttgcagttcggggccaagctggagggaaggtaagttttggctttggtaattattttaatgagaacttgtatttggctttctgctatgaattagtcatctaatttcaaaatagccttctcccttcctaagtaattttagtattcacatttgtggtgacttaatttgttcaaattttgcatctagtgatacttgtctaaaatgaataatgttctttcacaactcgttctgttggctgtttatattctttgattgctaaagtgcacatttatatgctgtacatctagagagtttgatttagtaggtgttgcctataattttttttgtttatttgttgctttttgagacagggtgtcactctgttgcccaggctggagtgcagtggcgcagtcatgggctcactgcagcctcgaccttctgggctcaagtgatccctctgtctcagcctcccgagtagctgggactacaggcatgtgccaccatgcctggctaaattttgtatttttgtagagacagggtctcactatactgcccaggctggtctcaaacctctgggtccaagtgatcctcccgccttggtctcccaatataatctgcattttaaataccttatatggcttgatatagaggcaatgtagactacaggtgaataacactgacttaagttagaggttttcaaccatgactacacattggaatcgcctggacagattgtagtactttgtatattagacttagttgcaggtaatagaaacaaggtctggttgattagagcaatggtctgtttagtgaaggatattggatagtttacaacagctggggaggctgtaaaaccaagactgggaaatgaggagaaataatggaaaatgagcagtggtcagggtcccagccaacaactattccacagaactctgaggacacttctggatccatgattgcatttctggatgcttggaaattygatttgactactatttccactaccagagtagcatctctgaaatcctaatacttttgtgttcctagctccctgttcaaagtctagttttaggcaagatcagatgcccacatcttatgtctgagaggtttggaaataattatttggtgtttggtgctcctaaaacagaaggctggttctaccaccaacaaaacttgtaaagagtatcttccctcttgttgtcccatcaggaagagggtttagattctaggcagaccaaaaaatttgaacttcacttttgttaggacatgtgtctctctctttgtaagtaagcagtttttaaaaattgagatagagattgcttaagatatcatctgtagcctgtcaggagagaggaaacagtaagtaatgacatacaattctgcttaaaatttcacgatagcccctgaattgaggataatgctaccaacacctcaatgtgacagtggtagaaagcactgatatttagatctgaatagatgaaatttaaacagaaaaaaacacatagttttagaaattagatattatccttaaaacataaggccaggacatttattgaaaagttctactagaaaaaagtttcaatgtcattttgaacagtatctggaaacctgtttataggttattgagcctattatttcatacatggtgctatcctgtctgccatggcttttgaaggaagataccaagtttttcagtatggctagtcatcctaatgaaggatgatgagaccctataacattcatatggtatgtgtcttggaaactgaatttttttttgtctgagttcatttctggcatgactaaggaaaatatatagtactttttcattgagattatttacttttctcttgcctggcttatgtgcagcattggatattttaaaccaaaatgttctcatttagtttatgggatgtttgtgattagagagrcaactcaaattaggtatatacattcattctgttttagtgtatatgtataggtagagaagaatttaacaacttaggtttctatttggaaatactaaattaaaatttaaagctaggagaaaagtaccattgtaggtaatgtattacccttctataccatttatttcaggtagattatttgaggtatgattatttcagatattcagatgacttttttttttttttttttttttgagatggagtcttgctctgttgcccaggctggaatgcagtggcacgatcccggttccctgcaacctccacctcctgggttcaagcgattctcctgcctcagcctcccgagtatcagctgacttttaaaaatgcatttatcttaaaataatacagatttataggaagctgtaaagacagtacagaacagtcccctgtgttctttacccagtttctcccaatggctacatcttacacagctgtagtacagtagaaaaaccaggaaattgacattggtacaattgtataattctgtgtcattttatcatgagtagataactattttatcaccacagtgatttcccttatgactgtagcgtcacacccactccccctctctcacaccatccctagctcctggcaaccactaatttattctccatctctataattttgtcactttagaaatgttacataaatggaatcatacagtatgtgacyttttaagattggcttcttttttttcactcaccataatgttcatgaaagtttgttcctttttattaccaagtattccatggtatggatgtaaccaaaaccatttaacattgatcttctgtagaacatgttggttgtttccatttgggggctacaaataaagctgctgtgatcaactgctaatgtataggtttatatacattttgattttcttttgaacagttacatattattgaagttggcacaccacctacagggaaccagccctttccaaagaaggcagtggatgtcttctttcctccagaagcacaaaatgattttcctgttgcaatgcaggtattttaagcaaaataaatgactttttaaaaatctctcctcttaaaagaaattaacccaaagactattcatggtagatataatttaagtgatgcttaaaagaatacttttttaaagtttattagtgaagctttgtaaaataataccttggcttttcatgtacaggactaccttaggcctattatgaggtttggctccagaccaccacaataaagtaaataccacaacaaagtgagtcataagaattctttggtttcccagtgcagatcaaagttacacttaacactatgctgtagtctactgtaaagtgtgaaatagcattgtctagaaaaacagtatacatactgtaatttaaaaatactttattgctaaaaaatgttaatgattatttgagcctttagtgagttgtaatctttttgcttgtggaaagtcttttctcaatgtcgatggctgctgaataatcagagtggtggttgctgaaggttgaggtggctgtggcagtttcgtaaaataagacagcaaagaagtttgctgcatcaattgactctttcacaaaagatttctctgtgcattgctgtttgatagcattttacccacagtagatctttcagaattggagtcagttctttcaaaccctgccactgctttattagctaagtttctgtaataatctaaatcctttgttgtcattcagcaatgttcacagcacctttaccagcagtagattttatctcaagaaacctcttttctttgcccatccttaagaagcagctcctttactaggagattacagtaattcagtcacatttttaggctctatttctaattctggttttcttgctatttctaccacatctccacttacttgctccactcaagtcttgaactcctcagtcatccatgaaggttggaatcagcctcttccaaactccttttaatgttgatattttgacttcctcccatgaatcatcagtgttcttagtggcatctagaatgatgaatcctttccagattgaccgttacttaaatttactgtggtgaatcctttccagattcacttaaatttactttgcccagatccatcagatgaatcactgttcagggcagctgtggtcttatgaaataatatttcttaaataagaagacttgtaagtcaaaattacttctttggtccataggcttcagagtggatgctgtcttcgcagacatgaaagcaatattaatctccttgtatatctccattagagctcttgggtgactatgtgcattgtcgatgagcagtaacattttgaaaggaatctttttttttctgagcagtaggtctcaacagtaggcataaaaagatttagtaaaccatgctgtaaacagatgtgctgtcatcagggctttgctgttccatttctatagcataggcaaagtagatttagcataattcttgaaggtcctaggatttttggaatagcagatgagcattggcttcaccttaaagtcaccagcatcattagttcctaataagagagtcagcctgtccattaaagccaggcattgacttctctgtagagaaaatctgttgtttagtgtagccaccttcaatgatcttagctagatcttccatataacttgctgcagtttctacatcagtacttggtttttcaccttgcacttttatgttatagagatggtttatttgcttaaacctcatgaatcaacttatgctaccttcaaatttttcttctgttgctttctcacctctctgagccttcacagaattgaggagagttagggccttaaactagattaggctttggcttaagagaatgttgtagctggttggatcttttattttatttatttgtttatttatttatttatttattttatttatttttttttttgagacagagtctctctctgtcgcccaggctggagtgcagtggtgcgatctcggctcactgcaagctccgcctcctgggttcacgccattctcctgcctcagcctcccgagtagctgggactacaggcacccaccaccaccctcggctaattttttgtatttttagtagagatggggtttcacggtgttagccaggatggtctcgatctcctgacctcgtgatccacccacctcggcctcccaaagtggtgggattacaggcatgagccaccacgcccggcctcctctccctctccttctgcctctccctctcctcctctctccccctctttctttccctttccctctccctctttaaagagataggttctccctctgttgcccaggctggaaggcagtgctgtgatcatagctcactgcagccttggaactcctgggctcaactgatcctcttgcctcagcctccagagtagctaagagtaggtaggactacaggtacatgccagtacgcctggctacttaaaaaatattttagagacaatgtctcactgtgttgccctggctggtcttttttttttttttgacactgagtctctctattgcccagactgaagtgcagtggcgcaatctcagctcactgcaatctctgcctcctggattcaagcgattctcatgcctcagcctcccgagtagctgggattacaggcacccgccaccacacctggctaatttttgtatttttagtagagtyggggtttcgccatgttggtcaggctggtcttgaactcctgacctcaaatgatctgcccaccttggcctcccaaagtgctgggatcacaggcgtgagccaccatgcccagcccaggctggtcttaaactcctggccttaagtgatccttctgcctcagcctcctctgtggctgggatacagacacataccactgcacctggctagtgtataacatttttatttgtatttttatttgagacggtctcgctctgtcacccaggctggagtgcagtggcgcaatctcagctcactgcaccctccacgtctcgggttcaagtgattattgtgcctcagcctcccatgtagctgggattacaggcgcgcaccaccccacctgggtaatttttttgtatttttagtagagacagggcttcaccgtgttggtcaggctggtctcgaactcctgacctcaagtgatccacctgcctcagcctcccaaagtgctgagattacaggcatgagccactgcacccagctgtgtataacatttttcttttagagacggaatctcactctgtcgcccaggctggagtgcagtggcaccatctcggctcactgcaacctccgcctccggggtcaagcaattctcctgcctcagcctccccagtagctgggactacaggygcacactgccatgcctggctaatttcttccgtatttagtagagacagggtttcactgttttgcccagggtggtctcgaactcctgagctcaggcaatccacccacctcggcctcctaaagtgctaggattacaggcattagccactgcacttggcctataacattttaaaagagaaaaaaactgctcatttagatagttacataaattcaaaagtagaatcgttttatttctctttggcctgcaaaacattatctcaatatggcaagtacctagagtttgactttgtctgtggtmggtttcttagatgtgagaaaatgagactgggattacatttgtaagccactgcaccagtgcactttctgcatatcagcaagaaagctgttaggttttcttatcattcatgtgttcactggagtagcactttaatttccttcaagaattttcctttgtattcacaacttggctaggtcaaaaggcccaccattcagcctatcttggccttggacatgtctttttcactaaacttaaaattacttctagctttcgatttaaaaagagaggtagaacacatagaggcaattgtagttattatattggcytaatattgttgtgtctcaggtaatagggaggcctgaggaaagggaaagaaacgggagaacagctggttggtggagcagtcagaacacacacaatatttatcagttcagtttgctgtcttatgtgggtgcaattcatcacaccccaaaataatagttacatcaaagatgactggccacagatcaacatracagatacaataatgaaaaggtttgaaatattgtgagaattaatgaaaacgtgacacagagacactgaagagagcacatgctgttggaaaatagtgccaataggcttgctcgatgcagggttgccataaaccttccattcrtaaagattcatctgcactgcaaagtgcagtaaaatgaggtatscctgtaatacgtaaactgtgctatctaagttttgaattgtctttcctcttatcagtttcatgttatataagagcttgggatatccatatttaaatgtgctgyagaaatgaaggaaactttaaatattagcttataatttttcaaataaccctcttgttctggaattttaccatctctaaaatggaattagactgaatgtttttattttctgtttgtagattcattattttactaaagtgttgattttctttctgtagatcagtgaaaagcatgatgtggtgttcttgataaccaagtatggttatatccacctctatgatcttgagactggtacctgcatctacatgaatagaatcagtggagaaacaatttttgttactgcacctcatgaagccacagctggaataattggagtaaacagaaagggacaagtaaggaaaccttgaaacttaagcaataaaataagataacctgatgagttgggaacaatcctgtccttttgagaaattactccccaagatwaaaaaatagaaaataaacatattactgttagtttttttccaaaaagtaaatagtaactttggatattagaaaataatatatatcaaagcacgatgtaagctgataaaaaagaaaataatatatacctaaaaatagagatgtgtatgaatacaaagtctctctttaatcctgtctcagagaaactggtttatagccatctaggactgtatagatgcattactgtcaaaagaagtgattccccatgcaaagaaacaatttagggtcatatttgacagactattyttttaaggaattttctgttatctccaaggcagagcarttatcaactacagggaaaagaattctacctacatcccttttcctagctccttaattaagcattactattacatgttagaaggtgatatgtttcagtacctcttgtgggatgcctggaaagctaatcagtttggtaggaaaaatattatccgttctaaatttgtcatttttgaaaaacctcttcataccatctagcaagtgattctttatctgtcatcttattattttaattttttttttttttttttttttcttgagatggagtcttgctctgtcacccaggttagagtgcagtggcatgatctcagctcactacaacctccacttcccgggtttaagcaattctcttgcctcatcctcccaagtagctgcaattacagatgtgagtcactgcacccggctaatttctgtatttttagtagaggcgggctttcaccattttggccaggctggtctcaaactcctgaccttgtgatccacccgccccagcctcccaaagtgctgggattacaggcgtgagtcacggcgcacagcctattttaatattaataagaatattttaccaggagctatgttaattttctgaaaaatggctaaacattttaaaaatactgttactggtcttgccttttactcattttcttccaaattagtatttttcccagataataagcaaaggaagtagatagattttgtttctccttcattcagttaatttttgaaaaatgttatgtatatgaagagacaattcctctagggaaagggagtgcatccctacctacccatgccccaccttaactccagacctggttaggtgcttttgctctgtactcctagaacttagggctttctcctcataacatttaccatacttattaaaattgctcgctaagctgttgcagtcactattcatcattagaaaaagggattgtctttagtaaattatatttctagcaccagtcagtgtctgggacaaaagcagttttaaaaattcagtagctttcagatattcagttatgagtgtcttgcttagaaaaatcaagaataaggctaggctcagtggctcatacctgtaatcccagcactttgggaggccgatgcgggcagattgcctgagctcaggagttcaagaccagcctggccaacatggtgaaaccctgtctctactaaaaatacaaaaagttagccggctgtggtggtgcatgcctgtaatgctagctactcgggaggctgaggcaaaagaatcacttgaacctgggaggcggaggtttctatgagctgagatcgcgccactgtactctagcctggatgacagagcaagactctgtctcaaaaaaaaaaaaaaaaagaaggaaaatcaagaatatattggtcttttggtgaactagattagtgataatttaataatcatgaagttgtgaagccaggggcttttttttttaaactcttaattaattaaaaaaataaaaaaaaagacaggggctgggcacagtgtctcacgcctgtaatcccagtactttgagaggctgaggtgggtggatcacctggggtcaggagtttgagaccagcctgaccaatatggtgaaacctcgtctctactaaaaatacgaaaaaaaattagctgggtgtggtggcaggtgcctgtcgtcctagctacttgggaggctgagacaggagaattgcttgaacccatgaggcagaggttgctgtgagccaatattgtgccattgcactccagcctgggtaacagagcgagactccgtctcaaaaaaaaaaagagagagagcgccagggtcttgctatgttgcctaggctggtcttgaactcctgggctcaagcgatcctcctgccttggcctcccaaagtgctaggattacaggcatgagccaccacgcctcgccactttttgtttctgctgttgtgctgttttaagatagcgcttaaccttaaataatttcatgacacattcttggtgttcataactctaattctgggaacttgttgattgttactttcccttcctcccaaattttatgtgccagctactttgagtaaagagatgagtatttacagtaaccttagggctttcttctactctttgctaaagtctaccaacttggcatattccctgaaggaatgagtaagtggcttctatgggttgaaaaagcaaaatcaattaaagtgatattatagtcaacatctgacttaaattcttaatttgatagaactgagtactttagaagacactggagccttttctgtttcctgtagcagatcttactaaggactggttgctagaaatctgctagaacagtctttaagtatgataacgataaaactgtggattcagtatgtggggaaacctaaggtaagatttgagttaaggttggggctcaggaatgcaaataactataaagaaagtaattattacttcctttaaataagccttgaggatggaggtcggacctatagaagtaaaatcttggaggttgaaatttcttcattttccctgaaaggagtagtagaatyggcagggcagactgttacctatctatctatttggttcactgagttctcaagtatttttcaattcttactgatttggggacagaaatttcctatattcatttattcaacaaattaaatacgttttatgctatactaattgcatattgctagtaatacagttaaacaaagacaaaccccctttcctcatgtgaacagtaactgagaaaaaattatacaattatattaggttgagaagtgctgttggggtaatatgagtagtttataagctagggcatatgactagttctgcactggggaatgggatggatgggtagagaaggactccctttctctatggcagttgacagtagttcagcttttggggcaagccagaaaatattctgtggcattgagaggtttgagggtaggtaattttccaaacaagcaattagaaattggcctttactgatattattattattttatttttattttttatttttaattaatttttttttttttttgagacagagtctccctctgttgcccaggctggagtgcagtcgtgccatcttggcttactgaaacctctgcctcctgggttcaagcgattctcctgcttcatcctccctagtgactacaggcgcgtgccaccatgcccggctaatttttatattttttttttagtagaggtggggtttcaccatgttggtcaggctggtcttgaactcctgacctcatgatccacctgccttggcctcccaaagtgctgggattacaggcgtgagccactgcacccggcctattttttcaagcacctaccatgttccttgtattatgttagctgcttgaggattcagtggtccctcccttcattgagtatataatctgctctctaggaatgaaaatgtaattaacgaaaattaccaaaaaattcttgtaaagaaaaatcctaaaattaaaaggagtataccttaaacaacttgcaagtgaaccctaaatgtcatttagatatcatagcttcttcagtgtcattttctgtaggttatcaagattgmagtcctcaagaagttttaaattatgtggagttgtctttcagagctcaattaagtgggaatgttaatttttgatactgactgtgttaagaatgaatagatggtatcaaagcagttagtttggacaatgaagtaagttatttagattatagaatagccatattttaggaaccacataatggcctaacaccctatgacatttgttttcaaatctccttaattttttttctccttgtcttccttcctttcattattttttaatggcagcaagaaaacagctgtcacaatttcattacctttgtgactcagtattaacctgttctaaacagatttggtatcatttgtatccaaatgaacacattgcagctacattttattctttaaattgcaggttctgtcagtgtgtgtggaagaagaaaacataattccttacatcaccaatgttctacaaaatcctgatttggctctgagaatggctgtacgtaataacttagccggtgctgaagaactctttgcccggaaatttaatgctcwttttgcccagggaaattactcggaggcagcaaaggtggctgctaatgcaccaaaggtaaagagttatgaaaatgaagttgtcatgacattaatycattgttaatattctgtttcttatattactagaaaaggaaccagcttcctacagataaactgtttttagattacatttgggttacattttcctttagtagaattccttgtcaatgcctctagatttggttaattttctctggatttgattagttttttaaaacccagattgttagaaggatatgtgggtctagcaagcttttgatttacatagatgtagtaatgtttagtcatttaggtgttatactgtttgacctcataaatgatagttactgattttatttccataacttggacatgaaatacatactgtccaattttatagtgggtagagctgtcaaaattaggctgaatttattcttatcacttttgatgttagtttatggtggactgaattaacaccttacattcctgaccaatattcattatgaaatttgtacwtaatatgaacttgggataatacttakctataactgttttatgattataactattctcttacacactgacattgtaatttaagttgatgtatttttgattctggataatttttttttttttccaaattctggataatcttataacattgaaccaggggtatgaaagacagtgactaaatatttactccagatggtaaagatttgaaacttcytaacttgatgttaatagatggattcattcctttaagattgacctaagagattgatctctacagggtgtttagtgtgatgtttggatcactttcgaagagcgtttaacatttctccttcttacactttcraagagcgtttaacatttctccttcttaaagggaattcttcgtactccagacactatccgtcggttccagagtgtcccagcccagccaggtcaaacttctcctctacttcagtactttggtatccttttggaccagggacagctcaacaaatacgaatccttagagctttgtaggcctgtacttcagcaagggcgaaaacagcttttggagaaatggttaaaagaagataaggtacgttaaattatgttgacataatcttgctttggttgcattaaatatgatattggcaagttaaaatcatttaggctgcaccacaatgtctccattactgctggtagaaacagaacaaaaacacacattgcataagatggattcacttatttccttttgaaaaaatatatattttttcgccgggcatggtggctcaggcctgtaatcccagcactttgggaggccatggtgggtggatcacctgaggtcaggagtttgagacyagcctgaccaacatggagaaaccccgtctctactaaaaatacaaaaatcagctgggcgtggtggcaggtgcctgtaatcccagctacttgggaggctgaggcaggagaatcacttgaacccgggaggtagaggttgcagtgagttgagattgcatcactgcactccagcctgggtgatagaacgagactcggtcttaaaaaaaaaaaaaaagttggatcttagtaagacaggatggctatctaattagcaatgagatactgtttcccagagatttcacagaatgttagttggtgttacatggaaaaatatttaacttggtttcttgaaatttatttaaatatgaaccttttctaaatgttaactagctttctttactgtaggtcttctccatgccttttatattcactcartacttatttctctttacagagagcatataatggtagtatgttttcctgagcacattattccttatgtggaatagtgactgagaaacagccaaaggatgttgtttgtttctaggataacaaacaagttttagctgtccattagtgttaattcctttcacaccaccacataaaaaagcctttctcctcaaagttgtagtatggaattgccattgtcaagaactgaagtagtattgtttaaagcactctgaatagtgaataacatttaatgttattattctttcagcgttagtatatgttaggactgtttttatattattaattctaagtccttgtttcttgacccagtttctggcaatcttgtaagataccagagaatactacatcagatttgggatayttggacaggagtctctgatgaagaatagccacactagcgagtatttgaggtccatcctaattgattaagataaggcagggctgagtttggtggcttacgcctgtaatcccactactwtgggaggctgaggcaaaaggatcacttgatgcaaagagtttgagaccagcctaggcaacacagcgagaccytattaaataaatacacaatattttttaaaaagataagggagggtgagaacagccaaggtaactgagttgacctacgtaacagggtgaaagctttttaggtatcattatccttttctgtgaacagtcatatgggaccatttgtggtattaataaaagagacattaatcaactattcattagcatgttcagttaagattatcgactctgatacaactttttatttttggcactaaatatcatttataagagctagtccccaaagtagaaaatctactatagtatgtaaaccagaactcttaggaaatgaatttccagattgggcagctgaatgagtaaggcagactgaataacacagaagacagtatctgcctgtatactacctaaaaattcttaagagtgtccttcctgccctataagcttaaatccaagtcaagaagatagtggtgcttagatccctcagacatatataggttacactgtgagtttaataactgtccttatggtaaacctcatctggctccttcattatcaaattttcagttgataacattacattaaaagttgctttttgtttttgaaaaattggggccatgtgatgtgagtctgatatctgaatattcttagtagctagaagtacaagaggtacaagattgtactttgaagtacttaaatccttaacaaggtagttgatagtatctataagattgcagtcttggtgagctttttatcgttaaacaggatttgtggagaattctactgagacattgctgtgaacacaagattaagagtctaccaaccacaacccctgcatatttataatatattctgtgaaactaagtacctttcatactagttattacttatagtggacatagtgtcaactgctcatttctaaaacagttcatggatcactaaacaatctctttttcctttggacagctggaatgttctgaagaactgggtgatcttgtgaaatctgtggaccctacattggcacttagtgtgtacctaagggctaacgtcccaaataaagtcattcagtgctttgcagaaacaggtcaagtccaaaagattgttttatatgctaaaaaagtgagttcaatgaaacacattctcagcatgaattcattgaagcattgacagagaaattagcctgtattaactcttgattactttaatagtgaatttcctttcattttgatttactttgaaatgtataaaaattctcttacccctcatatcaaattcatacttgttaaattgagaaaattacttttgcatggcttatcagaatttcagatagcaggcacgtttaacatgttagaacaaacttttgaaatattcatttattgaaaatggataagccaggccaggtgtggtggcttgcgcctgtaatcccagcactttgggaggccaaggcaggcagatcacttgaactcaggaatttgagaccagcctgggtaacatggtgaaaccttgtctttactaaaaatacaaaaaagtagccaggcgtggtggtgtgtctgtggtcttagctactcaggaggtcaaggtaggaggatcacttgagcccagggggcagaggtttcagtgaatcgagattgcacctctgcactccagcttggatgacaaagcaagaccctgtctcaaaaaaaaaaaaaaaagaaaagaaaagaaaagaaaatggataagccagttataaaaattgacagatgtttgttcaaatatgtcatcaccaaggtctaactgggcaccttaaattgaaaatgaatttgtgctttcaccagtagttctatattagtgagattttatagtagaaaaagtctttaaatgctataaaattgaaacttaggagcagcgtttaagtctttgtttgtttataggttggatacactccagattggatatttctgctgagaaatgtaatgcgaatcagtccagatcagggacagcagtttgcccaaatgttagttcaagatgaagagcctcttgctgacatcacacaggtaatgtgattaaaatatattttgtagaagctgattgaaatggagagtgggggccagccatggtggttgacttgggagtccaaggtgggagtattgcttgaggccaagaattcaagaccagtctgggcaacattgtgagaccctgtaactacaaaaaatttaaaaatcagctgcatgtggtggcacatgcctgtcgccccagctactcgggtggctgaagtggagggatagcttgagcctgggaggtcgaggctgcagtgagctatgatcgtgccattggactccaacctgggcaacagagtgagactctcaaaaagaaaaaaaaaaaaggaaaacttacagtttgtagaaattaaagctttgtcactctatatggataaacctcaaatgccttgcaaaaaaagcaagttgcaaaagaatggacagtatgaaaccatctgcatgtagttttaatacatgcaaaacaaacatcttatttagagatgtatgtgtattaaaaatatgaaaaatacatggggatgataaaacaggatagtggttgccactgggtgtggggagagggaagagatgcatttgtaagtgtgagtcagagtccttcatatttatgctattggttttctaaagttcataaaaataaaggtctgtcaggctgggtgcggtggctcaggcctgtaatcccagcactttgggaggctgaggtgggcagatcacctgaggtcaggagtttgagaccagcctagccaatatagcgaaaccctgtctctactaaaaataacaaaaaattagctaggtgtggtggcagacgcctgtaatcccagctactcaggagctgaggcaggagaatcgcttgaacccgggaggtggaggttgcagtgagctgagatcgtgccattgcactccagcctgggcaataagagcgaaactctgcctcaaaaaaataaaataaataaataaaataaaataaaggtctgtcggttcagttgtattctgctgttatgtaatatcttgaaatattttgtagttgtttttatcagaactcaaaataactatgatccctagaggacaaaaatttgttcttaagtgtttatattgtccaaataaaattctcaggtaaagaaagagttcatgcataattttgtctacatactctccatagtatcttaaaacaatttcttttaaatctttttttgtagattgtagatgtctttatggaatacaatctaattcagcagtgtactgcattcttgcttgatgctctgaagaataatcgcccatctgaaggtcctttacagacgcggttacttgagatgaaccttatgcatgcgcctcaagtatgtgttttaatgctttttaggcatgtttccaacattgttttagtaaytgtgcagcgcctctcagattgttatgcaaagctactgagrggcctactccttattaaagaaaatgtagctattataatattcttttgtactttaacagttcactattaaaccttaatctgtaatacggatattgaattactcatgtaagtggagtggacaataaacttgccttgtttgtggttttacaggttgcagatgctattctaggcaatcagatgttcacacattatgaccgggctcatattgctcaactgtgtgaaaaggctggcctactgcagcgtgcattagaacatttcactgatttatatgatataaaacgtgcagtggttcacacccatcttcttaaccctgaggtatttcagtttcttacctaatagatggtgttagttgtgattaataggtacactgaaaatgtgtttgtggtactaaatattaataatttcataccaccatgaggttcaacattatttcatttattcattcattcatttattttgtcttgtagtggttagtcaactactttggttccttatcagtagaagactccctagaatgtctcagagccatgctgtctgccaacatccgtcagaatctgcagatttgtgttcaggtggcttctaaatatcatgaacaactgtcaactcagtctctgattgaactttttgaatctttcaagagttttgaaggtaattaggagtttttgagtttttaaaaaaagtacttaaggtagccaagaagaggtatgcttatgatcaggctrttggaaattttgtttttctaaaaatttggttctatgggacattttaattttttaagttttattcaatatatgtcaaggcccttttatgttggattctaaggatatgcagtgaaccagaccatctgtttggatattttatagatgaattaaaggtagaattttaagagaaaaatatgtagtggtgttgaaattgtataaaatgaaaatacaggttgagtgtccctaatctgaaaatccaaaatgcaccaaagtccaaaacttyttgagcaccaacataacgctcaaaggaaatgcttgttggagcatttcagaaatcggattttcagattagggatgctgatcaggtaattataatgcgaatattccaaagttcaaaatctgaaacacgtctggtctcaagtattttggataagggatactcagtctgtactaatgatcaggtataataaaattttatgcttatatgtctgactcttataatagcaggtgattctcactaagggcattttgtgatttgttgctatttagcaggatttcttaaccttagtactatagacatttagggctggataatcattgtagaggggtgttcctgtacatgtagaatatttagtagaatattcagcagcattcctggtttctacccactagattccagtagcgtcagctccaccagttgtgacaaccaaaaatgtcttcagacattgccagtgtcacctgtgaggaaaatcacctcagttgagaaccactgctatacagggtactaacgtaatcactgttgggtgtctaacttctggtccccaactgcctttctctcctctctgtactagtagtactctattgagaaggggtaagagagtctagtagttttcttaattttttcttaattttcccagtttcaaaatgttaactgtgcactaaatttacactgtttagtacagtcactagccacatatagtagctatttacattgaaagttattaaagtgaaataaaatttaatatttagttattcagtcactctagccacatttcaagtgcttaatagccacatgtgtttagtggctattatattggaaggcaaagataagattttcatcattgcagaaagttcttctggacaatactgcactaaattcttcccaaattattttgtatgtttcctataaattgcatattgaaaaacaccaggtattggggtcttcatttaaaatttcccatataggggcacaatggtgtatgcctttaataatcccagtgctttgggaggccaagtgcttggggccacaaattcaagaccagcctggctagcatagcaagacaccatctctacaaaaattttcttaaaaattagcctggcatggtggcatgcatctgtagttctagctacttaggaggttgaggtgggaggattgcttgagcccaggagtttgaggctgcagtgagctatgatcgtgccactgcactccagcctgggtgacagagacctgcctcaataaaaaagaaaaaaaggaaacattgggttgaattgtctattcttcaggattaaagtgcaatccattttactgatctgattaatggaatagttagtatttttatcgcgctttttaagcaaccaacttatatttgggagtattcaatataacagttttttaattacataaatgtttttcagtcattctcaaaagtgtgcctrtgcttaattgtaattacttgtttctttaaggtctcttttattttctgggatccattgttaactttagccaggacccagatgtgcactttaaatatattcaggcagcttgcaagactgggcaaatcaaagaagtagaaagaatctgtagagaaagcaactgctacgatcctgagcgagtcaagaattttcttaaggtaagtggttttgagtaatgtgttttctggttggattccaggttagcagttctacaagggtttggtcatagttcaaaaatattttttccctaaatgtgaagttgttagcattcttaagttgtgtgctggattatttcttccaaacataatattctgtggtttcctttgaaatacggaaggaaattggtgagtaagaatgaccatctgtttaaaagaagaaaaaaaaaatagcactatttcaaaggaatttcctttattttaattttggatggaaaaatttagaaaagtggttgtatactttcaatgtcattttagaatcatttaggcttttgaatattaacatcagcttgctcttcataccattttgaggagcctctattgtaggcaaagggatctgttgtctaaggaatgtataggtttacctctttcatcaagtttgctcaactctagaaactaaaatattgttattcatatataattcataaaggtaagatcaaacaaaacgctcagctttgtgacacattaaatcagttagagaggagtaaggaccacctgtgttgcagggaggagtaatggttgagagattctgaactctagaacatccctaagggcagttaattttgtttaatgtttaacttagctttagctttattcttgtaactgccagttactttgtgatggaaataaagctttaaaattgatagctatctataaaaggctaggaaaactacagaacacttagattactgctctctcactgcctattatgtgtgtgtgtgtacacwatatatatatataatgattcctgagactttatagaaagttctgaagtattttttgtcttggaagaattttacattacaagtaaaaccaaaatgtttttgtagaacacagtatagaaagtaggcttttcctactcccagattatcatcatttgtgtgtgtggttgcattggcagattgttcttttgaagaatttactacctgggctctagattaaatagcaaaacccttaggggttttagtgtaatgaagtagtcaaaatgttgaaactgctctacattttagattaaaagatacacttttcaaaaaagtatagctttaaaatgtcttggccatcatgaatattctgggtaacctagctgtgctatgtttggaccaaaactttctggtgtcaaaaaacccctccaaatgagaaagatttgatactctgtgcttgactagtgtacccatactactgattcacttccttctttgagtatcattactatttcctttaaaaaaaacaacaacaaaaaaaactactactagattcttttgggggcagggggtgttgggtttttttttttgtttttctttttaagcttttaagttcaggggtgcgtgggcaggtttgttatataggtaaactgtgtcatgggggtttgttgtacagattgtttcgtcatccaggtattaagcctacaacccattagttattttttctgatcctctccctcctcccatcctccacccttcagtaggccccagtgtctgttgttcctctctgtgtccatgtgttctcatcatttatctcccacttgctagtgagaacatgcagtatttggttttctgttcctgtgttaatactaccagattcttaaatgatttctttttgtttttattgagccctcagcttctatgcttaaattgtaacttctttagctttggattttaatatttgagttatatatatatggaaagcaaaatgaaattagctattatttaattatcacatttttgagctttaaaaaaaatcctctagtaaagaaatgaaaaacaatcctctgggtactaggatggtactgccttaggtttgcatagcccatgggatctaatcagatgaagatttcccctccacacttgtgaactgggtacaagcctgatatagtaggggtgtggatgtggattatgagcttttgagtcagtcagacctgtttcaaattctacttagccattgtttgttcattcagtatatgtctagctgttacctcaggcaagttaatgaatatgcctcagcctcagtttcttcaaccataagctatgtttatttatcaagtaccttgtatactatagatgtttaggcagtaactattactgataagtgataagccttggaaaaaggtggagtcagcctaaatgggatttctgtcaggcaagtatttatttctctttgatatcaatttgtacttgactctttgaaggaatttacttccagccaggattagaggtgaatttagggtcttaygtctacataatttgacatgggagctcaatactaagatgcaactatcacattcatcctctgatgccagtgttgagagtgaacttattagattccttgttaacctccagtacagggttatgatgcctcttatcactgttattaaacttaattttagaggtactagctacatgataatttactggtgttgtaagtaaaccctgtgtcataagaaaaataccctgactctgatcttgaatattcaagtgccaattgtgtgttagccaccaggaataaagagattggtagaacataacttctcctttaaggtaccctgtgagcaggataaaattgtgtcattagcatcatttgactcatgccctaagtttgtagaactgtaagctctctgtagaaagcatataactgttcatcagacccatgatctgctccttgctacctttgatcttattttctacctttctttttttctttctttcctggtttagcttcaaccacactggcctgctagctattcctggaactcccctaaccttgtcctgccgaagggcctttgcttgtgccctgtactactattctctcatgaccttctttctcctttaccttctttgggtttctgattgaatgtcagaagagaggatgtctcaggttgccttgtgtaaaatagaacccattcctaccccattttgcttgtttttctttataacaccactatgaaacgtctcctcccactagaatgtaagttccttgagagaatggactctgcttcctttgttccctgctgtatctccagtacctaagaacagagtctgatacttgggtactcataaatatttgttaaatgaacaaatttatgttgaagaaaacctctgactatgctaatataatttcaagtttgatcttaaaatctttaaccattataactggaggttaattaaacatttagtaagtaatttaatattattaaaatgttaacatttctaccatgtataaaatcatgtgcaaattttagcaatcaagaaaataacctagattttgtctactttttaaatctgaaattttcttttggaatacagttagtattccacaaaagtggaattatttgccacagaaattttaacacctatgcatgaaaacagaataagtaatcctagattatctgtaagtgataaagataacaaaaatattttatatgtgtataggtaagatgactagtgtgttgatccatacttttttgatgttcatttagtaggaaaaacatgacatactaaaatttttacatagatagatgcagacagattctagaaatgatcgtaacagctattagtgcagagtttccatggtgttaaacaatacttattttagaaaaccttccttaatgtggaaaatctgcagctttacagacatttttattttttaatttaggatggctatattaaaattaagatttaccttggtgttcttgggacacttcatagactagtcttcgtattatttataatcgagtaactaatatcccctagtctcaggagccatttaattctaaccttgaaaataatgttcttagtggccatcactggggaaagttctaccctacttagttctgcttccctagtagactgtgttagaggaatcatttattgaggaatgtttcactgtgtataaatgaattcctgatggaaactgttgttttttgtgctctaccttatgtctgtggaatgtaacaggacatgtatcaggtaaatgcccagtacaggttttacttacctgtctataacatcttctatgtcagtctataagtaggattgtagtttggtatctgtaatggaatgataaaagcagttggcaatttaaagatatcttttctttaaatgctgggtttttttttttgtagggggtgggttttcttatggccacatgtggtcaccatcatgctgctccttgtaggctttgttataatagagtattagaggctggttgtatagattggatgtggggagggatagaaaatcattagtttgaaacaaatgtaagccatttatgccatatgtttgacaatgtgactatagttattaagttgattttaaatacggtagaagtgttattaccagtgaaagtcccagtatggtgaatttatcatctgagagccactggctcaggtatcttaatttgttactcttgttttttggtaaagggtgtgtatgggaaagacttggtatcttgctgtgtgaatctaagtattgcttagtaaaaatttactgaaactgggatgtacacactcaactattgggacattctttctttaacagaagagctatgtttgtgtgagcctctcttgttagcgtagaacaaattctcatatgttacacagatttgatacctcatagaagaaatttaaagyttccttttgtttgtctttttttcaggaagcaaaactaacagatcagctaccacttatcattgtgtgtgatcgatttgactttgtccatgatttggtgctctatttatatagaaataatcttcaaaagtatatagagatatatgtacagaaggtaagtaatatgtaggtaatgtaaaggtataatcttactatagattttatttctcatattctggaaatccttttgaaactctgtgctcaataagagtggtctgcagcttttaacgtgggattttttgtttttgtttttgttttggagacagggtcttgctctgtcacccatgctggaatacagtggcacaatcacagctcactctaaccttaaactcctgggctcaagcagtcctcctgccttagcctccaagtatctgggactgcaggtgcatactaccatgcccagcctgcttttaatactttttccccagcagaatcctttcttggaataaaattctacgtgcttccctagcaagccgactcagggaagggggaaaaaaaaaacatgcatgccaagtgtgtaaaatataagaatagaactgctattattgaaaaagttgggtggcctagggccttactaacttgatagaccctgaggtatccatgtagactccaaagcagagttttcaaaccatcttaaatacagatattagataattcaccttctaactgtagaaacaggcagtattgctataatgggagcctttttattagacagtcttgcatagtcatctttgactgtatcttctttggacttatttatcatatggaacaatgtttcggtaactaaccaaaccggtagagacagaatatagtatatgtgctttcaatacttattaaaccatgaagtcttgtttttagctggacttcctgctaaattcctctatctagttgcaaatttagaccctcagtttattactgaatttaaaaactgaacttaaagaaaaaaaaactgagcttaaaagcgatagagataaatgcttttttaaaattcctctttgcttttaataacataataacattcttctacttctttttaaccacaggtgaatccaagtcgacttcctgtagttattggaggattacttgatgttgactgttctgaagatgtcataaaaaacttgattcttgttgtaagaggtcaattctctactgatgagcttgttgctgaggttgaaaaaagaaacaggtgtagtaccattttaacagggataagttactctttcttaacatggcaatagataaaaatataggtagtcatttgttccaaagctactaaataacacatggagaataatttcctgaagacacctaacatagaggtgataagctagctaatagcactgggaaaaaatctgttttctgaaacattatagctgtcataggagatctgttaacttggttgatcatttttttggcatgtttataattacagctatgtggtttgactttatatgtttttatataaactrtgtactaagtctcctgtttaggtgtgatacctgtgtatttaacaactaattctgtactgatcaatcatgtggtgtttccaacctgagaaagctgattaaaaaaaacagtgtggtgtttaagtgtgaggcaaaagagttccctgtgcaactcttgagttcaattgatatttaatttacagtaccttaacatgataatatggatttccaatagaatatagtataagtgcttctaaaacttacagactgtgaagtctttttttagctggaacgttctgaggaactagtgtttaggaagtactgatgtaaatgagtttggtgaggtggtatgctagtgggaagttctgctgtttatgagaagaaattaagaaagtctgtgggtttcattttaacctgagttgatataggtgatctactaattatattcttagaatttatattagaatgtttcaaacatggaaaaattttgcatttaagggtaatagagatatgcagttaatactgacctaaaggtttgagcctagtttcaagtgattttatgtcataacaatttaacatttaataagaggttcagttgagtctgaacctattgaatctattacctgaaaataatcttactgcatattccaagcaaatggcagttacagttagataatttagtctttaagtgacaaattatattgtgaaaagctagattcacatctaagtcactagtctagacatgcctcagctaatttttattccttaagttgacatggcgtatcttggattgcacatgtttataggagctggatttttgcctctatttattaaaattgtcttctccctaatgggagggttcataataaccatgtgaatttgatatagccaaaataacgaataatgctttttctctggctgcttttaatgtttaaatcattggtaaaagaggcttgggccaggcgtagtggcttgtgcctgtagtcccagcttctggggaagctaaggtgagaggattgcttgagcccaggaggtcagggccgcagtgagccctccactgcactccagcttgggcaacagaagaccctggctttaaaataaaaataaaaggaggcatggtcatcaggactatcgaaacaagctatagtatagcaaaactgtgctccttgatggagtgtttatatgacagctgcaactattaaacccagagcttctaaagctatcagattttattcccaatatgtatttagggtttggctgtaggtaatgctgtatgttaattgtgttaaagctgaaagaactctcagataatctggcctatgtaatatcacatccccatcctatccacaaacaaaattttctgaagtctagatattttgtgtgttataaagaaaggacactgtatgaatctctaatcttttattcagatataaggaggtaagtatatcatatagcagataaacctgggagagtgaaaaatagcyttatataccttctttttattcttggacaactcaatcatattttgagtcttaatttcccaatttataataggatcactgataattaaaattaatgtaaagccaggtacagtggcttgcacctatagtaccagctactcgggaggctgaggtactaggatcacttgagcccaaggctgtagtgcacaatgattgtggctgtgaatagccactgcacttcagcctggacaatgtagcaatactcggggggcggggaaaaagtatgtgaaagcacattatagaccataaggtatttacatagttagcatgtcaagagtgtgttatttataatacagtatgtgtgtgtgaggtttttttccttttttcctagattgaaactgcttctgccttggctagaggccagaattcatgagggctgtgaggagcctgctactcacaatgccttagccaaaatctacatagacagtaataacaacccggagagatttcttcgtgaaaatccctactatgacagtcgcgttgttggaaagtattgtgagaagagagatccacatctggcctgtgttgcttatgaacgtggccaatgtgatctggaacttattaatgtgagtactgctagctgaatatgtagagaagctgcatttttaaaaacctgttacatgagagtttcagggtaattttaggtaatatgggacatttggggacggtgggtgcttttttaaaactttatttggaaataattgtgaatctgaaagtggccaaatagtggataaagtctatataccctttattctgattgacttgctaatgttttaaccccactagccttaccatttgtgttctcacactcttacactcaggcacaccattcatacatatgtgtatacacacacatactattttttaaccacgtgggaataacttgaatgcatcatggccttataccccttccgagtgtatggcctaagaataaggatgttctctttcattaaccacatgaaagataccagcttcagtcagtttgacattgataggatacctttaaaaatctgttctattctagttttgtcagttacccaatgatgtcctttgtagcagttttttcccctctagtctaaggtcatatatggcatgtagttttcatgtctttagtctcctgtactttggaatggttcttcagtcttttgttttctatgacgctgatatctttgtaaacaatagttgctttttctatttgtaactattttatataggtgaaatttcaagcaacatcaaattaaccattttaaagtgaacaattcagtggcattcagtatattcacaatgttatataatcacctttatctagttacaagttttcatcacttcaaaaggaaaccctgtattaattaaacagttcctccacataccccctcctcccagcccctgacaaccaccagactgtactgtctctatggatttgcctattctctatatttcatctaaatgtaaagtctctttttaaaaaacagaatgtgtctcactttgagttcctctgatggttcccgatgattagatttagattatacatttccacccagagtactgcttcagtggtggtttgtttttctcttggtattatatccggaagcacgcrgtgttcatttgtcccctttgtcagtttttatcaagttgtaacatgtctttattacataattattaccctcttggagatattaaacagtctataagtagtctgtagtagactatgcaaatatcctcttaccctctcccttaatttagcatctgttgattcttgcttaaaccattcttaatgtgttggttgcaaaatgaaaatttttcaaactccagcagtttctccacatttgtcagttagcactcatgcattcatgaactcttggattttattcgatgggctacaattcactactatttattttgatgctcaaattgtcccagttttgactggtgagaacctcttcagtctgtgtctttgtgtcatgggctcatttttctttgagcactaacttattttctggcacacaatacaccaagctcattttgtaccttcagcagccctgaagtcagtcatttccctagggaaccttttactggggcattagaaaccaagatctgggccaggtgagtggctcactcctagaatcccagcactttgggaggccgaggcaggaggatcacttgagcccaggagtttgaaaccagcctgggcaacatagcgagccccccgtctctacaaaaaattacatgattagctgggggaggtgccatgcacttggtttcaagctacccagaaagctgaggcaggaggatcacttgagcccaggaggtcaatgttgcagtgagctatgatcrcaacactgcactctccaaccttgacaacagagcaagactcctactttctgaaaatattagaagtcaagatctgagctttagtgtatttgcttctaagatctttcagtggtcagggcttagttacatttatgtacatacatatgctcatttatgtacatacatgtgcatatacgcatggaaaaataaacacacaagaacagctagtaaaacactgaaaactgtaaaagtggactagtcctaccagatgttgaactgtgtattacaaagtctatataattaaaacagtatattactggtacatgaatcaaagtccaaaactagatccaatatcagtaagattatcaataaacatagtttaaaagataggaaataccctctaaaatgctataaaaagtcctttactttttaccttgaaattaatctatcatatcttctttaggtttgcaatgagaattccctcttcaaaagtctttctcgctacctggtacgtcgaaaggatccagaattgtggggcagcgtgctgctggaaagcaatccttacaggagacccctaattgaccaggtaacattggcaaatgtgtttatggctgtcagtaaaaattatacatttttaactatgaatacaatcctttccctcatcatgtactcaaatggatcatatataactatgagagaaagcaatacaaagtagaagaaaattaaaatttatatatattcaatttacattcatttgtatataatgaatgtaaattgattatatacattatatacaaatgaatgtacatttatataagtataaatatgtatataacatacattaagaaaaataagccatgtgcggtggctcacgcctgtaattccagcactttgggaggccgaggtgggtggatcacctgaagtcaggagttcgagaccagcctggccaacgtagtaaaaccccatctctactaaaaatacaaaaattagccaggtgcatgtaatcccagctactcggcaggaaaatcgcttgaacccgggaggtggaggttgcagtaagccgagatcacgccattgcactccagcctgggtgataagagcaagactgtctcaaaaaaacaaaaagaaaaaagaaaaagaaaatacatcccaaaagacctgacttaattatataaaactctcttggttcatcatagtttaaaaggaaaataacaaactaaacattaaagattgctattattaacacttaagtggctaaattgattggaaacttcaagataataagtcagaaaaatataaggataagagaaaatacaaaagaccaagtgcatcagtgttatatcttactaataagaagtatagaactgcaaatgagatggggttttatacctaaawaaaatagacaacatattttaaaagttctaaaaatagaagagttgttataatgagtcttaaattctcctgagataagtataaataaaatattttggaaacgaataggttgaaggctattaatatttcattcctttcctaggaagcacttctaagcaacattcccaagtagttacaaagcttcctaggggaaggttgtgggggtgggggcgatggttggaaatcattgcagcatctagaaaaccaagcaaatagccaaaaccagacgaattaccgatattttaattccacatctgtgtagctgaattttgaattatgtgtagccattaaagtgataatgatgattgctagcctggataatgttttaatcagggaaaagatagaaattatatamttagagtaatttttcaacacaattatacatattgtatagatttgtgtagaaagacctctctatgtaaatttaaaggtctttttcctacttcattcttttctgcctatttcaagttttctaatgagaggccaacttacgcttttttaaaaccaacttgattctcagtacttatgtcccatatatcctctgtaggttgtacaaacagctttgtctgagactcaggaccctgaagaagtgtcagtaactgtaaaggctttcatgactgcagaccttcctaatgaactcattgaactgctggagaaaattgtccttgataactctgtattcagtgaacacaggtatgctttcagagggatccattggctatttatagtcagtctttaataaattatggcccatcagttttgggaaggaacaaaaagatcagagraagttgcctgaattctcactcttctaatatcctcccccctaccctacctcttgagacaaaaacctctccgttagtcacagtggttattttttatgtcggataaacttaaaatattgcatttaaaatattcttttttttcttaaaggaatctgcaaaacctccttatcctcactgcaattaaggctgaccgtacacgtgttatggagtatattaaccgcctggataattatgatgccccagatattgccaatatcgccatcagcaatgagctgtttgaagaagcatttgccattttccggaaatttgatgtcaatacttcagcagttcaggtaaatcttcagattacctaagttgaattactaaacactgtgctatgagggtgggcctaattggttgctacggcaatagagcagcaataaaatactaacagcttaaatgtaattgctttgggtaggattgattttactctaaccctaatttcaaacttggatacttaggtcttaattgagcatattggaaacttggatcgggcatatgagtttgctgaacgttgcaatgaacctgcggtctggagtcaacttgcaaaagcccagttgcagaaaggaatggtgaaagaagccattgattcttatatcaaagcagatgatccttcctcctacatggaagttgttcaggctgccaatactagtggtatgacttcttaccttatgtattgaaacctcataaaatgattaagctaagcattaagatatctgtctattctgaattttagaagagttggatactgcatggtttcttttagtgctccatcttagtccagataaaaagaggctgtattttgtgaatttgtaagttcacaaaacttacaagtggggaagatgaatcttctgtttttgaagtctcataaaatcctgatagtgctctaatcttaaaactttaaggaaaaagaattcatctattcatttggtccgtgataatacagaagtgaaatattgcacggtttacatttgtcattatccatgtttccttgaaaaggaaatgaatgcaattttcatttacttgggtgaaagataaactaggatgttagtgtttggatatattttttctttttctatacttaggaaactgggaagaactggtgaagtacttgcagatggcccgtaagaaggctcgagagtcctatgtggagacagaactgatattcgcactggctaaaacaaaccgccttgcagagttagaagaatttatcaatggaccaaataatgctcatatccaacaagtgggtttccttttcagatttaagaaaaactagttgggctacttgattagcttggtaggatcaaaacatcataactgaagaattccaaggaaaaatctataggaaaacaaattctttctcattgtgaagatatcaatttgaaaagaggattaagctcacactmatatcttgctgaatgtgggttacctttttttttccaggttggtgaccgttgttatgatgaaaaaatgtatgatgctgctaagttgttgtacaataatgtttccaattttggacgtttggcatctaccctggttcacctgggtgaatatcaggcagctgttgatggggctaggaaagctaacagtactcgaacatggaaagaggtaatctaaacccaagtttgagtgaagaattaaagaaacgctatttaaacattagtttaaataactagccatgttttacatttgagttcacagaaaggaaatgtttattctaggtctgcttcgcctgtgtagatgggaaagaattccgtcttgctcagatgtgtggacttcatattgttgtacatgcagatgaattagaagaacttatcaactactatcaggtaytaacgagacttttatatgacctgagatcttttaccatagatattcttatctttaactgcacatttctcttgttcaggatcgtggctattttgaagagctgatcaccatgttggaagcagcactgggacttgagcgagctcacatgggaatgtttactgaattagctattctatactctaaatttaagcctcagaaaatgagggagcacctggagctgttctggtctagagtgaatattcccaaggtaaccagtcattgtaacacagtgaagcaactgtgtagttaaaactaatgcttcaaaatatcttattctttttaaggctgttagctagactcatatctaaagcaattaagtctttcttatgcaggtgctaagagctgcagaacaagctcatctttgggcagaactggtgtttttgtatgacaagtatgaagaatatgataatgccataattaccatgatgaatcatccaactgatgcctggaaagaagggcaattcaaagatatcattaccaaggtgtgtactttcttcagaagataaaggattcagaaggagaaagctcattaggaagtaactgacttatgtatggattttcccattrtaggttgccaatgtggaactatactacagagcaatacagttctacttagaattcaagcctctgttgttaaatgatttgctgatggtgctgtctccacggttggatcacactcgtgcagtcaattatttcagcaaggtaaagtaataattttaaaccaaagcttcatagcaaggaattaggacatacttcgataacttttgtccctgggacttcaataatgtgctatatttgtaacaaactctttattttaaaggttaaacagctaycactggtgaaaccgtatttgcgttcagttcagaaccataacaacaaatctgtgaatgaatcattgaacaatctttttattacagaagaagattatcaggtaaaaccttttgattcttgcacataatctcaagactcataaagttatgttttcccattttttaaaaaagccattatcctttaggattgtaaacagtaggtgcttgcatacctaggatctaaatttagtaagatttcaggattgataaatcttctaattaagtgccaagttttcagaattttgctcagatcttgtataagatactgcttttgaaaaaaatgatatgattactttatctctaacatctagattgtaggtagagtcaaaaatgtctttgaccacttaactaattcataaaatttatttggtattaactatatttattcaccatttttcttgcctactgttttattagtgtttgtataaactttctcttatgaaggatttcacaagcaaaagtgaagtagagttaagcttaagctacttgcctttttttctctctcttcattttctttgaggctcagcgcatgcagatctgtactgctgccatgctgagttttatcagaagtttctctagagcacagaatcttgccctccatgccaggcgtggtgactcacgcctgtaatcccagcactttgggaggccaaggcaggcggatcacgaggtcaggagatcgagaccatcctggctaacacaatgaaaccccgtctctactaaaataccaaaaaaattagccggttgtggtggcacgtgcctgtagtagcagctactcgggaggctgaggccggagaatcgcttgaaccctagaggcaggttgcagtgagcccagattgcatcaccactgcactccagcctgggcaacagagggagactcyatctcaaaaaaaaaraaaaaaatcttgccctccaaattagaaatattgtccatttcatagccatatgttagtccttgatagtgaaaatcttggagaaaatggtatctttaggtaaaatgaaaaatcataccttttgatgcttgaatctaggtgtcatattacatgttaccatctaaggggctcattgattgagaacggaatataatgttaaacaaaatactgatctggcatttggatggctttttttttttaaggctctgcgaacatcaatagatgcttatgacaactttgacaatatctcgcttgctcagcgtttggaaaaacatgaactcattgagttcaggagaattgctgcttatctcttcaaaggcaacaatcgctggaaacagagtgtagagctgtgcaagaaagacagcctttacaaggttgataaagttgcggggcaggggctgttttaaaccaggcctaaaatggtgttacaagtgattataatctataaataaaagtattggttttgtgaatatgagagctgactttaaggcaatttaagttaatggatttcttgattctaggggctctcttatgttaaggtcaaacttgtctggggaaaaaaaagcttttagcttatctcttctttgaaaattttaatttaaatgatacaactaggaggcttttttccccttgcaaaaccagatttatattggaaagyttccattgtttttcttggtttactagttcagtatgtggggtctaatgtttttgactttcactatttctttgaataggatgcaatgcagtatgcttctgaatctaaagatactgaattggctgaagaactcctgcagtggtttttgcaggaagaaaaaagagagtgctttggagcttgtctgtttacctgttacgatcttttaaggccagatgtcgtcctagaaactgcatggaggcacaatatcatggattttgccatgccctatttcatccaggtcatgaaggagtacttgacaaaggtaatgactcttctaagtgtattcagaactagtttccttgcatgtaaaattctacatgcacattaatttttttaaatgcttttttctttagtagaagtaagtcatttagtcgatcataaaatattcctgttcttttgaaawttttttttaatagctgacaaatgacactgattggaaggggaactcaaatgtagctgtttaccctcagtgtatttatgagggtgaaaataatctatgtatttttttatttaaaaaactttgataaattttatttcaaaatagtatttttctcaaaatcagttcttgtractcaaatattcatgactagtattgtagattcccttttatttggttggttcctgactttaatgatgtctatgcctgtttcccctggggaagctgcatgtatattcttaacatccttttaatcttcacaatttttttgatagtttaacccctgatttaaaaataccataggaggtgaacatgggaaaaaaaaaacaagctgggggtctaattgccttataacattcactattcgtcttagtgtccttttttgatgtatgaatttactcacyctatcttcagcagttactagctgtctctctgtagaacatttttaaatggttttagwggatccttttcgtcaaagcaaaaaacatgattaaaatcagagtctcacatctgattccttcagcctgcctgagttggggggatgggagggtgaagaagcgctaccaacaacccctcccatactgaatttttcctcaggataccatttaattagataccattgtgtctgtttaaagtttttaaagaattaacattttctgtattcaatgtaagagaaaaaacatgttgccttatcttagccatagatgagaatagcttcttaaacataatgccaacttgtgagacctgtctttaagctgctgttaacctaagtgctgtaaatttttctagtgattaagctgctttctttcatactgtagcataaattcttctgcaktaagctttgaagttacacaaaattctaaattttgcttccagtatgccctttattttcacttctctcatacctttttagtggttagatgtttcttccctaaacctttgttgctgattctacctttttatgctcaatatggaattgattttttttctaagctgcaccttctgaattcctttgcaggttgatgcaataaaggaaaaggtgaaagttgattctttaacatctttaagtctggaggactaagtctaaggaatttgcatgatgtttttccttcctcttctacactgctgctgctgctttttccccccaataaattttcactaaagcctctgcaagtcccttgaaacataactttaatagagctgtaggacattagtagacgtttgctactaatcggctaataggctttaggaagggcaggaggctaatcagtagttggttcacagtctctcttaaatatattatgaaaaactgagtatggtgagtttccatattaatttcaaagtaacaggaaatttctcttccctgtcagggtatctggaccataataggactgtcataatccttgaagtaaattaaaacagcctctggttttactttgtgagcttgcctgacagttgtcgaatttatatatgtatatatacatgccctaaaaggctttttggggtttttttttttttgtattgaaggactgtgatccagtttctgatctcttgattcttactaattttttgctgaaagtagatacgagagatactagctgcttccgaagagactttcctcatgtttctccaggtgtccagttcttatggtgctagtccatttttaagaggaatcaaaacctttttaatcatgagagccaagcttgctataattgttgctaagcaacatgaattatttttaacaaagtattaacttctactttctgtaataaggcatacctctgaagctacctaaaatttgctctcctatttatcagttggcttgtccaaggatgtcaaattcaggcaccttttggttgctgcttccttcattggcttgtctccatcccaatataaatgaaacaaacttacgtctgttatcaaattgtggttagaaaagggtgggaaggtaaaggagagttgaaacaaatttaaaagaatttgggtgggggacaatgccttgggattatgttgaaccaaactggaatcaccactggaacttagggcaaacctgagtaaaatgcattgtgtgtgagacccttcagcagctagtaagcaaggcagttagaaagcgtgtgtgtgaaaaacaggtaattgaactgcagtgttatgcattgttttaaatgaagcatgtacaacagtcattgcaattacatcatactatttttgaaactcttatagcattgctgtgggctgtgtgtgtttcttgagagcctgtatagcaagtcatcttcagacctcacttcttgcttcagtacttttgcctttttttcatgcacacatacaccaaaataactgactgcatgttacttttcctctgcagcayattgcagtctttgtggaaaagccttttacattttagtgaattttcagtagtacagatggaactgaattcattgacatgcttacctgtaatttttctttttaaatccaaggatcagaaactttagttacagctcttaacaaaagcttgtgttcttaaaagacttctctgctttttttttgagcaatctaaattggatcagtggaaacaaaaattgaaagtccctgtgccagaggctgtcccattatatagaagaatcaaactttttgcttagcttgatgctattccttcagaattcttccccctacgcccaaacttcctatgtgtatgccagggcattgtgatattgccagctcttctaagtcttccatgtgtttctctaataggacttctgtgttcaacatctgattcagaccttaacttttaaacacatgttcacttcagattcttttccctggaagtccggaaatgtattatgcagtggtggctttttggttgtttcatttttcttcttttttcttagaagttactaatatacaggcatccatgtatttttctttataacttctgtagctctttcttgaatactggttagttagcaaaaccccatctgatccttgatggcacagagctgtgctttaagttctataactaataatttttgttctaagtgtggatgccaaaaaatggacatttcatatggtacttatactacataatagtctttaatttgatattagggtaatttgtaacacatcatttagactataaagtaggataatagtgtataaaagtaaactaatccatcttcctaggctagaaattaaaccacatttcatctgaaggagcctacttaggcttacttttctcaaactttcagttccctaacaaattaagatggattagactcatatttatggtatttaatatgaaacaattaaatataaaacagtgccctaaccttaatggcctatgtgaagactgaaagatacttttttaatagtttcaaacagaaatgaggtgctgccttaatctttttaggacctggtttttagaaacttttccactgaagtctacaatttttttttttgagtgatttttcataatttgcctttttgaagaacatgcagtgagcattcataaagtgtttccccctgcaccttggccccccgtctcatgcagcacatttatgacattgaaaaccaccagtaatagataacattgagatttgaaatttagttttacttaggtataatgacagaccaagtayaaggctttggttgagagaccagcttttaaatattgaaagacaaatatagtgtaaaaggcgcaatggaatttgtatagtgaaggagattctctagtcccagggttgtaatgtcacttctgtctaattcattacagaattacagaatcaaatcatgttagccctagaagaaactgcagatcattttgttcaatcttctcattatataggaaaggaaatttgagggccagtgcaatggtttgccaaggtcacacaactagttagtggaaggatccaggcattctaattcctttctttcactaatacatttggmctgctctacagaattacttctgtctgatactatccactttgaagagtagctagcatatagtagccatttacttttggctcaattaaaagcaaacatttttgggacaaaatcaggctttcctgattacttcttagataacagagcccacacagtattaaaacatgcagcctttctttatgcaaaaagattgaatatggagccacttgaatcttaaacttcagtctgcagctataaccaatatcatcagaagttatacacaattggcaaaagaatagcttattctgcccaaatacttgtccagtcactaggatcatttcacttttttgaataccatttgctttggggagggaagtattgccagaccrtgaattcattattacctctgatcagttttaaacttcatttgaaaagtggttccttctcgttttctccctccctcaggctgcatcctagcatgcccagttttagtctggcatgagcttttatggcattttgaatccctccttcctgagggtttataatgacagtgctgaaaaccacctggactgaagtatgaacattgccattgaatttgagggggactgagaatgttctttctagtctgttttattttgacagaatttaacatactaaggcttttccactttctgccataaacctaggtttataatacttttggggtgctaattaacatgatgtgtttttctccaggtggataaattagatgcttcagaatcactgagaaaagaagaagaacaagctacagagacacaacccattgtttatggtaatctctctctgtaacctcaaaaaattcattagacaaatatttaattacttagagactgtgcctcaaaatagaatacaacaagcttctaaagtgcaaaaggctttctaagaaatactgctctctactgtctgattttttttctgagaagtcataaagcaggtgttgatattattcactaaaataatcttaaatacaagaaaactcaaaaatagtcatttaaaatcataacatgaatctttcctatcatctggtccctcacgcattacctgctcataaattactgaaaaagaaatattgatgaattccattttcaaaagagcaaaaggtgagagaacatgccaaggctgtctttagtatgctttacataaagaatacatcctcattttaaattctaactggggcagagaactgggtagagtttccatttgagaactttccagagagataggatcttcaaactctcaagtgaatatttaagacaatttcatgtcttcttaaacctacatgtctgaattactgctcctttccatttcatagttggtgaacagattcatttgaacaatcactttgaagagtataggtagaagcacaataaccaggtgagggaacataaaaatatgaccattatggctgggtgcggtggctcatgcctgtaatcccagcactttggaaggctgaggcgggcggatcacaaggtcaggagcttgagaccatcctggctaacacagtgaatcgccgtgtctactaaaaatgcaaaagattagccgggcgtggtggcacatgcctgtagtcccagctacttgggaggctgaggcaggagaatcgcttgaacccgggaggcagaggttgcagtgagccgaggtcgtgccactgcagtccagcctgggtgacagagcaagactccgccttaaaaaaaawatatatatatatatatacatatatatatatataaccattatatatcaggctactgacacaaataataatatatacacttattatggttttgtctcctttttactgtagataaaaagtactttaggaatttagaggacaggatagttttgataaagtgggttcttagagatgggagcaagatgtttgacatgtttgagataggaaacacatcaagtccttaaaggtgaaaaagacataggaaacacagtaggaacaaaaaaaagatgggtgtaatactttggggttacctactgaatttggcttgccttcagggtgttttcatgggtagttgaaaattgggttggaatttcaagtagatgtcattatcaagattagggatgactttttaaaaactggtttctgttggctgggtgcagtggctcacgcctgtaatcccagcactttgggaggccaaggtgggcggatcatgaggtcaggagatcaagaccatcctggccaacatggtgaaaccccatctctactaaaagtacaaaaattggctgggcatggtggcatgcaactgtagtcccagctacttgggaggctgaggcaggagaattgcttgaacctgggaggcaaaggctgcagtgagccaaaattgcaccactgcattccctgggcgacagagcgagactccgtctcaaaaaataataataaactggtttccaataataatttgtttgctgaagacagctttggttgttaaccacaaaaagcaaagacatgaagtcctttgtgtaggagaaatcttgatctaggtttacactgtagtgggatgttaaaaatacttttgtaggggtagagagaggtgttacttgttttcgctctctaagccaagttctctacaggtcatgttttctgtatatggccaacaactatttaaactttataagaaagagtgtcaacatagtatttgatagagggtgtatgttctaatgtatttcatacctaaagaatgtctgaatrtgtctttttttttcccccaagatggggtctcgtctgtcacccaggctggagtgcagtggcgtgatctcggctcactgcaacctttgcctcctgggttcaagtgattctcctgcctcaacctgctgagtagctgggattataagcatgcaccaccacgcccggctaattttttttgtatttttagtagagacggggtttcaccatatcggccacgctggtgtccaactcctgacctaatgatccaccctcctcggcctcccacggtgctgggattacaggcgtgagccaccgcgcccggcccaaatgtgtcttatttttaatttaactgctgtctctaaattagtactggatcttctataaatgaatttggtttcattgccatttagacatgtttaaatcagaaatttaaatgtaactctaaaagttatgttaaaaacatgtcatttagaccaagcatggtggctcacacctataatcccagcactttgggagggcaagatgggctgatcacttgtggccaggagttcaataccagcctggccaacgtggcaaaaccctgtctctactaaaaatacaaaaattagctggacatggtggcgcacacccataatcccagctactcgggaggctgaggcacgagaatcacttgaacccaggaggcagaggtttcagtgagccgagattacacaactgcactccagcctaggcaacagagccagattcttttttttttttttttttttaaaaagtcttttaaaaaattcttttattgtgctgattttattgtgtcatgaagtgtaatatgcatgtaggtatgtgtcaagtatacagagtgtcaggcatacggtgttcagtcataagcagttctggcctttggccctgcactgtttgttggctttttaggtaggaaccttcttagagtaagactgtcatgctaaaattgtagcaatcaaatgtgccccccatacaactcatttgaggttgagattatgttgctagagtggaggagattggagtgttctaaatgctaacagtttgtcctgcctccttgcccctgccccctgctcctttttgttttcttctactgtaggtcagccccagttgatgctgacagcaggacccagtgttgccgtccctccccaggcaccttttggttatggttataccgcaccaccgtatggacagccacagcctggctttgggtacagcatgtgagatgaagcgctgatcctgtagtcacctattttcgtactgaaacatcgtctttacccacttctcagtttataatgggggaaaacaggcaacgtgttcttgtaacctttatttcatgaaggacttctttttgtttctaactataaacttggatcacctatgttaaaaccttatttcacattccacatcattttagaatttattttcgaaggggaatagtttcaatgttttattcacttgggctttttttcttccccctctttctttaaagaactgctcaatattcaatctgttgtgaagaacctgatttgcactctgtagtgtttaaagaaacaaagaaactctaatattgaatctcttaaatttagtgtatgtaaacagcttacaaatacgtattgtctaaatgcatttaaatctgttttattcaaagaaaagctaaagcaaaaacactgkcatatgaccatgcaagactgtcagtgccaacaaagacaacactaatcagcacatcgtacactggattgcagtgcttcccagattattgaaaaatgttacagacaacttgcctgatttttaaatgagcgtaaaaggccctctaacctatgcaggtttccccattatgcatatagaaaatgctagtatgttttgctcacttcatatgtaacaggtgcccttatgttgtgctgtatcctgtgctttttctgtgggaccattccattcaggagcaaagagcmccatgattccaatcttgtgtgtgtttactaacccttccctgaggtttgtgtatgttggatattgtggtgttttagatcmctgagtgtacagaagagagaaattcaaacaaaatattgctgttcttcagttttgtttgtggaatttgaaattactcaaatttaaaataaattactggactgtggaaataacatagaattgaagttttaattaaataccactcaaacgaaaagaacagtagtttttgtagttttatattggatactgaggcattagggaggcatgaaaggaagaggaatgaggattgagacatgtgaagacattgtgcattatatcaatgtgcattcctgtagttcattaacaaggtacatgcaatagtctaaaraaccagagtcactactatagtggcttaacatttaatctgtctccaatattttaaccaagtgacaccgaggtttttatcgaagcatttcacttaaatgaacaaatcatggctgttatattaacttgaaataaaatatatttaaacatgtagttaacatgctctttctcatcatgaattataaaggtgcccaaattatgggtatcttgatttttttcaaaaattggttgtgtgaatccagctcttgcttatggctgagaatgttcctaaagttcatttcactatcccttaatcctcaatagctacacatacccccttgcctagttagtcttgcactgctttacaactctcttaggcaaattacctaacataagctccacagaagagttttttaaaacttaaaatccctgtcccaccaggtgtggtggctcatgcctgtaatcccagcactttgggaggctgaggcaggcggattgcttgaggccaggagttygagacaagcctgaccaacatggtgactccatctctactaaaaataaaaaatcagccaggtgtgatggtggatgcctataagatcctagctgctactcaggaggcaggaggctgaggcatgagaatcacttgaacctgtgaggcaaaggttgtagtgagccaagatcacgtcactgcactccatcctgggtgacagaatgagactcttgtctcaaaaaacaaaaaaacctatttagtttcatccaggacattaagtgaaagtgtttaatgtgagtgcaggtcagtgaagaatacaatggtgcccctgctttgatttgtgggaggtgccatcagttttccccaccactgcttttgcaccctcagtgcaaatatcaacacagagaaaaaaaaaawtaatagtattatgaaaacattgactctgtggagaccctgtgggttctgcagagtatactttgaaaactataagattatgagttctataaaataccaagtacagatgaactagaaaacaagcatatatccacaattaccagaattttcatagtattccttttagtagatatgccatgacagttacttagccaccccatgccatcctgttgggaatgccactacctttgaatttggagccatcagtctatctgaggcaaacctcagaaattacctgagccagaatcatgcacttagcactgagttcaactcagtcttaacgttgcattttgttgcatcacttttgcagccagtaaacattctgtttagaaatagttgctattgtggcatcattcacagttgcaatttttctcctgtgctgtcatatgcctgtgcgaagtgtattaaatgaatcaaatattagaaatttcaaggctgtctttagtgttctgcccacaatactccaccaatgaccttagaccttgagatggtgctataacgctgcttatattgcagttaaccatagagaggtggagccacttaaaatgggcctattaccaaaattctccctggcatcattacagttcttggggatacactgattttagaaattactgtcagtatcctcctaaaagaaggcttaaatagtttctaacaagatgactatcaggaagctatgtggcttggggagttgggaccctctgcctcatattctgggtaactggtataacatagtaattattaggattgtatcaagtgtatctaaagatcaaaagggaaaaaaggcacccttaattgtcaaagttagttctaggaaaaaatactagcagggatgacaaactacgttcactttacagttaccataaattcttacttgggcccacccatttccatctgttaaggtccataaggttactcaagtttcagtggcttcattgttacaagaaaggggggaagtgagaaactttaataggctgtgatttagaaccactgctgattaacctttggccagtatgggtcagggaaggtgaacatgaaacactgcacagtaggttgtatcaatgctataaaactcaacctggagacaaaatttaaacaggttataaaccatgggactccattgagggtggctgtatcagtcacccaaaaagtgacagcaggggaacaaactgcagcttgcctctagtgggaatacccttgaacctcgacctccagggggacagcagcatagtcttggggaagggctaccaacacaaagggacctaaccatgtatagggaaatgctgtttcctccattttaatccaattgtatcatgacctgtttctctcatcttaaatatctgtttcagcctctcacttgaaccaccaagaccatttaaccaacagtactgtttttaagcccaagatgacaactgccaaccatagaacatgggaataggttttattttcatctcaagaacatttaagttgggtgaagaaattcagcttttgttgttagaatctgacaggcttcaaacacttgtgatggaggggttgttgtcatatcaaagtccacctagtaaagttttaggtgaccagtgactttgtcaattaggtctgctggtcctggcccaatccctaggacagtttgagagcctggtgcaatctgagtacgtccagcatcttgaattaaacttacagtcagtcccagcatttttgcatgggccaataatgcaatcagggtttcttmatcaggagctttgaccaccaccttgggctggccacagtattcccattgtttgagcatttcaggatttcttctttgaatctgcttgtaggctgaaacagcagcatgagagcactgggcagccactttcccttttcccatctttaagtcatttcgaaccacaagaatcatcttgtactccccgctgtctcccaagatgcttgcttcactttcagtatctgtgtgtgtcttgctcgtcttgcttttggggagcatcccaaagcatactcgaaggctccagcccaggcacatgccacaagcaactccaacagccaagccgagtgtactgggatgagccaaatattccataaccaaggatttggagggcatcttaaaggaaaggmaaacagttatcactatccggcagtaacaacttacagaggtataggcttatcagagaaacattttgactatacacttaatggtcatccagaaaaaaggcaaaacacacctttgatcttatgcctgcaccctgtttccaacaccctcttgcccaccaccagtgtactagaaaagattcaagcatccacatgaaacagtttaggtcattttgaatcttgatgtaaacgaagttgcataaagttcaaaaactctattcctcagtcttcccttagtcttgtggagatgttccgttttaccaagatgcctaagatttaaagaaaccaaaaataaccctttcctggaatacagtgctaatcggtgttttcacaatgcagtggttctcagtggagatggtatcaaatcagttaccctcagaagaacctcactgtcacattaatgggcctggagtgaggtgcactactgaaatttactaagcctgagcaaggatgctaaaaaccttacaaaatgaagagttgtcccattggacgtgagtgcagctgaaaaacttaataactgagatgagaactcaacatcattttacttaagaacacaaaatattttttgcatagttttactatgtacaggtgctcctcaattttccatggggttatatcccaattaacccaattaattgaaaatactgtaagccaaaaatgcatttaatacacctacagaatatcatgacttagcctagcctaccttaaatgtgctcagaacacttacattagcctacagttggacaaaaatcatctaacacgaggctcttttataatagtgttgaatatctcctgtaatttattgaatactgtaagtggaaaacaatggttgtatgggtactcaccattaatttacacagctgaaagcacagtggtcctgaaaaatgtttgaagcactgaaatagaattaattgctggatgatggggatgcaacagggtcctcaatttctctctcttctgatgaacatcgagaataggtggtagaaggcattgggacatcaacactagttgatggtttagcaagcatagtgttgttcttcaggaagataccaagttttgaccgtacagcttgtttcttcttttcactatatatttctctgtagcaagcaagagcatcctgtatctgcgcctgtcaactgtggcgaatctctcgtaattgacgtccatttcttctaacgtgtaggccactgctgatagcagcaaatgcctctgccagtttctttgctgtgaactttctaggtgccgtgggtgtaacttcttccactgcctcaacgcctttacctctttcttcctccagtgcaatcagctccttattgcaaagatctttagccataattatcctatgcagctgttccttaaaagctatggcaccttcattaccagcacgtgctgcctcaccagtgatctttacattgtgaaaattatgacgccttttgaagcgctggaaccatccatgacttgctttaaacatttgtgtatatgtaggatcactggcacggtcttttagcatattaaaaagacttcttgccttagcctggatcatcagtaggctaagtggtatacgcttctgtatctggtcttccatccacataacaagtaatttttccatatcatcaattggtccagcccttttctttgtgatgacagtggatttaactgatgctgacgatttcgctgcatcactgatttgcttcttatcccttaagatggttgaaatcgtggattgccaaagtcctaactcacgtgcaatggccattactggcttgccaccttcatgctgggcaattatcttgagtttcatttcaagagtaattgccttcctcttcttcatctcaccagaaacaggagacactgatggacattttgtagacatgatggaatgtgaaaacacaaaacacaatatccaaaaaagctgacaacacagtacacggtagaggatgggttgttgattcccgtgatcacatgggtgactgggagctgtggctcgctgccgctgcccagcatcacaagagtgtactgtaccacattatcactaggccaggaaaagatcaaaatgcaaaactcgaagtacagtttctactgaatgggtgtctctttcacaccatcctaaagttgaaaaatcctaagtcggagactgtccatactgaattttccagaagtgtagctatcataaaacaaaggaatgtcatcctttattattttagaaaatcttgctacttcggcaaagctgttcataatatttgagtcaccaataagacacttatatcagtctacaaatgaggctgctggattcacagtgcttctatgtggcaagcaactatcagtttctttttctagtggagtattatctaagcatttataaacatggggccactatatttgtaatgcactgtatttgtaatgtaaagtggtgcccttggaattgtgcactgcatgattggcacggcatagatgacagccctggaagtacttataaatttcctttatgttcttctttaaagttagggcattatattaacattctttccactaattttaacataaaaggggttactgtctttggtggggcagaaattcgtttgaggtggggtcaagagatagagcaaaaagaaaaagcaatggatataaggcgacacagaggaaagcaattttttttttctcctaagaagaaaggataagcatatttaaatgttaataggatgaagccagaagaaaggcaggtaaatgctcaagatagagaaagactttataaagggatgtggttttggaaaggaaaagggacacctttcccaatttcagttttaaatcaagtaggtccacggatttgaaggcaggaaagtattccccctgagggaaggagctcagacagaagttaaaatggagtagagaagagaaaggcggaaataaaaggtgtggcaaaatatggcaggattgcagaggaatattgaaagcatggttaagattaatgatgactttttaatggcaacatactatttgtgattttctccagtagtacttagaagccaaaagactaaaactactaatcacttcctccagacatacaaactaacctccatccacactcatcctttgctctcccctcctactgaaatggtagttggatgtatccaagtttaaattatgccaggagcacgccccaagacacagtggtacaagggaatttaggataagggtaagaatgtttgacatgatagaccatgcaacctgtgttattacatttttctcttttggcctacctgataaaaagcaacctgtattatcaaagactgatttatggacaataaagtgatgcatgctatttatctagacatgctgttgaagaacaggtgtaatgaaagtaaactggaaagacttagagcgatgcatagggttttgattttggagacgaacaattacaaagaacatagctataggaatgggtatctgaaatagaagtgtgactactttctactttttcaattcttttagttttatgatatactgcttcccttccacaaatactgattgaccctgttctagaatctaagggatacaggagtgcacaaagcagaaaaagtcctttctctaatgaagcttacattttagcaatggttttgaaatggtccaatcctaattttgaatttctttcatgctgttttaaaactttggggtttttttgtttgtttgtttgtctatttgagatggagtctcgctctgtcgcccaggctagcatgcagtggcgcgatctcagctcactgccagctccgcctcccgggttcatgccattctcctgcctcagcctccctacaggcacccaccatcacacccggctaattttttttttttttttttgtatttttagtagagacagggtttcaccgtgttagccaggatggtctcaatctcctgacctcgtgatccgcccacctcggcctcccaaagtgctgggattacaggtgtgagccactgtgctcggccaaaactttgtctttatagctcaaaatttccacaatactttgacatgtattgttatttgatccactgagaagtgaggattactgccatatcaaaaatgaagaaattcagaccaagagaagttaagttcaataaaacaaatgtttactggctatctatgtgccagccatacaccctgttaagctgaggatatagtgatgaatatgggccactgtcagctgttcatagataagtagtgaagacaaataattgcaagactggtaaatgttataaaaaggtgtttgacagtcccatcgggggtgagatgggaggcagtaacagatcatcagacattagattctcataagaagtacacaacacagatccctcgcatg

SEQ ID NO: 12237 - DNA, 448755 bp, Homo sapiens
  misc_feature (1)...(448755): n = A,T,C or G, or insertion/deletion polymorphism (see Tables 1-2)
aatattacaaccataattcaaacctcaacaattaaaatgataagtttctctatttcaaaaaggctacaaaagacagtttatttgttgccaagattctctgtagcattgtgcattgcatacagtaggtgctcagtaagtgtttgttgaatctaattcaataacaaacctctgagatctgtgccataacttcagcaatgtagaaaaaagaagatcaaggaccgcaggtttgagggtactgaacaagtctatcctcccggttcagttcaatgctctgcaatgagttctgttttgttttgtgttttgttttgttttggggacaagtatctttgaatttgaatctaaattatgataatatttttcccagagtttcattaaatctttcaaatgcagaaaaattgagagacatgtccagtggctacttctatacccaccacctagaatggtactgatttattatctcctacttgtatcaggctctgagctaaacactctacaaacctctcactctactgcccacaactgcctgacggtggtgaacataactctcattgtccaaaagcctaaaacagaacaagccagcaaacaaacaaaaaaaccctaagctcagaaagtttcagcaatttatttccttaaatcccttcgagtaataaatgcaacagctaagatttaaactgtctggctccaaaaactgagttcttcccatggtaccaaacagcctccagaattcctttcttctactgactggggtcacagattttaaccaagcacctacagtatgagaagccctgaattaagtcttgtagggagaaccgtaagccgaggcccttggggcttctgccatttggagacgaatcagatcaaattttacaattgtggagtttgtcacgtaagcaacatgctatgctagacactttgcagggaaagagaggaagaccatgggacaaagaatctaaaatcatattttttgcccattacacaacctgcagtagtgaatcagattgagtaaaagcaggagtcttacctttctctactttctctctgcttactctgttctccacagctgtaaagcctttccttagtttcttttcattacctaaaagtctgtgtatatctcaaagccttcttcagtttccattttcctctaccaaactcctcactgagtccttaaatatgcattgacatctcccttctctgaattctcatggccctttgctttacaaagagtcagtatagcttagtggttatgaacacagattgcttgggttcagatcttggccctttccctctttggagatatgatttgggcaagtactttaattctctatgcctcagtgttctctgttaaagggggtatatcagttgggattctgttgcaaagaacagaatttattcttgctaatttaagcagaaagtgatgtgttataggatattaaataacacataacatttgagttaccaaagaaaaagactccaacttgagctytctgaagattccagtgctgctttacagaaacacatcaccatgggagttgctgcctcttccacagccaggaagtcatctgctgctgaatggaaaagctgcatgaaacagcaagagctgcaagggccatgcccaccttccctgatccagctaataaatgcatgtcccatgcctgcctcttgacacctgcaaacatagcaactggttagcatggttacaagaaaaacctcattgctctgtagccatttttacaagcagacagagcaaagtgtagtagcttctgcctcacttcctccttccgaatttttgtagtacttcagagtggctagttctcaattccatccagtaccctagctgcaagggagtctagaaaatgttgtttctggacttcaggcactggttgggatgaaggactgctaacccatcattaaaaacatctatgtgaagttaataaatgtacctaccccatagagttgttgtaaggattacgtgaaataataaatataaaatacttagaaaagtgcctacacatgggagactctcagtgtatgtagctattttcatctgtcagcgtctcagatggtagtcctggggaaagtcaaacagcctttgatagagccccaaatttcctgcctgctaataactttgatgaacccattttctacgtaggaggactggtttcctcatctgcaaattggggataataatcactctctaactcctagagtttctgttcatatcacattagatcatgtgtgaaaggtgatttgaaaactataatgaatgctctaatggctttggtgttaaatagatactaggtgagttggcaagttgtggagtaatgctcaaatttcagttctgcccctgagaatagcagtctgcttcctatacttttatcttagtcgcccttactttatttttcagaattaaccagggaaatcgaacttcactgcatccctgtggggaaaacaaggctcagatgctgccataaccacttccttaaagaggggagattaggcmctgcctagctcttgaaatcctcccagccctgagttctttccaggagaccctgtgtcccctatacactggtttctgcagctgaygggctaagcagagaggctcaacctgaagaaagagacaggtggctccagagcaagacttgtaacgaattctccccagggagagaaataccgaaagtttagctcactctttcctcccayaaagcacactgaatgttaacagcttgcttctgtccaagctggtgtcttttcaattaagtattgttaaatccataccatttggaatgatgcttcagacagccctgacactctctctctygcttctgatttcatttcacctaatatgttgtgcatggagccagtaaccagtattattcagctgccacggcttctgctagtgctgctgctcacacacttgcagacggttttaatttagatacctgaagaggaaaaaaggaatttggccaaygccctgctcagatgccgtaagtggcctttccccggttgccattaatatggatctagattacctaaagttttacattacttttcctaggtgctgaaaacgttttagaaatgagaaagtcaagasacatagaagctggaggctaaaataagatactttccatcgtcaggtaacatatacccatggtaaaccctggtagcctactttccttttcctataaacatcccccttcaacaacatcactgccaacatctgaatatatgtatgtgtatacatcatatatagatataatgcatatatatgaatatgagatgagggtggatttagattcggtaaaccgtggctcaatggccagttctagccagcaaagctttagtcaagtcacttaacttctctgagcctcagtttccacgtacataaaatggggtgattacttaatttcaaaaagtagtcacaaaggtcaaatgagatcataaatgtaaaatcactttgtaaaccataaagatggcatgtacattttggccatcatcaaaattagttcatgaccaaaacttttcccagtcaccttaacccaacttgattttgttctcccttttctgaagttatagtaaatttgtaatttcacctgtactgtgtagctctggatgtgcaattgcttttcctagtttctctgggtattcccaagaggaaagaaaatgctgtgaggaatcagaagcatgagacagtgtggtgggcatcctccaggcattcaacaggtgattgagggcttaactttaaaatagtatattattcggtgacttcattgagatgaccatcttgctgtacattagcatgcccattaaaacttcaaggcagaaatttctgactcaaaatacctaggcagtatttatttgcaaagcagaaaagaatctaaactagcatgtaagtggttcccagttattttctgaccatgctgattatttttctgttcctctacaaatagtatctcatcattagctttgttgctacttttctttctcccattacctattcttccctttggatctgcttaatgagcagggtttatgtgtgaagagggaggaggtggtattaggtaaaatgttccattaatagaactagctgaaactcttcagttaatgactgtgataggagggaaaaaaataaaccctttagcagaaagctctggtgtgtaacagagagacacatgtaacatagctttatgaatgaaagtttatttcaatcaatcacctttctttaatgtgatgaggatttcagacaaaaacaatagtggaaagacaaagttaagcatttttacatctacttgtgaatacgctttagcttatgagcattagctagtttttgagagatttgtaaaacaaatctttctaaaagggaaaagcatatttcaagaatgggctctctttgttatggatttgtactgtccatttttctaggtccacatacttaatattgagaacaaaggataatctttgtatgaccttgactttcctaacagcatgaaaataggatttttaaagtttctctctctttaattgatataccatatgaagtaggtaacctaaagttgaacaacctgcttttcttcacctttttgaaaagcaacgcagcaggtatgtacataggcagacctgcctgtattcacatgcccattatggcttgatcaggttttccatattcgtgtgtttcatacctcttgtcagtattttttaataatgaaaggaaagaacattaattctaaatgtcttgtacctccactgcatatatttctgggctatcaggagatctgaaaagggaaaacgtcctgatgacacacctatggcaatgtaaggccagggctgctcttttattctttcaaaactcaatgatttcctttgcagataaggggaaatacatccttgtttgacatttgacacttttctaaaactgtaataaaaccttcctctagtagagtcaaatctcccttgctggtggattaagcagcttcagaagcttcctgaccttctcgttgctgttgctggccttgtcgtcatttcactgctcattagcacttccttcagggctggactggcctccaaggtcatcccatccaaccctcttgcaatagtggatggaaaaatgaggtaaaactcagttcagccttttctgcattataacagctctgataaaggacgtgggtgaggtgcggaggaagctgaaacttggttaaaagaaggtttggggattaactgaggatttaattcatcctttctttctctcccgtggctaaaatagatagttgagagttggcagtgcatcaaaaccaggctgctcctcaaccccaaatttcagccccactcatcctggagtctttgttgagggtttctttttaaactgggggatctaagtttctaattgtgcctttacaattagcaaatcttaaatgccttcaattgtcactttacagagaagcaacttgctttgtttttttccccccaaattaagtccttaataacacaaaataacttatgccactgtttaggcttagtgaggaaccttcagaaaatgtatagagtatttattttgcaagtcaagagagaaagtaaagaggaactttatggaggcgaaataaaacagttgtacagaacacatttacagggcacattaagtcggtttttgtctatggttctttccctttatggcatatgttatatattgacagggattaagtttctctcctgaatggaacaatacacagtcacagggagctactgtactttacaaagcaacagacatcagcacaggcaaatggcaaatagaaatgcatctcacaaagaactaaccaggtccatgggaagcacagtgcttggcttcatcttttgcaattctgcatcttttgcatttcccttctcgctctgctgctcgctcgcctttctttttcgtccttttcccccttttttgctcgcaccgttacactttctctgtcctcctggctttgttattcagcatgtctgattagcaggagcctgattggctggctgcctgctccgagagagattccattcagcttaccccccacccatccacccacccacccctcggtcaggaaatgtgagaggggctgatggaagctgataggcaggactggagtgttagcaccagtactggatgtgacagcaggcagaggagcacttagcagcttattcagtgtccgattctgattccggcaaggatccaagcatggaatgctgccgtcgggcaactcctggcacactgctcctctttctggctttcctgctcctggtaaatgccttttcatttcaatgcattgctattgccattgagtctgggtgctgttgggggtgtgtgtgtgtatgtgtgtttgtgtgtgtgtgtgtgtctttatcttaaaactccaggtaaaataatttacacgattacaaagagagaatactccttctagaacttttaacctcaacttcccaagcaagataaagtctgcaagactttctggaattagttactgctatacagtaatactgatactgagacatgaactttgggacatactgcatggagyttgggagctgaggactgtatatatggtggtgtgtatgcttggaatttggataacagacatcctgaaattaaactcactcactgtggtgttcctggaattttttgatggataggctttgcagagcttgcccgtaccgcctttaatgaattactttccatctatgcacatgtactatggaaccaggtaaagaggggaatgagagcctctttgcagccaacccagattatggctcttaattactgcaagtcatttatggatagaagttaatgctaggatttatgaattgaggattatggcctttgatctcaaatttacttttaaagaagaaaaaggaatggtgacttttagtacggctgattgccacagtcatagtgataagatgctctgctcttgaacgtcagtacacattgcatttttgactcgaagtaaatgttccgttgtgactcatacttggttttatgggcagaaaatgaacatttactgtccaaaataaatctacactcaaaatattaatagcaatgcacattttttaaaccagagtgttctgggcaggcagcttagtaaacctcatctgaaggtttgattccaaaatttgcacacactgatccaaacaaatgtgattgtagtttttcytgtcacatttataacatgccagaacttcctcagaaggtaacaaggcaggaagagaacaaggtaaaaatgtagcaaatgaataggttgcattgattccttgatggggaaggaatgtttgttctgattatattctgacaaatctgatctgcgctataattttgaagtagggaagaaagccatttggtacaaactgaaaaagtccaggagattcatcaaatagagtaatcagacagtgattcaatattttatacattcccacttcttaatgatttgcatcattgtagctaagaaattataatgctgcattgcaagtgctataaatatagaaataaatttttaatttttcatagaaatttaaaggtaaactacatttcaagcatgaatgaactataagttttagctgttctgaaaaatacaaagaacagaatgtttaggtatgctttatgacttgtggagcaagcgatttatgaaaggtgtctcattttttccatatgggatgtgttacttgtatacaccattagtttgtctcatctttccttctttgtgatttttttaagtgtgtgttattttcccattatattgcatcataaagcaaattaccagtatacattacttttttgatattttcatatggaagtatgatctcattatactttagtaaaactttcccattcaggaatagattgttttgctatccatttggtaaacgcattatatccctctgtgatatcttgaatattcatatatgtattagagcatataatttgacttatgtggaatgaaaaggtatgtatgcttatttcagaaggacttaaaacatatcatatttaaattacaataattgtattataaagataaaattaaaacaaacctaggtttgttttatgcctgcatttaaattaagtggaaatctgagagttatgctacaaaaggaagaactgactgatgtttacatacatccctttgcmaagcaataacagcattagtaatagctgtcatgtattttgtgtctgaatgtggctagttgtttgaaaatcattacaataaatccttacaataatcatacagataagacattttaaacccgttttttcaggcaatgaaataagcttgcatttgaacccaaaggtcaaataatggagagaatagaacatgtttgcttcgtatggtggttgtaaatatttaagaacaatgaaaacagtggtgcaggttggtctgtaccctttgttgcagatatttaggctttctgcatcatcttgatcattaaagatatgtacaatatcatgagcacttgttaaacttgctcattaactgccccctttagcattaaatttaattattggcttaagagattgtgacctttagcctgttgtgtacttgatttagaactagaagtgtggcatcatcagctcaaccttcaaacttgatagagaaattgaattgaggggcttgtttttcctatagtcttttttttgtttttgttttcatttacacattgcaaggattctgtctattcttggacttatttggggcaatttctaaaggtctctgtaacttaattggaaaacatcctgtctattttgtggcaagcccagtttctaccttattaaaatatccctcatttcactgacagctgaatcatctgtatcatgactaggttcttgagtgtgtacaaatattgaaggttgttcagccttcattctgtcaaaatcctttccccttggaacttatttctgagaggatgggtgttgaatctattttacgttaccacccatattttcatgcacagaacttatatcataaatttatattctggacacagtaggacagtagtactgatcaagagatttcatttgatattcaggtgaaattaagctacataatgccattttctcaatcctcccattctgctttctcgtatttattctctctcctttgtcccaattgtttagctcaaaaagaatgtggcaaaaaccatgaccggccattgacatatgtgtccatctacacttgaagtcaaatcacttcttgtcagaaaggcatttaatcaaatttgcatttgccttttgtttcttttaaacggttttaagctcttttgcctgctattgtgagagttgcaagagtaacactaggaattataataaagtacatgtgttttcctgttgaatttctttttcttctctgtactaatttatacatggcaactagtcaaacacaatagcccattcccttcagtccctctggcactctctcccactattatctaagtggatctatcttggatggggagaagcacccttagcttgtggaatgaatgttaagtcccttatttacaggagaccgcggcctgttccagcagcatgtatgtcagtgtgttcatgtgcatgcacaagcacttttctataattgttcactctacacagatttctttttctcagacctagattgtctttaaatcaagcttgaagacttttcgcatagatctacagaacgctatgaagcatttaaaatttaaaaatcactttcttcatgtttttgtgaagtttcttgtctagacatggccagctacatttttgtttactcaggctcctgtttttagtgtttcagtgtgttcaggaccactttctggcccccattattattttcacataacaccatttctgttgcttcatataagttgagggaagagtgtccaatagtggtcactagtgaactacagaagaatcttgttacaccaggaaagtttttccttgaaaaagcatatggaaattgaagtcttttgagagacaaagagaatgaataaataaatgcatgtatgtatttgtgcatttgtatgttttaatacatgttgatgcccatttactattatgtatgtataaaytggaaagcagtcttctaacacaccatggagtaggctattactctaacttaggagattcacatctcctaagttgattctatcctactaacaatattacagttagggtttgcaatttttatcagttaagtgtcrttaactctatacaagttactcatgttttttaaaaacttagtttacttgggctgtattttgcttggggattatattagcatgagacatggtctggtgttttggttctccccttyattatggcttactcagaatataattttaaactcttccaggaaaaatactgggtcctatgaatttctgcttttcccgaagcacctagtagagtgccgtgtagatacagtttgtgaactaaatgaagagaaaaaatgacttacagagactatcgaagggttctttaattcttcatattttcagtgattcttaaattcatatgtgtagttctgtttctttggtcaagtgacagctctgcttttaattcatgtatcttccagtttccaggaatgacacgctctcaggtccagctatgtaagtttaattgtgccctcctctcagtaagcatattctactgtttctgtggtctcatgagtagagtgacccagaagtgacctcttcgtagcataaggaccggagccttttcttgagtgagagcattccttsaatcaccatgaataacctactggttaactgtattgagataatcacaggaaaatgtgtctaaatcaagttttacagtcttgtcattgttactaactttcttcttttagagagctggcttcaaactttgtgttttcaccagaatgagacaagtgcgtgtcattttctgtctacatcataaaaaccataccatgtggttgaattttggcttgattggcagtactggctcatgagcggcttaggactggcataccagaggtgatgtaagtcctaaaggatcctaattgaaataggccagcacagctgtgtggggagcctgcctgctaactggggtaagctgttgctatcaaccccttctttccatgagctcaaaaataaatgactaaatctccccaattcccgaacttcaagattaaaacctacattgaataaagcttaactgttctgttttgcctctcagggactctgttaactggagcacccagcatggagggcagttagttaagttttctggccacgtcaagaagatgcccaatggctgtaatctgcagccaacagtgacctcaggctttttgtttattgtctttcccaagaaactcagtattcataaatccattaaaaagttttgctgtatccacaagcattctttattttgattagagaaatatattttatctcatgaagtaattgtaacctttattaggagaaataccataatttctgtgttcaaatagccccatcccaaattctacccatatatagctatgtgtacagtcagcgcttagtaattgcttgtcagaaggcataaataattcattgtaatctctaaaatattttatatgtaatttttatagttcttgggctactttgcatttatctgtgccatcgcccatctcttacttatcttacacttctttctgtcccacaaagctgtgggggacagcagaaggtgtgacttgttcctcctgcctctttcagaatgcctggtaatttgatctcaataaacgtgggtgaatgaataaataaatggaaaaataagaatgacttggcaagaaaaggtgaaaacagggaaaagtacaagtaggaaggaaaaatgtcagcattcattttacatgtgaagcgtttcactatttctggttttggtaagaccaagtcatcaacgctaagaaacgcaaaagaggtatatattctgtattcctttctctgtcttttaaatatacgtagccacacactgaacaacaattaacccsttttgctcttgttaattagaatgaatcattttggatgtttcatatattttttatccatttagttctcaaatatttttcctttttcaaaacttgtcctcaggaagaaaacgatacttacattagtcacagttttgtaaaacttgaaggtacttaaaataaactctcatgttagcagagacaatgctgtggattcactaaaacctgtttcttcttgctactgggcacaatgataaactgtatttgccagccttccctgtgactggatggtactatgtaattgagttctcatcagtgaaaaatagctagaagtactatatggcacttgtaggcctgatccctcagcctatgtgatcctccaagcatcaaacactctctctttacccacctgctggatgcagagaatccactagaaaaaacttcatgactctaaggaatggcaaagccaccaagtggaagtctaggtccctgaatgactacatggagcacagcccctcagtgtcactctcacagacttacactgtgaacattcatttaaccatgagcaagaaacaaactttgttgtgtgaaaaccctgaaattttgggaaaggtgttgtttgttatgctgaaaacttttaagaaataacatatgcttcaaatttagatgctatacatgccagtacttactcataagtaagtactaataccgttttccatttattatatgggaaaagagaactaacaagatgccacatcattctaatggtggtttgatctttgcggtttgcaatttactgcatacctgaagtgtgataagtagttgggggtatgtgtcagtactacagggaaaataggaaaatgggtccatttttaaaacatagaatctggaagtggatgagggagtggtagaaaatgaggaaagaaaaccaaagaggcaaggctgtggtgaaacagttgaaatctcctgggacagagtgggatcaaacagtgaggccaagaacatagaagcacacagatccaaggggraggcraatataacagaaaaagatgctgagaagctgaaaccagggtgcaacactgaaactgctccaagggcagaatgtcagaaaatcagagtgaacaattcacagagagggaacagactcacaaaggcaaagtaaacaaatgttttgtacagcgatatataaagtaaaccacacttcttgaatatccctagtttcaaacaatctttaacacatttttcttggaggtgtctgagtgccatgaaagaacagtggttttaggctgggtgcagtggctcacatctgtaatcccagcactctgggaggccgaggagggtggatcacctgaggtcaggagttcgagaccagcctggccaacatggtgaaaccccatctctactaaaaatacaaaaattagctgggcatggtggcaggcatctataatcccagctacggagattaagtcacaatctctacagtgaagagcttggaagtgtgttggacattttgttgtcaagagttttttttttttttaatttttcaaaacacaactcttctgtaggcaacagttctgtgatggacattattattttcaatttccccacaagctggttcatcttgtaaataactctctgcacctgcttagacgctgtttgtttaatccttttatccctgtgtaaatgtaaattatggctttccatagattatgaatgtgttattttcaaattatcaatcactatttgactctgaacatgaaaagttatttttactgtttctatagtttatagtctcaatttgtgcaacagaacacactggaacaattttttagttaatattctttagggaaaaactattttcaagataaatggttatctttgtgagaattaccattatgtgtgaccaatgtctagagagttttcatctgccccactatcactggggaacctgctgccagattacaatctgtacatagtttccactacattgtgctttcttggcaacaaccaaaatccacgcaaaaaacaaatagattccatttggaattatatttctgtcagtgcaattactatatgaggttgtatctcccatcctcattagaattatacctaaagttcttattaaaataaattaattrcaataagaccaagatgaccttgtgcatcaaaagtaggatagttgaaagaaagggaatagcagaaaaatcacgtgcatgaacatatgccgtttataatacaggagatttattccacttctgaggcaagaaattgccggactctaatagtttcaccacctgtgaattatttgggtgcacctcataagcgggttctttcttctatttgtttaaagaaataagtggtatgtttgccaattctacactacattaattttcacggagtttccattttcatcttcattgctttttcagatttttttccaaagcttctgccattctccagctaaagctttgggtattttccccttcaatttttgtccagggactttctctaagtcaattcagtttgttggcataaatgttgggatgaaaagagcgtgataacctaagacatcctgacataaattccaagagcactacagaaatgagacaggaaattgtgagcaacctataataaattcaaactgtccaataaaataaatatacctcactttgttcccatagtaaggtatggtagggtatctgatttctcagcctcctttgctggctgtaatctcagtcaccatttgaagtctgtatgagtattgttagaatattgtacttcatcaatacaactaggaatgaaaaagattaatggaaacaataagaactcctactgttcaggtgtgcttaagtgagatttggtgggaacgttttcagaactagccggttctttttttctagctgttataaccatttgtcactgagacctaatataatttccctgatatactacayacttttagttcttatttggggcttgtaactggtctgagataacaaacatgctttgaaattactgttatgaggttaattggcatttaaattcccagcccatagattcatagaatggttttagaattaaagggaacctttgatgcatgcggaatgtgacctcagttgactggtatctctttgaaggcaggggttttgttttattttgtcctgaatatctttgtatctctagcaccagacaaagagtttgatatagaaaaagtgtttgatgtgtttgtttgaataaattaattagttgcctattccagccctttcattttgcagataatttaatttaaaataaatgtctgtaaagagattcgagttatatttatcacgagcatctagtacataggatccakatactggaatcttgtgctgtttccttgtgtctgttctccttctattgagttcattctcctgtattatactgtgtggcccctttaggacctttaaatarcagccatcatgctggctttggtagagagggattgaaatgttgaaatgtcasatgcggaagaaaccaaggatcgaatgaagctgctgcaaaacaatcttgagttaaaactcaaagatcggcgtggcgcgctggctcacacctgtaatcscagcactttgggagtccaaggcaggtggatcaggaggtcaggagatcgagaccatcctcgctaacacggtgaaaccctatctctactaaaaatacaaaaaattacccgggcatggtggcgggtgcctgtagtcccagctactcgggatgctgaggcaggagaatggcgtgaacctgggaggcggagcttgcagtgagccgagattgtgccactgcactccagcctgggygacagagcaagactctgtctctgaaaaaaacaaaaacaaaacaaaacaaaaaactcaaagatcattgttggcttataaatatcagggtgacctggcaagaacagagaactaaaatctgtaaaatacggctcttccctagagttatgtcataccaataagcctcatttatcttgtttccctattaatgaaaaatgtggataatttggtgatgtatgtgtgaaaataacttcatatgggatcttgcatgtagcacgtctctgagaagtgctagctttctttcctccctcagtgcaaaatagcatcttcattgagagcctgctatatatcaggcactgtgctaggtactggctatgctatattgaacaaaacagacatggtcctaaagatgagtccttctacatagaatgtcggtaaggatttggcacaggggtgaggaagacaggaattaattggtcagtactttccaktggttttatgttgctgtcatgatattattttctttaaactgtatatttaactattgctgatgtaacggggtttctgcctaaagaaatagacacattaattcattatttatagtgattcaagaaagaatgtgttagaaaaactctaaatctctaaagatttatatttaaggtcatttctttgacttttgcttctttttcctgaaatcctcttttttaggaatactgaaacctaagcttaatgggtgtattactttgtctctgtgtttatttgatacataaacacctgtcttttcaatctagagctatgctaaagtagtaaaacctttaaaccagtccctctttcaggcaaataaaaggccagtcagctgcatatagaaggctaatgacagtaggttttcccacaaaaggtttgctaacttcagtttgctggtgctgggacttttattaagcaggactgtcttggctgcaggctccaggattttgattttaagaaactcgatcagtgggttttgcccatttgagagttctagatgatttaaagcagtgattctcagacttttggatttcatagactattaaaatttcagaaaaaaaataaggctggttggcaggtaggtaggagttacggaaagtagagacaagtttctaattttttgtattgttaactaaggacgctaataaaataaatttctctcaccatagtttcatcaatgaaataacattagttaatactcaagagagtacttgcttcaatgtaagaagcactttacatatactgcattaaattatctaattctcataagaaccctatggatggagccatgacaattttccatcttgacaaggaaactgaggcacagagaggttatgtaacatgcctaagatcactcagtcggtaggggaagrgtacagattcgaacygaggcagagttcattcatgtctcaactctccggttttcttttaccagtacaagaaattaaaggtcatttgaaaaagccaaaagtcccaggtacatgatttcagaagaaaaaaaataactaaacacatttagccttatggaaagctaaccaatgtccttattctctttattctatgtgtcaacacatactttgtcatggattggcctgctgtctgccagtcactttccttgaaacacaaagatraacaagacagtcttactccccaggaagctcacaggcaccaaagtttttaaaaaataatagaccgaggcagagcagaggatatgagtttctgtagtagcacaaagaagaaaacaaagaatgggagggatgctggcatttttctgtctgatgtgtcccaggcactgtcctagtagagaataactcaatggaagttcatcaggcagataagagagggaagagggggcattgccagcagagggacttgcacggcaaaggcccagaagaaggaaagggaaggtaagttcaaggaacagtgagtgaatccctatagctggagcacagccagatcatgcagggtgttgcaggccacccccagaagctctgacccaagtttttgttttagaaagacagctgggatggccacatagagtggaaaggcctggagaagggaggccaaaagttwcaagattattacacctctcctggtgagaagccacgaaggcagtagcaccagcagcagcagtagtgatgacaaagaagcgtaaacatccagctgtaaggctacatagttactggtagcaaaaacctcttgtgggctccctttgctgtacatcttgaggcctcagaggctcttataaagtgccagctgggtgctagggttctttagatcccactgtttagcatagaaccagggcttggaactgagtcagtgttcaacaaatgtttgctgaatgaaagtgtgaaagagttagtaattttattsaaggcctcccagttaaaatttttgacctacagttagggattatttttcccaaattattgaaggtattcgggaacaaccaatgtatctgtatcstaaaaagttaagaactttctgtcattcagcaaagtgtgaattcaggcccaagttttctgaagagactgccaaactgttgtgacttaaccctttattcactctcagcgagcttttaaaaatagaggctatttcaaaagggcaatcctggcctagccagcatggtggcccacacctgtagtctcagcwctttgggaggccaaggcaggaggatcgcttgagcccaggagttcaagaccaacctgggcaacatggcaaaacctcatctctaagaaaaaatgcaaaaattrgacaggcatggtagtgcgtgcctgtagtcctagctactcaggaggytgaggtgggaggattgcttgagctggagagatggaggctgcagtgagccgagattgtgttgactgcactccagcctgggtgacaaagtgagaccttgtctcaaaaaaaagcggagtgggagtgaaaatcctgtgctttttgaaagctttacctccctcatgtaacacaaagcccataacagggagtcatttttgtacctttgagtgattattgttgtctgaggctgtagtagtttcccatgtgtgatcttcatctgttttctcaccaaatagcgtcctactccactccttagattcatgtcacaattacgaatctttacatgggatgccagcaaatctctttgccctgattcttgcagcttttcacattgtctaacataggcatcacacgtgaagttccctttgaaaacagctaaaaatgccggtaaaagatgtagcattaatggtctaaatgtatctgccctgattaaatattaattgtggtcttcagaaaataatcaggccatatctgaaattcctcaatttatcattttatactaaaaaacatgatttgaaaaaataactcctaagttatactaaagtgagttaaatgtcacataaactctttatattgtttctttattaatcagattgctaaggcgtcagatttttaatcaggcattggaatctcgtgtatagaatttattttcctaattataaacgaatagtctccactgtgcatgtagctctttacacagcattagtacaaaattgattatagcttggcctcacctcataaagtagatatgctttggaacagcatcaaataggtatttatgttttaaatcacatggtccttctgactttcattctaattttggacgattaccacttttactttccttcctccttccctgaaattgactgcaaacagcatgaaaatgtctttagacttagcaaaaggggaaaaaaagttaatttcagtctcctcctaggtgccaagtactgtgctatttgtttatgtatgtcgtgtcatataagcctgaccacagatcacaacccattttaccggtaagaaaactgagtaccaaaacctaaaaggtgttatgaatttcctaacttttcatgtrtgcgtattcagtgcttagagcaaacaaatcttaytgaaatatgcagtacagattattttccatgttgtttgaactatgtttttggccttggttagcaggagcctccccagtgtgctgagcgatttccacagcttcagaaccaagttcattgcagttcacagcttgtaccgtatttcatcgatcctaagacacaaattttttttctgattatagcaacttgaatgaatttcataattatagcagccatagtttagtgagtggcatttttaaaagggttcgtaatggcatataaaataggaatgtcacttcagtctatagcatcttaggtttgatgcaatgctgtatcagtctttccaatatctaaygaatagaagcaaagctaggcttaagattcagatgcagaaatacgattatggaaccctctcattccctatcatctgatgtggattattcccgcctttatttactgatctccccaatctgagggcctggagagagtctgtatgtttgtcttaccttagatctgttctgtcacctatcaagatcaaaaccctctgcccaggacctcctttattcttaatctaggggcgcctgtttccttatctggaagcaagtgtaccataattcagtagcttcccacgtttggtcagtagccaaatcagccagacacttgttaaaattatgaaggctccggcccctcctacttcaatgagtatagacctctgtgtattttattagctttcttggtaattctgatacacaccaacatttgataaccacagaaatagtggttaagagatagactgcctggatttcaaccctggttccaccagtgtaacctttctgtcattttctgtgccccagtttccttgcctgtaaaacaggggtcaacaatggcatgtacctcaaaggatcattgtgaagtttaataaaacaagtcatgcaacctactcagcacagtaccccacacaggtagcaggtgcccaataaacatcagcaattattactctctccctgcaaggctgaaatttccctacctcattccagaaaccaacctcttgtctttccctggattcacagcagctgacagttttgcctcgtaactacagtcttccatgcaatctcaaagaaagggactgagaggaaaaactaagattgcttttgaatttgtggggtctggagcacattgaagccagtaagtctaagacagaataaagataaaagttggttcaagaaagtcatccagtgaattcactcataaatgcttgtctaatttagggttctcaaccctcttctgcataaaaatcacctcaggaattccaaacaaagtatctgggtggctggcagcctccatccccgcaagagattctgatacggttggtctggggagagacccagacattggcaattttcccaggtaatttgaatgtatagacagagttgacaatcactgatctaattgaatatttaaagggttccaaaaacctcttaactgttagtggatatatctcttatatttgaagatgctttataaactcccttcctccctgtgaaaatcaaaaacttaggagccccttgtccctaaaacagggataatatactgattccaggaactcctgtagtcaatgtgaatgcactttgtaaattgttaagtctayatgtgagaggaagcattctggtgcctaatgtgaagatgatcatccgatcctgttacatagcatgcacaaagagattcagaaatcctccagttaccaggatgtcgcgtaatctgaagtataatgcaccagccacttcaatgtatacacttttcattcaaaaaataggaaccatgaacatgttaaatcatttcgtaaaagatagaagaaattaaaaccttcctgagcccaatttgaagggacaaaataaaacatacgctgagaacattcagtcttccacacagactagtcatctcatcttttattttctttatttttctttttctagatggccattgtgtgagattaagtatttggtcatatttcccactgctcttctcagatagctaaatttaattcttatccaaatgaccgacttacccaactgtataccacttatttaattagacataaagagatactaaattcctctcatctgttgaggaaatgatggtaacctggctttgtctcctaccctttaacagaaacctcatttccccttttttcctaaaatgcccataaaccttcagtgcctcatagtagtattatgaggatcraataagtacgtgtaagtactttgaaaactgtaaaaccttagtcatctcgtgctcaaaagccttcactgtctccagctgtctggagtctactcaaggaccaattcctcagctgggatccaaggccctgtcccaaaccatcattcctatcttatgttcagctgttttactgcatgtgtcctggcacactgagacccatgccacagaggaactggcctggccagagctggaagcaggctggggtcccagttgtgtatcacatagaagaccactgcaagaagagtctgaatgggggctctagcagacagggggaacagaaggaagctacacagcagaagcagaataggtggcagaggcaattgattggagggagggagagggggtaggtgaaggggatgaggaggaagacagaggaggctggagaaagggraattgttgtatagcaatgtctgtatgttcatcactatgctagggggaaagactgctaaaatattggggccccaaatagcgagcttggttttggatgtgctgagtttaaagtatcaacaaagcattcaggtaagtgaaactagaatcctggagattggaagagacgtagatttgtaaatcacatgcaaggagaagacaactcaagtgaggaaagtggataagatcaatcggagcacagagagaacaggggcctgaggaaagagtcttggggatgacagcatttgctagtccagatgagtaagaaaaggcaggggacaaaacaggggagaactcgctgccaaagaagccaggggagcatattccgcagcaagatgtgagggaaagtcataggatgtggtgaattacaggatgctgatgaatttcagaggagccacgtcagccaagcggtgggcagaagccagattacaaagcactagagaattcgggagtattggggaagtgggtgcagtgaacatgggttagcctttcaagaagtttagaactgaaaggaagggaggcaggagacaggttagccctcaccactgacagagtggagtgtaaaggcaggaaagcacaaagcaggagctatgtgataaaagggagcttggttttaataaaaagaagagaaagtgctttcgtcttaatagctcaaagaatgctgatagcagccgtgtgtgaaattgatttctgaggcccagcaccagagacagagaggctgtgaggcaaatggggtagtaaaccatgatttagcaccttcactttctctgcttattacaaaacaggctttaaaaaagatgcctgtggtgtgcctcagcattcttgatattttctgtggccaagatccattttaatatattcctgaggcattttggtaattctaacactgcctgagacattaatctattaacttttcacattgctaagcatgttaatgcaatttaaatattatttctcttaaacaacatcgatgtggaaggaaaaagaactcttcttgctggaaacaaaaaggtaacaggctgaaaatgcttacacgttgaaagcacaattaagctttataaactctcaaagtatttgcttctactctgcaagcattgagagccagagatggctcacaaraatcacaaaaaatcatgtcatgtttcatgtactgttaataataaayatttaataagtggttttgcagatggctccttaacatgatcatttaatttataaattagaagatggtagtccttcccatatatacaatatctggattatatttttcagtttaaaaatgccaaaagtatgcagaatttagccagccccaaaacgtaaatatttctgttgactggaagataggaagagatgactgctatatttgtctctaatcaccattattatttcccattttaatacaagtagagctgtactatttacagataatgatgacaaattatagtggcccgataaggacaggttcttttagacagttattttaaatgaggcacttatactacaatctactctggacaagattttaaagaaaaaattgtaggctatcatgtttttgaagtaaatacctatttaactagagaatgcatggcttgattgatgtagttacaacaaaagctatactaagacaatagtaactgactctcatttattattgataaaggacttaatatgtaggaaagcattttaaaaaactaagttacacagtagggaagcacaataacagagtttctgttttgatacaaaacaaagtatgtcatgaagattattgatatagcacattataatacaaacatcacaggaagaaaaaaacatcattccttaacacttggctaggaattaagtcaatatagaaactgaaaaacatcaaataaagctgacttttatctcagcatttgggagacttttgcttacaagtatttattgtttttcaaagtattaaagagtaaactcttattaataaaaagtacagagtataatttagcatttcttttattattcagaagtcactttaggatctgccataggttctggatgcagaaaattgtattagcaaagaaagaaagtcccagcagagattctctgtttcaagagttgctttgtaacaaaacaattcttaggactgaagctgtaggactgcctctacttggatttcatttattaattgcactgcacaacgttttttcaygtattagcacttatatttaaaaaaataactctatgagttacayagagcaaatgcttatgttccattttacaaattagaaaattgatttgtaaatgtgcttaaatgaaatagactaatttagaatcatagacatttttgtagctagaggtgtctcagaaattagccaaaattcctttttgtggaagtgactaatctgaggcagagagaactaagttgcctaaaataccacagcagcaaagtcaggatataacaaaaacaccacagtggccaaatcctgttgcctagactgtgtccctgtttagaagtttttgctatcaatattatgtatgtacactctgaaacattttaaaattaaaagtgctcaccaaaaactcagcagaacagtaaacatccattgaacattaaactctgtatcaagccctgtgttagatattaggggttaagctgaatatcacctagtccctagcttcaaggacattgtattgatattttgcctctattaatttattttaacatgagagctctattacttgaattgcaatatttagttttatggaaaatctaatggaaatatgttctcccgagtccaaaactctgactttaaaatgtgtgttcagatttgcttctatcaggttatttttcctgattaattctgctcaactttacatctctctgtgatctatggttatctatgtattgtactaatttttacactcattaaaaatgatttaataagtattctttacttctttttaattggtagaggcctatgcttttaattaagccaggacttcctcacccacctctcttcattctcattcccagttctctttctaatcccagcacactcatcttcaaaagcacagcttcccaagtgctgcagagggatgaaaattgtttactcagtgacaggctccctttggcaaacaaggatctaggacttggataaagctagattaagccaagatgtgacaggttaatcatctttcagctttacacattttgggtaaatttagagttggcataaaaagacatgtgaataagcagaaatgtgatcctttttttgcccccatgattcagattcatttttgtcctcttctgttcccttgcttatctgcagcttctgcatacattttttccctctgtctttagataatctgaatgtatatggacaagagtgaaagctgacagctgttatgaattagacattcaactgcagtttgtcctaacctgccttgtgttaatcattcatttaatgaatattcactgagaccgattacgtatctggtgttctacaaggcactgcgcatattcagaggcatattcatctttgtcacagstcttaagaagcacacagtccacttctggggatagatgtgtaaacaagtaactatactgggtggctgacaaatgctaaaatagccatttgtatcaagtcctagcaatatgctcaaaacacacaggatggctgggtggtggctcacgcctgtaatcccagcactttgggaggcrgaaacgggtggatcacctgaggtcaggaatcaagaccagcctggggaacatggtgaaaccctgtctctaytaaaaatacaaaaattacccgggcatggtggcgggtgcctgtaatcccaactactcaggaggctgagacaggcgaatcgcttgaacccagaaggtggagattgcagtgagctgagatcacacgactgcactccagtctgggtgacagactgtctcaaaaaaaaaaaaaaaaccaggccaagcagtgattgattctacctagagataagagaaaattttactagaagatggcagtggcattgcatcttagagcaggagcaggagtacacaagtcaaatgaaataaaaagatgtgagcaagatggtgaggaggggaatctaggcactatcaagatcatgacccgattactagatgtcctcacagcacctgtgttactgagaatcatgaccaattactgaagtgtagaggccatgtatgattacaaaaagcaggaatgaatctagaatgttgatttagggccagtttatgaagcgtcttgtatgctatgctaataacttagactttaccctatatccaatggctcttcaccttttttgaagaatttgataaaagctataaatcctcgctccagaagtgtgatataacacacatatgctcaaaatgtggcatagagtttctgagagttcatagcccacctggcatttattaacactactaggtcccatcagctttaggcagtggagccatagaaaatctcctagcaaggagtgaacagttgagctttgtattctagcaagataactgggaatgatgaagaggacagactggtgggaagagaggctggaggtcaaaaacaccagatgggaagtcaattgcaragtgccaggcatgaatggtagtaccagaattaagtcagtgaaagtaagattggacggggtgagaatggaagagagagggatttcagaaatggaattgataagacttgatgtctgattaattataaatgatgttgagcagttaaatattttgttgttatctcaatcttccccactaaactgtaaatcctctaaaggtgttgctgactcacgcaggactcagggaatgagcagaaatgaaaacataagcatgcaggattagaaacttcacattcatgtgaaagcaacgcgtccctcaaaagccaagaggcagagggctatgaggtagggtagtgacctctgagactaatcactgcttatggacataaaatcaaataaggaactgttgaaaatagtaaacctgagtaagcagtgattaacttgttggttgccatctctaccttacatggtttcctagccccagagcacctcctagatagctaagagactaggttggtttgctttacattcrtaatgggaargtatgaccagaacctcaaaatcaacctactcccaaaactgcaaaatttgccagagtgttccaaatatccaggctactgcctgtagttacagctacaggttaagctagaggaaaatgttatctattgaaggtacaaagatatggtaattgagagagctactgcttcttagaacaaagtcatctaggttgcaggtacagagtttttgatggacttcatctcctagtgtgtgtgtgtgaaggtgggggagtgatacctatttgagctggagaacagaagaaagtccctgaaattgaaattacttggcaattttaagtgactggatatttctcatggtcttgctttctcccccactttatgcttactctatgccctmtgtacctttttgagagacaaatgacaaatatgtaaacrtttaaaataaaacgtatttccaggcatttcatcattgattaaatatttgttgaaatcttacattttcttcaaaatgacattcttaataattatttcaataactgtagataactcaaaaatagaaagcatcacccctgccttcaaagagcttccagtctaattggaaagataattgttatatagaatgataatcccaaagagctacaaagtcttgttttaatttattctatactgactctttgtaaactagtactacataatgggacatcaagtaacttcaggttaaggagaatactgcaatactaagagcttatcattccactttttctgagtaaggagagctgaacttaagcaaaagtagaaacaagaatgtaaaaaagaagaaagcataatattaagccagggagaatgttttaaatttcaatcccacacatcctacaatatctggatggtatttaagagagaacgcatccaatcatgagtataggaatagaacctaaaccacatcccgcatcccatggaacttaattcagaactattacaccacatttttttcttggctcacatggcacaatagtcaaccaaagaaaagagaaagttctaccaaaaccaaaagctgacttgtttgagagtgacatgaagttagctagtcatttcatgcagcttccctattatcagttataatttgggtttttttgcccatcaaaccctaagccatattaatctattaacgttccagtttcctcagcaaatcatgaaatgagatttttctccaacaggaattcttcctctatgattccaaaccccaacatgtgctttccagagcctcagatgtttccttagttctacagatggtttgtaaattcatttcagctcaatttgccagtgctgcagaaagtatctatggctgattggagtcacagtttggacggacctctrgttagattagatggaagtggaaactaaaacttctaactggctcaccaggaagttgggaattcacaaaaagagcagagagagaatttcgtttgagggggtgtttcaaacatgcctgttttggggagtggagggtgtggaagccctagggggtgattcttcactgttttccttggtgttgggcctacatattattttccactggagattggttttctaagtataggaaaaagaagaaaacaaaaaacagcaacagcaaccaggaacarttgtttcatttttagaactccaggtaaaatggctaacgtttcacacctgaggtgaaatagtatcagggtttaaaatatccctatagtccaggggccaggaaggtgatgacttccttcaaaaacatgaaataaatgaatttttttaaatgactgtagtttctacaggatacagttctcctgttttccacttttcctttgtaaaatacakgaattaccagcttcaggcttctactcctaattgagcactctctaggtctagaagctcagctattatagttattttaaagaagattattatcacagaaaaagagaaacagactgacaggctatttctagtagaaaatctcctttagtcttccaaattaaaggagtttgaaatctctatcaaaaaaatgcattataatatttatattaatattctctcagtcttatgacaaagcagttatagtgtttccatttgctaagtttgtgcttttaaagtaatagaaactgagaatgatcaaatattttatctatgccttcccttgagataagctgattcaaaatattcaatggtctgtcgaaaatttcctgaatactaacctttgttcatatcagcaattattgattttaattcaactggctgtgaaattgtgttctgttgaagctttccaaaatgcccagaggtttctcagcagttttctagawgagctataatccaggcttgaccttggatagaatacaaaataaaatcaagttaccatagttctgaaatgaaaaccttactgaagtatttgacattgaacagagtcggatttttgtttcctaaaaagtgatgaagctgttttaatttcatctccaaattgttgtcccaggacgagaaggaattctgaggacaaaataattttttagaagaaaagcaacaccattcattgtcattttatacaaaattcacatactgataaatactgtttgaaaaggaaagaaaggtcaaaatatgaagctaggcagaaaaaaaaagatacagacataaaacttggctttactagatattaactatgtgacatgagcgtgtgtgcatttgtagcatgggggtgggggcagggagtgataaaataattggcactaatatgccagaaactatgctaggtacttcacatgtgttctctctgttaatcaccatattatgagaagtatcaatgttccccccaccccyttttttttttttttkgagatgggattttactcttgttgcccaggctggagtgcattggcccgatctcagctcactgcaaccttcacctcctgggttcaagcgattcttgtgtcccagcctcccaagtagctaggattacaggcaagcgtcaccatgcctggctaattttttgtgtttgtagtaacgatggggtttaaccatgttggtcaggctggtctcaaagtcttgccctcagctgatccgcccgcctcggcctcccaaagtgctggcatgagccaccgcgcccggccaatgttcccattttacacatgaagaaactctggcttaacgagatctgacaacatgtctaagttcaagtttaccagtatatgactaggaaagtccgtctcactctaaagtctgtgctctttctcctgcagcatgatacaggttgttcaacctcacagcctcaattttcttatttgtaaaataaggaaaaaaaattctcacctgacctgggtcattgtgaggattaaatacgatcatttgtctaaatcctggcatgcttcctggcatgcaggtacttaagaaaccccagttttccctcaccatcaactctccaggcttagtgcagttagkcgccttaacaggaatgcgcaaaagcgcactggaatgtgtgcatagatgctgagaaagcaaaagggagacaggtacccaaaagtcctccttggcctgtatagcttttacaccctgttacagaattgacttttckcttcagtagcaagggacaggcttcatgcagtggcctctgaaagaccatgcactgtgtcactggcagttcatcatatctcccaacagtgcagctgtgataagaaccagatgatccaaatttcctaagcaaagccagcagcaaatatcatctgggaaggcgcatgcctcagtatccacacactacgctctttaagaaagtacatsaaaaagctaatggacttttacaagagcccagttactgcttaatgtctgtgagctctcaggagcagggaatcacaacccctaccacatacagttggcggcagaaccagtattccaagttgttaaagaagccaaggattagataagatttatagagacctgatgtgggtagggcagctaaaaatggaatctgcagatttgtttccaaagcttcagacatggccaggmtgtttctgtgtatagattgctccacttcgcatgggcagaccacaggaaaaatggttctctcatcactggggragttgcccctctttttaatatagaagtgtgtgacatccatttgatacagccacatacacagctccagataacttaagctaaatgctgtctgtctggaagtggaaaaccagaggttcaggtaccttcttgatgatcttaaaattgtgagtgccattctttgccttctctcatagcccattttgttacttctgacgatctgttgacatctgaaaaacacttctcttatactataacttcagctgttatatgacttcaattttacaaaaaactatcaagcatttcctcagcacctacttttttttcatttaatttcatatagcttgacctcttgttttaacatttggaaaaaatattttccaagtaccctgtatatgcgtgtctctgagcaaatataactctagtcttttattgctaatttctgcttcatcttacatctttcatgtatttgataacctgtccaggttccaatgaaagaggctatggataagtggtacataggaggtcattctaaggtgaagtgtctattgggcagtgagctgcagggaaaatattgcttcatgtgattactcaaattgtttaactacttgtagctgtcaggcttggagctgttcacctgagactttgttgctgcaattggctctggaattaaccacaaaactgtcagatgtaaaccacgtttagataagccagtaatggcaagaaaatgacaccattctgaggttgatggatgtaggagagctcttctagtatttgtaggaggcatataatgatctgtgaccacaatctgtattccataaaattggcatttactgaggctaagaacgtcttgactggccaggaacgatggatcaatggagttggggggttgattgctgagtttctgagaagacagcagttgattcaggagtcttatccaacactacatttaaaggtcaatatgtggcaccaaagatctaaaaatggctgaactgtttctaaatttaataactcaaggggcctagtcaactttcataaaattatagagccaaaactcaggcgcttcttctctcagtggatttctcaaatgctagatcaaaacagctgccaattgtccattctcactcatccaatgcctgtaaagtaaaatagttgctgtaataagaaagggttttataatggccttttccctcaagttcaatatgagatgcactctagactttttatgatacatctactactagtgaaacattgccttacataaagaacttaatagttgttctttagttccttgtcattgatattaacagctaaagaccatcatctcacatgacattgctgctgaaatttccagcagtggggtcagggataatcttttgatcactrtgttcaatagcatccataaccttccttttgagacattgaattaaaatattacatttatctgacgaaaatcattgaaaaacattggctggcctgtatagaagagcttagatttttgatttcagaagcaatcagcgttacttttaggcgacccattatctactctttatttttcttctgcctctatttcccctgctagatgcaattcaaagtttacactttagaaaattgctgctgtaaagttaaaaggactgtacattcaaaagtaaaagagaaatggggccgagcgtgatggctcatgcctgtaatgccagcactttgggaggccaaggtgggtggatagctcgagctcaggagttcaagaccagcttgggcaacatagcgaaacctcgtctctatgaaaaatacaaaaattagccgggcgtgccgacaagcacctgtagtcccagctactcaagaggctgaggcaggaggatcccttgagcccaggaggtcaaggctgcaatgatcgtgtcactgcactccagcctgggcaacaaagtaagacacgstctcaaaaaaaaaaaaaaaaaaaagtaaaagagaagagaaataagcatgtgttctaccagggccagacacaaaatttgtttatagtgaagaaagtcttaaaaactgcaataaacaaatacttctagattttaaataatcagaaaggcatctctaaaaagtcattgctggttatagatgtaaatgtctggcacagttaaaaagcagaaaaatcactttctccaacattaaacatggattccattgaaatgaattatgtttattctacttgttaaaagaaaacttagagtttgttcgactttgtgaaatagacctatgacttgcttctgggtttgcatgagatctcattcagagacatcgtgggcacttaatatgtgtagttgtgctgaaacgtgtaatatgtgatgagataagatgcttagcagtgaaacctcaccattgaagcttttagtacttcttcaaacaaggcacatgaaaaatatcaaggaactttagcacagagtttgaaacaatttgtttttctagaaaaacaaaatcacaaccatacattatttaccaaatatcttacccagagaacagccagagggaaactctccaaggatttggcattcgagtgttcttatctcatatgaaaatgcattctgcatgtgaatgctgcgtgtggattttctttagttttgttttgttttgcttttgcagttgtagtaacggatagcatcaaagtttgtaatcactcatttcaattactgcatgaatcctaacgtttgtgatactggtttcatcaaagtcatattgaatttgagtaaaatgagagaaatcgcattgcagagatatatatttgtcacttaaatagaaactgcttcaggaaaatactgcacctctctcagtagtcagcaatcctatcttctattcacatgcggcaaacaaagagttagatgatacacaattaactttttaaaatctgagggatgaatttaaatgggctatggagaagaaatttgtgtatgcatacatcattggcaaagagtcttttctctctcattgtttaagttctgaaaacagagcacctcttattgcagtgattaaggattgattttaataatcctaaaaaccaggctttggagctcaataaattcttcctttcaaaagtacagattttggggttaccaaggtggctccgttatccatgctttgccacattttataggaacataaaactgctagcagattacatcaccaggcagatgcaatatgacaagaggctgcaaggtcgtactgtgggaaagtcagggatttcagggagatgatactttacaagcacggtgtctcaactaaactcaaagcaaaaagcctggtgccttatcagtgtacctcctgtaaactttcagagcccatatatgtttatacatattaataataattaataaataatgttaaataataatagcaacaaatgcttatacaatgtagtgtttattatttaggccctatgtacttttaaaaatgtatgtttatatttgtttttgtgccagtgaaatgtactaacacaaaatttaacattttaactatttttaagtatatatatttatacactgaactatacattaaatacattcacattgttttgcaatcatcactaccatccatctccagaactttttcatcttccctaactgaaattctgcatccataaaacaactccccattcccctctctcccagtgccccccattctagacacagacacagacatttctgtgtctatgaatttgactattctagatacctcagtaagtggaatcatgcaatatttgttctttcatgtctgacttatttcacttcgtgtcatgtctttaagtttcattcatgttgaacctgcatctaaattttcttcctttttaaggctgaatagtattccattgtgtatatatatatatatatataccacattttgtttacatattcatccactcatggacatttgggttatttccactttatgtgctttttatgtatcaactctttcactgctcaaaaagattcattgattcattcattgttgtagtatctttattatctccatcttatgataagaaaactaaagcatatgagattgtgtaggtgcccaagtttatagagctaggaagctctaaagccagtattccaccccaggctgggtagatccacagttcctgctcctaatcactgtgctatctcatctccctttccaatgattcaggaaactaagtatagcatgtaccagttggaaaaccatttgtataacatcctaaggccaggttttaaaagttcaagtacaggttttaaaagttcaaaggagtagtcagtttaataaccgcaccccatagcaactgattgataaaggatcccattactacaaaataaaaattagcactctgctccggcactagttctaggtgggctaagttcattttgctgatcttcctatataatatgtgcatgcatgtgtgtgtgtgtgtgtgtgtgtgtgcagtagcatggttataatattaccccaatttgtaaaaagggaaattggggcataggaaggtggtaagttacttgttcaaggactcgtaataaaaaatagaacttgtacccaaactcagataatttgtaactccagagcctgttctcttaactatagcacacattttatctttttcttgaatgtgaagtacagcattgagacctgtacataaccacaagtattcttacagtatatggaaattttcctagaaagcctgtaaataaccagcaagtctatttgtcaagaggcaatccgtgcattgctaaagttatttgtatagttattccaacgagcacatctgaaaactaggaatgcagttgctttattaaaaaattgtcgatggtataaaatattgttagattttgggaagcagtttagtgtgcacatgccaagcttctcaggacagaaatacctctgagagcagcttctttcctttcactaagagatgaagagtacactcatgaaccctgagcaaaattgtgacttcaatgcaattgattgtcttctaacccaaattcctgtttctggcttccttttccatttgttccatttgtacaacttcgtgcccacttcagtcattgcccagggcccttaaatttaaatatccctccccctgaacakataggcattatgaaatggaaaagaatccgagaatctgattgcgcgttttcattcstagcaaagccaccatgtacacacacgtacaggccagtcacattttagaacacatgtttcagggttccatgggggatatgatgctgaccattcttttgtttctcacagagttccaggaccgcacgctccgaggaggaccgggacggcctrtgggatgcctggggcccatggagtgaatgctcacgcacctgcgggggwggggcctcctactctctgaggcgctgcctgagcagcaagtaagtcctgcacccgttgggggtctttgtgagaaccagaggtagccggtttgaggcatgcttttgtgattgggtttatggagaacattttgtggcttacagatccagataaaagaaaagaattaaaggaacgtacaaataattaaatttgtgttcttacgtgtttttatttgtgttcttacgtccatctgcagctgggtctttatgtactcttatcagatgataagcaatagagaaacttatcatctttaccaagcaaatgttatctgttttcatgttaggactggaaggagtatttattgttaggaatggttctggaattattagctctatgacatattgtacagtattggtgttagtagcatattgagtttatgctggatttttagtgttaccaagtactttgcaagtgaataacatattggtttatttttgtagatgtcctaatagccagaagtttcttaaagtcattcagttcaatgaatgatgaatttcgaatataaggaagtttggaaaaatagaagcttcagtgggaattgggtcaggaatagtgaaagggatgaagaaggtagacatgggggtggctaatgacatctaagctaaaaggaaagggcctgaggccttagaatggaaatttttacttagagtaataatttaaaactccttcttgagctgtgtggtctaygactagatctgtctccaaactataaaatataaagtaccatggtaatatttttaatgaaagattttatttgactatgaaaagtgttatgtatagcaagtaggaggtttgctcaaaattactgtatatactatattataaaacgggaaacagaaaaagaattctagacatttcataaacaaatagcagaaagtggtgagacagaggttcagaaaaatgtcaacttactttaataagagtgagaatttcttgaaatcagcgtctgagccttattcctttctgtctccccaaggcctgcacagggtctaacagatattagaagcccgatagatggttcttcattgaaacatgaaagaccattttggctccagggaggtctcactggaaatgttataacctgagatgtatccaacaagataccagatcaattctgatatttggccactgtggcattgaggtgtgcactaaaaatgggtcaatgtgattgtatttaccagcaggtttgtttgtctcatttttgaggccagcttcgaatcaacgagaaccttgagctgataagaaagactagacttttgctccttatgattcacctgctctcttaatcttgaatatacaaaacttccaaaatctgcaatgtatgctgccacacggtgataatgtaactgataatattcatacatcagtaaagccaaaaagtataaatttagaatgttcctgttatttagttttctcaaattagcatccttgartattttatagaggtgagccaaaacatgtgtctcacaaaactgataagaaacaaaggggaattttcatattgtctcagtgatgtgtatgtcagcttgaggtaggatcttttactgagtgagagactgagaagcaatttagggaatacattaaratcacaaaattctgtcattcagcaaataatcaaatattgatgccatgcgaaattcaaaaataaacaattttgccacctagtaagtkaaaggtctaggtgttagggctctrttatgatactacaaaagatatcagttgtcttctacttataaagtattagaaaagtagaatgtaaatgctgaaattataaacatatagaagatatgtccctattttactttcaagtattaaaaatatatattcagtaatctcatacaaggctgaccaagaagcttaaaaaatggggcggaggttsactacccattctttaggaatttgaagaagaaaaaaagcctccaaatagaaggcatttccaaatccaacaagaatataaagaaatattagtttcttaaaaaccagtgcttagtatggactgatacattatccacatggatatgttctatacttttaaattctagtcattctttagcaaatcaaaaacttgtcatcatcattaaactctggaacaatctggatagaaaatgtaatatatatttttaattktgaaagaactatttatatatgccctatcatatattttgacatcattcttcaataggatttgtattattaggctaaactgtattaattctgatccttgtaagacaaacaacatagaggttgatttagctgttcaatctgagattctagtgggatttctggagacaagcagctcatgatatgaccacattagcatattacctctgcgccctaatgagttaaatcttacagctacagattttaaaaggagcaaaactaagactgagttaatccctttgggggtgtattgattgtagaaaatctgcatctccaaggacaatttaaagatctacagtgactaagtaaatacctttataataatacyaaataagtatgttaacccattgaatgttcctggatgctataatgctgatttttaaaatattagttggtgcaaaagtaattgcagtttttgctattaccttcaattcaccaacccaatactttagtttttatggcaattacacacttattttctagaaagcacaacacaacatgctattattgaacagcttagatagttcctgctttgattcaagacttttgtttatgttgcatttttcaaaacaaggcatgcgtatacacctacaaaccccctaccccacgcatgtatttgtgtgtgtgctgagctgtgacagaaaatatatatcatttcaaaagggtctgacagcttctgttgcagagaactcaccctggcaggggccctttgtggatactagtcagacccatttacccaggggagaccttatcctaagtgtcactggtcctcaatcaaaattcagtttggccaggcacagtggctcacgcctgtaattgcagcactttgggaggccgaggcgggtggatcacctgaggtcaagagttcaagacaagcctggccaatatggacaaacccsatttctactaaaaatgcaaaaattagctgggcgtggtagcgggtgcttataattgcagctgctagggaggctgaggcaggagaatcgcttgaaccccagaggcagaggttgcagtgagccaagatcgagtcactgcactccagcctgggcgacgagcgaaactccgtctcaaaaaaaaaagaaaaaaaaaaattcagttttctttacctgggattattatgtttggaatcagagattctcaaatgtttgtgtgtccctggctttctcttcctgccattctgtatcacttcacaagttttattaatatgattttagccctgtattttctccttttttgtgtgtaatgaaagtgtggagcaagtcccctttggtatctaaagggaatcagacattttggatgatttcattttagatgatttatagtcwcctccatatrtagtttgaatgcatctgctcaggatcctccatggaagtgtagttgtcttcattatcttttaagttgtcaagcacctaagaagctatttgttttcttgataatttttatttgcaatctagatctttcactattaacagaaattcctgggttacagcctcatgtttcaaaaagctagctttcagctatcaaagttcwtggagacacctagcattcattaaactttcagttatagtcatgtataaaaattttaattttcattaaaatacataactctaagcagtaagaaatattaaataagtacttataaaagcaaaatataatattaataaaatacattctaacatttttctcattactacttgactgtaattaagtcattgcttaaatatggccctaaatcagtccttaggctggatttagaatgtattttgactcttataatttagaaatagatatgttctgggatatgtgctcagctttaagacttcaaatcagtttgatttttaaagttttcaagttttttccctcaacaactggttctatctattctagtaccagcaagaatttattagtttactccccttacttccttacgctaatggtaactctaattggtgtagcaattattcattgccacagtaatgctgcataaaaaccactaatcctcactggaatatcagataaggaattattgcttggctaggcagctactgatggactttgatggtacttgatcannnnnnnnnnnnnnnnnnnncctccatggaagtgtagttgtcttcattatcttttaagttgtcaagcacctaagaagctatttgttttcttgataatttttatttgcaatctagatctttcactattaacagaaattcctgggttacagcctcatgtttcaaaaagctagctttcagctatcaaagttcatggagacacctagcattcattaaactttcagttatagtcatgtataaaaattttaattttcattaaaatacataactctaagcagtaagaaatattaaataagtacttataaaagcaaaatataatattaataaaatacattctaacatttttctcattactacttgactgtaattaggtcattgcttaaatatggccctaaatcagtccttaggctggatttagaatgtattttgactcttataatttagaaatagaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaggcggagcttgcagtgagccgagattgcgccactgcagtccgcagtccggcctgggcgacagagcgagactccgtctcaaaaaaaaaaaaaaaaaaaaaaaaaaaaaaaaaaaaaaagaaatagatatgttctgggatatgtgctcagctttaagacttcgaatcagtttgatttttaaagttttcaagttttttccctcaacaactggttctatctattctagtaccagcaagaatttattagtttactccccttacttccttacgctaatggtaactctaattggtgtagcaattattcattgccacagtaatgctgcataaaaaccactaatcctcagtggaatatcagataaggaattattgcttggctaggcagctctgatggactttgatggtcttgatcacatatctagggttggctggatgttggctgatctagactggcttcatctggttcaacttgggaaacccaattctgctccacaagttccttatcctccagcaggctagcctaggcaagttctcatagtgatagcagaggtgtaagagagagcaattcccagtgcaaagcctgtttccagcttctgtaccatatttgctagtatctcattggccaaactaagccatccaccaagtccagagtcagaatgggagagccaaattgttacatgtgaaagcatgagctagagagagggtgaaaaattgggactattcttcaatctagcatgaatagtcttctatggctttcttactcatttgtaatgggataatgaacttcatgggttctgtctcatttctccactccagatctaggcatctaaattcagttcagtcaccttatataccttcccaatagggaaagatcagagtttatgaatgtatatatgcttagaggcctagcaggtaactggaatgtatgtagtagcattcatattgagtccaaataaatcccatctaccaggtaaattaacctgccaggccaattttctagctctagtaatatgacctcttagagcactctcaggtctgattattttttcaagtctatcagctaatgattattctattcccaatatgaaagaaatgtaaagggaggtagattacttagattttgtggaataaatgacaactactcaacttctggagttaattttgttccctgatggaccgggagcttgtgaggagacttggtttaccctctgagtacagaacatcctctctgagtgatcttttgaaggttctagaaaaaaattcaatggagacaaagcagaatgaaaacacaggtacacattaaatrtaaaagccttcattctcaacaagcagtacttgatactggagaaaaagttctgacccaggaacatactgagtagaatcctttccttggtttctcccctaccctttttctgaggtttgcagaaagtaggcagtgcttgattttccaggtttatgatattggaacactgatcattgcctttatctgcaaccctggtttgaacaacaaagaaagacactgtataaacattgtctctcacctttactaattttgtaaggttatatgaggttttattgagtaactcttataatgtaacttttactaatctagtatcgctaagtagaatrtaatacctgtttttatttttcattaattagaaaagagactatacctactggtgcttgatgatggacatttattttatttcaaatgaattaaagtactaggtaccttgagaagctgctcctctctccagttcttcacccccctactaaatactctgaaataatatttatagtgaactatttgtctagctttttaaaaaatatttaatactaaagatctatctttcagagctctaggtttatcttcagccagctaatttagctttgctcataagaagttccaaatgcataagacagttaatataatgtgtaacattatctgtctccctgtattaagtcaatgccaagaccaggctcaaaggaggaaactacccctcatttgagatggcaacgagttagatagctggctgctcttaggtgtgatgtgaacctttgcactggtgactaaagaagatttaaaggtcttctgagaccttttttactttctgaaatgccaaattcatctgctaatggtataaattaatactacattaatattgtattaagagcataaattaatacattaagaatacaaatattatgttaaatcttaactgattcagcaatgggcttggctgtttcatatctatccaaatagcaaaaaatgatcttcttatgaaggatggcagaattttttaaaagttaataaattttgagttaaatattaaaattgaattaaaaagtttttgaggtaatacgattattagatgagcaagaaataaaaatcacacaagaggtgcctaaaacaagtaagattatagtattattccaaaggcatgtggctgccagaatggtgtcaacataaatacagaaaaagtaaaataaatagccccaaggagtcttagtccacaggaataggaaagatcattctaaaggtctcatttcataataattgtggtaagagaaagtaagctaacttctctgatttttaattgcaaacacagatattctgccatgaaaatattgatacactaatataggctttagttagcatcttatttctataccgtataataataaataccaaaagaaaattttcaatggtaagattttgcttcttaaacaaatgtttgtttttttctctaaaagacatctcatctctatcataacatccaattaagattcacaggacttgttttaagaggttttagaactttcagctcaagtgagccccaaagcaggctttatctgttattcttcatctggtgttatatgttatcacccttgttttccttgggaatgtttgaatttttgtttaaaagaaagatatacaagttcagagtgggtatgactactcatgtcatttgtatgagatagtcttttcattttgttaaaggagattgcatattttggaacatatgcttaagagtttgcagttgccttcctttyactttttgggttaaagcctagtctaaatatattaccaagacttctaatatttcaggtcatatatcttaggggggtgtattgttccaagatctgatctcctttccggaggcaaatgcgctaaggccaatgactgaatgtttaggaccaatttatggcctggtttatcccataagccaatttgttggaataaaagatggttagaaatgtgtttgttgtccataacatttacttgccatatcaggaatctgtaactcttagatgtctttttctgtttattaaaaaaaaaaatccttatgtgatttgttcagtagcccttctaaagtttgtatatctcctcaattttaattcattcattcaataaatatttattgaatacctactatgtattaagcaaattggtaggtataaytaaggatagaaatcccaaagggccagagtctcaagaatttaccaaattattaatttgcctctgagtttctactgattatagttgcaagatattttaagaactaagagaagttcccccagttctataaataatacatctgtggaactgggttttaaaaatattttatatgtattgktattttattctggtagcatcattttatatattaatgctttcttttcctaattcaattgtatgaattcctccttttttacagtgcttagcacacagcagacattcaaatgtttaataattggcttttaaacagtatatgcagtattgtcattttatttcttcaatctgtgcttcaactaaagtggaagaaaactatgtgatattaaacatctctacaaaagaattgggaacctaatccctataccacagaacaaaggttggtggaaccaattctacttttgcagaattaagaaaatatttcagacttagacctagactgagctgggaaggatcttagagctmatctcctctctaattccctcttggttatttcccttcctctttttatttttattttttattgtggtaagacaatttagcatgagatccaccatctcaaccaaatttgaagtgttctatacagtattgttaactacaccagcagtgctgtgcagcagatctctacaatttagccatcttgcatcactgaaactagactccttgaatggcaagtactatttctccctccgccgcaacctctggcagcctcccttctactgtctgcttctatgtacttgattagtctagataccttatataagtggaatcacgtagtacttatccttatttctgacttatttcactcaggataatggcctcagagttcattcattgttgttctttcccttgccgtgcagactgtttactttgatagtgtcctacttgcctatttttgcttttgttgcttgtgcttttggtgttatagctgagagatcattgccaaatcaatattaggaagctttgcccctgtattttccagttggagttttatagtttcaagtcttatatttaagtctatagyccattttgagttaatttttgtctatggtgaaattttgatagcaattttattctttcacatgtggatatccagttttcccagcacctttccccattgtgtattcttggaacctttgtcaaagatcagttgactgtgtatgtgtgagtgtttttctaggtgttctattggtgtatatgtctgtctttacaccaaggtgtctttacactggcatatctttacaccagtrccatactattttaatttctgtagcttataaaatgttttgaaatcaggaactgtgatgccttcagctttgttctctctcaatattgttctgaacattccagattsttttttgtttcatatgaattttagaactgttttttccatttctataataatcagttactgggagtttgataggcaacgcattgtatctatagatcacattgggtaacatggacattttaacaacattactcttccactccatgaacatggaaggttttaccatttatttgtgtcatctttaatttctttcagtaatgttttgtgattgtcagtgttcaagtccttcacttccttagtttattcctaagtattttattctttttgatgtgattgtaaatgagactgttctcttaatttcttttgtggatagtttgttattagtgtgtagaattgcaactgatttttctttctttttttttttttttttttttttgaacgaagtctcgctgtctcccaggctggagtgcagcggcactatctcggctcactgcaagctccgcctccggggttcacgccattctcctgcctcagcctcccgagtagctgggactacaggcacccgccaccatgcccggctactttttttgtatttttagtagagacggggtttcaccgtgttcaccaggatggtctcgatctcctgacctcatgatccgcccgcctcggcctcccaaagtgtggggattacaggcgtgagccaccacgcccagcctgatttttctatattgattttgtatccctcagttttactcaatttgtttattagtctttcgtgaagtatttagagttttctgcttataagatcatgtcatctgcaaatagagataatttaacttcttcctttcttttttggatgccttttatttatttttcttgtcttactgacctaagactttcagtactcttttgaacagaagtggcaagagtgagcaactttgccttgttcctgatattagaggaaaagccattgagtgtgatgttagctgaggacttttcacatatggccttagttattttgaagaaatttccttctatgcctagtttgagagttcacatcatgaaagatgttaaattttgccaaatgatttttctgcatctttcaaagatgatcatgtggtttttattcctccttctgttatggaagtagttcttaatcctagttacactttagaatcacctggaaagcttttaaaaaaaatacagatatctgggccctaccaaagaacagttaaattaggatctcttggggtagattcctgacatcagtaattttttcaaagctctccaaatgattttagtgtgtatccagagtttaaaattgctgccgtcttgaagggggtgatagtgcaatgatgaggtttatctctagctccctgaaaaagtagaggttagggtaaagaagaaaagaagaatttttgttgtttgtttgttttttgagacaaggtctggctgtatcgcccaggctggagtgcagtggtgccatctcggctcactgcaacctttgcctcccagtttcaaaccgtcctcctatctcagcctcccgagtagctgggacgacaggcatgagcaatcatgcctggctaatttttgtattttttgtagagacagggtttcactatgttggccaggctggtgtctccctcgtgagctcaagtgatttgctcaccttggcctcccaaagtgctgggattacagggatgagctaccacaggattttctgataaagaaacttcttttatgttaaaaggagtttctgtaaaatgatcgagtccgccatgtgggagagaagtcatggatacaagcatgtcaagatgtaagagtggggattgccctaggtactactctttatctacttttctggtacatacacagttgtctagtattagtcatcatcagccttgcccaaagtattaaatgaactaagtgatttctaacttattctttcatccttttattaattaagcctacaaacatgatcctttaagcttccagcttgttggtgaatgaccaggttaatgtcctagtgattcttgggtagtttatgcaaattctctgagactcacctctccttaaagtcattaaacttcctatccacagagttgagttgagttgagttttccatcttcaattcagcatccatccctccagctcctccctcacctcaactaccaaaaaaaaaaaaaaraaagaaaaagaaagatttcctaatgctacttgcataatttattgaattattcttcggtttgggcccaatttgtagaaaatagaaaagagttatctgaccctgttttccttagtttcagtcactgagaaagagagagaaagaaagaaagagagagagatggagacagatactggatattaaaagcaaacagagggtggtctgtccaaatcatatacaatgggggatggacaattcacctggaggcaggaagaataacttataaaacactaggtgatattacatccatgcatggatcatcagctgaagcccctaactaatataccaacctcaaatagctgcagagccagccactgcctttgggctttggagtaggaatccctggtccagataaagaccctttcctacttagggagagaaccacatgttgtgggaaccagaatttgtagcagtgagtttcattgcctactttgtggattattmcttctattttatttttcataaaactactgattttgaatattggcaccactgttctckacttgtatgacattggactagattttagtttctctgggattttgtttgcttatctgtgaaatcaagtgggcagtgcctggaacagaacaagtgttccataaatatttgttgaacagatatccaaggtgcccttcaactctgaaatgtgtgcccctaaaaaggagacagtttctcctccagatatgcagtcaagcccattttgctgttagataggaagaggagcaaaaactgctcttcatataaatggttttaaagaaaaatgttgtgactctccagacccctgttttgcaatgaacatctgggtgacatggaaggattggagaacttttgtctctagccaaaataattcataaatttcyagctcaaggcttgtatcaggagaggttgttagagtcctagagtttcataatatacattttcctcaaggggaagatggaaaagttggacttgatgttgctaaaacacatttgtttttattctcattctttgcctcttttggctactgagcaaatgtaagatcatttgcaaaccttatggcatgtgtgtgtatactataaagtgcatgtccttcttgctagtggatcttaagccaaaggcagcaatcccccggcccccacccctagccatctttcagaggaagcaaatgcattgcaaggacaaacacaacttataataaatatatgaaaataaacgtgttcattaaaatagagcccaatttttttactttggtagctatttaatttcattttaaacttttcatctttttctttttttttaatttatttttttttattatactttaagttttaggatacatgtgcacattgtgcaggttagttacgtatgtatacatgtgccatgctggtgcgctgcacccacgaactcgtcatctagcattaggtgtatctcccaatgctatccctcccccctccccccacaccaccacagtccccagcgtgtgatattccccttcctgtgtccatgtgatctcattgttcaattcccacctatgagtgagattatgcagtgtttggttttttgttcttgcgatagtttactgagaatgatgatttccaatttcatccatgtccctatcattttttatggctgcatagtattccatggtgtatatgtgccacattttcttaatccagtctatcattgttggacatttgggttggttccaagtctttgctattgtgaataatgctttttcttgttatagacagattttaatcaggtttcttgtagaacagatgtgaggccgaaagttcttcatggcctggagttatctttataacagttccttctgtatgtttcttccttcttcctttggccatttgttctttccttccctccttctatcccttgctcccttctttccttccttccttctctcacgaaatatttgtaaagcactaacagtacaccaagcatgttgctagattctgcagctcagagaccaaacagactgcaagggaaaaaagtaaataattgtcaaaaaatatttactattttttattttagattcagggggtacatgtgcatgtttattacatgggtatattgcataatggtggggtttgggcttccagtatacccatcacccaaatattgaacgtcgtactcaataggcagtttttccaccccgccccccaacccagcctttcctcttttggagtccccagtgccaaatatttccatctttatgtccatgtgtacgcattgtttagctcctgcttataggtgaaaacctatggtatttgattttctgcttctgagttaattcacttaggataatggcctccagctccatccatgttgccgtaaaggacatgatttcattctttttatggctaagtagtattgatggtgtatatgtaccacattctctttatctagtcatccattgatggacatttaggctgattctatgactttgctattgtgaatagtgctgcaataaacatatgaatgcaggtgtcttttttatataatgatttcttttcctttggttagatacccagtgtgggattgctaggttaaatggtaatatggttttcttttcttttttctttttattttttgagacatattctccctctgtcacccaggctggagtgcagtggcacaatctcagctcgctgcaacctctgccccccggattcaagcgattctcctgcctcagcctcctgagtgctgggattacaggcatgcgccatgatacctggctaatttttgtatttttagtagagacagggtttcaccatgatggccaggctggttttctaaaagtaaaagaggcatgggtgctacaggatggtgtcctagaactttaaaatgctggccttttgctacctctctgcctcctctcctggtgagctctttacctacaatgtccctccctccccatactcacctgtgaaaatcctaaatgttatttaaagccaacttcacctgtaccccctgagtctcaccatgctatatttgtgaggaatttgtttgcatcacctttaattcacctttacatagtctggctgtgttatcgttattcatatggtactgtctctaattacattatcagtgttatggtctcaggttttattttccttttctttaaaccttcttgccttgcacagagtaggtatctagtcactgttaggtgaatttactgagttaaacatagggtaagaacctagtgtagtgctcgagggagcaggaggaggaagcgagggctgaatcgcaaagtctcctttctcccatcacattcttgggactcctatcacccatataggacctcccacctaagatacttcctttgtaagctattgccctctcctcaatctctgccttttcaaattccttctgtatttaatattcagatcattcctatgagttgttcaccaggcattatgctgttgtgtgttcyattctgattcgtgtggatttgttcaagtaaataataactttgataagaatcagggaggccaccatttttgtgtctttcacagtgccttgcttagtactagtatagactggatacccaatgaatgtgttaagtkactgcaaattggaaaacattatacaaaaagygtgttaaccaggaagcactgcccaggactcactttccscattggagtgcttatygtacattgtctcattagattttttgagcagtatgttcagagcagtttctggcttcgttagaagctgggcatgacctttatggtctacagtgtcatcattctcacctttttcttttctgattacatgagtatactcctcattttcataactgcagcccatatttgtgaaaacttgatgctttgctatagcatgtctttctttgaagaacaggcagggatatgtaaaatcatacttgtttggaaaaaaaaattggcagtgatttttctagttatagtttagacataccaaacagtcataatagcaaaaagccaatttgaaacttaaaggacaarctccacaattcagcctataatattctcatgtgggtctaaattttaatttaccagctttgcagcctcctaactgttgctcaaaaatctgtaaaagtgcagaggtgctttccttggttccatatggtcgagagaagatcaaacaaccagagaggatgttgtcttagaccgtttaccccaaacctacataatttctatttatatcaaatttagtctccacaataagttttagtaactctctggatatacataaatcagtgtttccaagttggcactacattcagaacatttttataatgacagattaggatagagcagaagtgttgaattacaaaactgaggtcacaaaaatatgttatctatgccaaagaaacacttttaagtctagttcacaagttacagcaccatttttcaatctggaccttcactctcctctgatcagtttaaaattgctttgagaatgcggctttaaggctgrcttttcttttggctccctagggccttgttagtgcctctggcacactgggatgagctaacatggcaccagggatgtgtctgttcccagscagctcacctactgatggatgatgcytggcagcatgccaccttgttgtttcttgtattattacaacagaaagcattttcaaaagccacatttatcaagtcatcataatwgtttggcttgtatatctatctattcaaaaaaaaaattaatctctcccttagtactaatctgtttgagccatgtgatgtatcccatgtagaaaaggcagtggaaaactgcttctgcgtgggattcagggacctttcatctaaatgcttaggagaaagagagattttttatatatgcttttgaaagtcccaaagcaccaagaacctctgtttccgcctttccactggtggttatatgtacaggggatgcatttatttctagcattttagtggctttgttcaatgaaggagatttaacctcaaatgagggaaaaatgtgaatgttagcctcaaaaaaggacaaagacacattttaatgtttaaggtcagtttccataggcaggtgttaccaggttaaacattacttgttatgaagaacattgtaagcaaatttcttattatttgaggtacagggttatctggaagcatgtggcagagaggaggggcctcaaagtacatttttaaagtactaaaagagtgtaattaacttgtttgtaacacaaaggataagtgcttgaggggatagatacccatttaccatgaagtgattattatgcattgcatgcctgtatcaaaacctcttctgcaccccataaatacatacacctactagatacccasaaaaattaaaaatttwaaaaaagcattgtcctgaataaatatatatttattcaatgtttattaaaaataatttaaatatgttaatattaataaagtactcactagggatgcatactggaacatgtctaattgtttagagatatgatatataatgaagatacagtataagcatggttatctgcagatacttttaaagaagagacagtgctgaattgcctcctcttgttgggagcaagccccctcaaaataatgcttttacataaacaagtttcattgtaatttttgtttatgatgttataaattagaattaaataataattattttaaacacagaataaaatgtagaacatgatagaatgacatttttaagtacaagagtaaagcaaagctaagaaaaagattagaatatgggacttgtgaaacccacagggatggcttgtcatctaactcctctttctckcccatgtgaggtaagaccacaagtaaccatctcttatgcacagactccagttctagtccctgggtgttcagcatccagtctgaaccacagatgaagacagtgagcatctgagaagagctttacacacagggtccagtggttcatatagtttcctttttcatggtcaagttgactggtatcaagtatttcctgaaagaaactcttacaataatgtgtctgtgctagggactactagagggaggaggagagagggggtggtgagctgaaaaactacctaacaggtactatgctcactacctggtgacaggatcatccctaacccatacctcagcatcatgcagtatacccrtgtaacaaacctgcacttgtacccgagtctaaaataaaagttgaaattatttaaaataataataacaatgtatctgcagaaaatgaaaagaagctgacagtacacttgcacttgtttctctcagttgttctcacaatttattattcctcttgagttttttgtagagtctcaggaatgtagaatttttattttattttattatactttaagttctaaggtacatgtgcacaatgtgcaggtttgttacatatgtatatatgtgccatgttggtgtgctgcacccattaactcgttatttacattaagtatatcccctaatgctatcccgcccccctccccmcaccccatgacaggccccagtgtgtgatgttccccttcctgtgtccaagtgttctcactgttcaattcccacctatgagtgagaacatgcgatgtttgktttttttttccctgcratagtttgctgagaatgatggtttccagcttcatccatgtccctacawaggacatgaactcatcctttttatggctgcatactattccatggtgtatatgcgccacattttcttaatccagtygatcattcatggacattaggtttggttccaagtctttgctattgtgaatagtgccgcaataaacatatgtgtgcatgtgtctttatagcagtatgatttataatcctttgggtatatacacagtaatgggatggctgggtcaaatggtatttctagttctagatccttgaggaatcgccacactgtcttccacaatggttgaaccagtttacactcccaccaatagtgtaaaagtgttcctatttctccacatcctctccagcacctgttgtttcctgactttttaatgatccccattctaactggtgtgagatggtatctcattgtggttttgatttgcatttctctgatggccagtgatgatgagcattttttcatgtgtctgttggctgcataaatgtcttcttttgagaagtgtctgttcatatccttttcccactttttgatggggttttttgtttttttcttgtaaatttgtttgaattctttttagattgtggatattagccctttgtcagatgagtaggttgcaaaaattttctcccattctgtaggttgcctgttcactatgatggtagtttcttttgctgtgcagaagctctttagtttaattagatcccatttgtcagttctggcttttgttgccactgcttttggtgttttagacatgaagtccttgcccatgcctatgtcctgaatggtattgcctaggttttcttctagggtttttatggttttaggtctaacgttgaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgcagtatagtttgaagtcaggtagcgtgatgcctccagctttgttcgtttggcttaggattgacttggtgatgtgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttcctcgagcagtggtttatagttctccttgaagaggtccttcacatcccttgtaagttggattcctaggtattattctttctgaagcaattgtgaatgggagttctctcatgatttggctctctgtttgtctgttattggtgtataagaatgcttgtgatttttgcayatttattttgtatcctgagactttgctgaagttgcttagcagcttaaggagattttgggctgagacagtggggttttctaaatatacaatcatgtcatctgcaaacagggacaatttgacttcctcttttcctaattgaataccctttatttctttctcctgcctgattgccctggccagaacttccaacactatgttgaataggagtggtgagagagggcatccctgttttgtgccagttttcaaagggaatgctkccagtttttgcccattcagtatgatattggctgtgggtttgtcataaataactcttattattttgagatatgttccattgatacctagtttattgagagttyttagcatgaaggggtgttgaattttattgaaggccttttctgcatctattgagataatcatgtggtttttgtctttggttctgtttatatgctggattacgtttattgatttgtgtatgttgaaccagccttgaatcccagggatgaagcccacttgatcatggtggacaagctttttgatgtgctgctggattcggtttgccagtattttattgaggatttttgaatcgatgttcatcagggatattggtctaaaattctctctttttgttgtgtctgtgccaggctttggtatcaggatgatgctggcctcataaaatgagtgagggaggattccctctttttctattgattggaatagtttcagaaggaatggtaccagctcctccttgtacatccagtagaattcggctgtgaatctgtctggtcctggactttttttggttggtaggctattaattattgcctcaatttcagagcctgttattggtctagtcagggattcaacttcttcctggtttagtcttgggagggtgtatgtgtccaggaatttatccacttcttctagattttctactttatttgcatagaggtgtttatagtattctctgatggtagtttgtatttctgtgggatcagtggtgatatcccctttatcattttttattgcatctatttgattcttctctcttttcttctttattactcttgctagtggtctatcaattttgttgatcttttcaaaacaccagctcctggattcattgatttttttgaagggttttttgtgtgtctatctctttcaattctgctctgatcttagtagtttcttgccttctgctagcttttgaatgtgtttgctcttgcttctctagttcttttaattgtgatgttagggtgtcaattttagatctttcttgctttctcttgtgggcatttagtgctgcaaatttttcctgtacacactgctttaaatgtgtcccagagattctggtatgttgtgtctttgttctcactggtttcaaagaacatctttatttctgccttcatttcattttgtacccagtagtcattcaggagcaggttgttcagtttccatgtaggtgagtggttttgagtgagtttcttaatcctgaggtctagtttgatagcactgtggtcagagagacagtttgttataatttctgttcttttacatttgctgaggagagctttacttccaacaatgtggtcaattttggaattagtgcaatgtggtttcgagaagaacgtatattctgttgatttggggtggagagttttgtagatgtctattagatccacttggtacagagctgagttcaattcctggataacctttttaactttctctcattgatctgtccaatgttgacagtggggtgttaaagcctcccattattattgtgtgggagtctaagtctctttgtaagtctctaaggacttgctttatgaatctgggtgctcctgtgttggctgcatgtatatttaggatagttagctgctgttgttgaattgatccctttaccattatgtaatagccttctttgtctcttttgatctttgttgatttaaagtttgttttatcagagactaggattgcaacmcctgcctttgttttccatttgccgcgtagatcttcctccatccctttgttttgagcctatgtgtgtctctgcacatgagatgggtctcctgaatacagcacactgatggatcttggctctttatccaatttgccagtctgtgtcttttaattggagcatttagcccatttacatttaaggttaatattgttatgtgtgaatttgatcctgtcattatgatgttagctggttattttgctcattagttgacgcagtttcttcccagcatcaatggtctttacaatttggcatgtttttgcagtggctgttgccagttgttcctttccatgtttagtgcttccttcaggagctcttttagggcaggccttgtggtaacaaaatctctcagcatttgcttgtctgtaaaggtttttatttctccttcacttatgaagcttagtttggagaatttttttaactggctcattgggggcaacctcctgcagtatagctccagtgagtactgaaatgctcatttgatgtgacaggagaaactgtgttccagtactacttaaaatcccttggtggggttgcaaatccgcttatcttgttctaatctatggtcgctctaagatccacagtctaaatggcccaggatccctggggcttgaattgcgaaacatggctttatgtcttttctcttgtaaagagctcatagatttctttggatgactgaaagaagagagataggcttgtattcacagtgctttaggagtttgaggtgggaggatcagtggtacccaggatttcatggttacagtgagctatgatagtgccactgcactccaggctgggtaacagaatgagatgagatgctgtctcaaaaaagcaaaagcaaaaasaaaaaaaccagatggaccatcctgctttaaaattctttgccataagtccgtatttgaaaagctagtgatattcagggaaatacagtaacccattcttgcttagcaacattctttgctttttagcaatcagagataaagcctggggtgccatgagcctaatataagtgcaattgtccttaaaaacccagaagtgttaaatgcagaatgaccagattttcttgaaacaatgtattgacatcaggtataagtctggctatgtcaccagaaggatctattgcttagtgaagagatgataagaattttaaagtaaaggagcgataaatcaaatgcatgcccctttttaaaaaggcttatatgagaagggggatgggggaacaagaagctaacaagttgtttgrccctagagaaaaatcttttaatttttcatgtcatttcrcctcttctcaggttgttaaatgacagttgaaactataacatcaggattttaagaagtggaagtttagatggtgtattatgcgttaatgagagacaaataaagtatgtatccagtatatactaatctcttaagtgaattaaagactgaataattcacacataatagcttgtgattgagattatttctatttttaagagaaggaattaaatcaaaatstgactgggcaggagtaaaatggtgattaagcaaayaaggaatttttgttgcaaatttgaattagaatatatatatatgtattccacccgcccccctcaagatggagtcttgctctgtcgcccaggctggaatgcaatggtacaatctcggctcactgcaagctccacctcctgggttccagtgattctcctgcctcagcctcctgagtagctgggattacaggtgcctgccaccatgcccggctaatttttgtatttttattagagacggggtttcatcacgttggccaggctggtcttgaactcctgacctcacatgatccacctgtcttggccgcccaaagtgctgggattacaggcatgagccaccacacctggcccatttttttatttttatttttattttattttaagtttggggttcatgtgcaggatatgcaggtttgttacaaaggtaaacgtgtgccatggtagtttgctgcacagatcaacccatcacctaggtattgagcccagcattcattagctattctttctggtactctccctccccacagcctccccaggccccagtgtgtgttgttacccccatgtatacacgtgttctcacccctcacgtatacatgtgttctcatcattcagctcccgcttgtaagtgagattgattttctgttcctccattagtttgctgaggataatggtttccagctccatccatgtccctgcaaggggcatgatcttgttcttttttatggctgcatagtattccatggtgtatatggaccacattttctttttccagtcaataattagtggccatttgggttgattacatgtctttgctattgtgaatagkgctagaagaaacatacctgtgcatattacatttttatattaaaatatattctaatacttatattttgttctttcatacttgacccagtttctgagttcataattgatatagttctgaactccckaaacacagtgctgtaactattttatagtttatattgggaggacatatttatttaaatcctctcttatcatttgtctatagcttttctcagacgtcattttggactcaaatttcaaatgtttgttttcatccccagaggtaaattttactttgtttaaatgtgaaagaaatcactcagctgttttatattaacgacctgttaaaaaaaagaaggaaaacattttttactgcttaattctctgacagggattttgtgcccagataaatgccttggatgaaaaaattcacacttggcaggaattaaatccttgtggtggaatagtcacctagctacttatgtgaaatttatattcaaatttcataaattttaactttcaaaaatataagcttctctgcactgaagttctttcacattgcattttactgatgaacatggttttcttggagatgttccaatgtgtatctacctatgtttttctagaaacggatttaccagaattgagaagtagtttataaactgatataataacaacaagacaggtcaacctcaggcctattcccttctcagctttccgaatttttagcttagtgttagtatactatgtatcttgagcacatcatgttccttttcttattgtttgatagacttaggagttagtcacgcctagattccaatccctggttcacttttctgtgtatgtaactttaagcctcagctttctctgcctcagttttctcatctattaaataggaataataaaattttgcgagttgttggaagattagagatagtatacgcagaatacctaacactgggccaaatatctatagtaggcactgaataaatagtagagactagttagtgtttctattataatccacaatttaatagtagagactagtgtttctgttatagttcacaatttgataatgtctttcaataatgatcaccttgccatacttaagcattaccaccttaatatcatatttcagtcaaattaaagaagctctcaaaaaagtaatatattaaagggaagatagttcagaggcatccataaattacctgcaaatccatattaggcattagacaactacaggatattctttggaaattatgacaagtgggttttctttgctttgcttttgttttgttttgcttttcctaaataataagtatttaaatccatcttttacattctgtgcagatatctcctattattcagtgatgcctgtaaaatttgtgtaggtatttgcaggttaaaatatcggggaaaaggctcatttaaactattgaaacaagtatttttctgctttgttttgtttagsaagcagtatctctgtaataatcccttggcatttgaacagagcttttgtacattatttcagttggtgatcctaactttgtgcataggcwttcctaaattcatttggcaggtaaggaaactaagaccctaagagagcaagaggtttatgcaagtggwagaacaaaatctatatcccagatcttcaggctcctaattcagatttgtttccataatttttttcatggatataaggttaggtaaaaaatttttaaaaaggatgaaaaacatatactattaaagtcccaatagttaacaccagggtttaccttttaaargcaaaatctcaccattgaatctcctccgttttaataccttcagtggttcccctttgtgtattacaaagttcaaaattagtaggtatttcactcacctactgcaattccccacataaaccctaaatcccccgaaaaccagaactgtttgaaaatctgcaggcatgccaaatcttcttgtgcctctatgcctttgcttagtttcttctccatatatccttgacctcctttcaatagctattatatttttacatctattatgtacttaattaatttatctaacatctacataatgcttactgtgtcctaggcacagtctgaagtgattcacaaatactaactcagttaattctcataattccaggagataagtaatatcatcccattttaccaaagataaaactgagatatagagccaagattctagaaagcagagcctatttttaaactgggtactcttaatcactgcactgtggtacgtatgcagcaggaacttcaaaattgaaaagcataccacattttgcaaacaccagtgtctagatgggatgctaccaaagaccttccagttttagaattcaattaccttgtaaatttaccatcagctggaacctagctctcatattgttggagtcagaaacctgatatttttcagcaatagcaccaagawcacatccttttcttaggggtgtactcacaataactcagcccatgagatgaatatttcaaactagaatgccagttgattaatttacagcaaataacagaactgtccatcacatggaccagagtactcatgtcagcatggccagcactctctgttctcagcagtcatgaaaatccagatcactcttggcaagtagcttgatcaacctgacaccgtaatgaggggtggtacttggatgagctgaataatcatcggtatcagtaaggtcagcatgagtcatctatgtggagattgcagcagtcttgtcaatgggacatgcaggacttgaaattcattcgccttttgtctaggacattgctggactggacactgacacacatgtgtctttgtcatgctccttatttcyatggtttcaatgtgtggccagccattccttttctatttttaatgcatagtaatagtcagtctgattacagtcaagtctttaggaatgggaccctttctatatttttaagatagtctgtgtataattgtgttgtcagatgmcattttccttctggtaacattctcaagacctaatacaaatgctatatgcatttcttacaccaaattatataattaattttcttaataacaaagaccaagtcatattcattcttctttgtattcttcayagtaatttcattgccaaacacatcacagaagctctgtggacgtttattgaataaaaaagtaaattaggaggcattaaagcattgtgatcatgagtgtgtgagttccgaagccagatggcctggtttcaaattttagctctacaacttaacagttgtgtcattttggcaagttacttaaccttcctaagcttcggttttgtcatctgtaaaatggatatgatgatggtactctatctctccgggtttttgagaatattaaataaatttatacatataacaaacttataaatgtacctggaattctaaaactactaggtattagtataatcattctcacaggattttgtagtgtatctttactttttaaaaaatgtgtgacatattttgaaaagagtatagtactgtttttcatgatttaagtgtcagcattgaacgttttatcaaaagttgattgtttttgttcataggaatgcagtaaaatggaaactctcatgtattgctggtgggagtatgtaatggtacaacttttatggagtgcattttggcaatatttatgaagagccttacaaaagttcattccctttagtctagtaattctctttctagaaatttatctattcaaaaaacacagtcagaaactttgataaaacacatgcacaaagatggtttaccatactatcatttatcaaacaccaaagtggaaattacttaaatgacaaataatgaaagaataattatggaaaaaattacatcagttgatagaatattatgtagctctcaaaatggtgtttttaaagttatttaatactgtgagaaaatgcctccaaaaaattttaagtggaaacaaaaacaggctacaaaattgcgtaagtgatgtgattttttttatttatactggaaaggactaaataaatcaaaataatagtgattgtctttagatgaggcaactacaggggacttctttttttttctttttggtaatctgtcttttccaaaacctctgtaatgagtatatattttataaataaaaataattttttaagaattatgactttccacattcttagaattatgattttaagacatgttgaatattaattccattaattccaatttattttcaagatctaagtttttcagtgaaatatatcttcaattttatatcagaaataagaagaaaggattaattgaatgtcagttttttcagaaaagtttgtactaatatttatttgattaaatatgcactaaatacttattttgaaaatttttgaaacaagataaatacttagtttcaacccttatagagaaatcaatttacatctataacttctttaaatctgctcaatttgatttttaatagtaaaccctctaagaacatgcttagaagaaaagagaggcccttttactagtatttagagcaaatttttataagaaaatatttctgattttgagcttttcataagtagtaatatttcttttttctttttgcaacttaggagctgtgaaggaagaaatatccgatacagaacatgcagtaatgtggtaagtataaggttctgagattgtaatcatgtatttttgttagcactgaatggtgctaagcagttttatatcctgagcaggaaatcaaccaactagtatttcactgagagtttttatctcatactgtactgattatatgcaggactaaaatgatatttttaagttcctcattatagacttttaatcatttgagcagcttgaaactaactagactatttcaaaacaaggactctacatttcctccctactttctgcctttttgcatatagatctcatgaggatgagtgagagggttgataaaagggaaaccagttggggtatcatgaaataaatatttgtaaatcaaactcagatttgacaaactcattcatttattcaacaaatattattcagtgccaactatgtgtgaggcactacaccagtacaagaataaataacatrtggtccctgttttaaacatctgtagtatagtaagaggtatagagaaagaagacagatgtgcattgcacataaccacattctaggaaaaaaatatcacaaatgccataggaaataaataaagttctttgtgggctaaaatagagagaaatcttaaaggaaaaggtgatttgagatacagcttggaggactgtgactagcccatattggatttgaagggttgacagtcagtccaatggagaggacataatgggcaagtttggaggcaggaatgtctgagcactagtttcaccagagttgagtatagcagtataaaagagaagaattgaaatatatytttgaggttatatcataaaaagattcgaatgttagtcttcaaagtttatattagttcagtgaataatgggagtcactaagagcaagagtatgatgttacagagtttcccttttagaaaggttaattttttggtgatacaagggttgcactggaacaggaagtggatgaggagcaagaagtaatgaaggcttaagccttcattagtagtcacagctactcaygaggctgaggcaggaggatccctttagcccaggagttcaagaccatcctggggagcatagcaaaaccctgtctcttataagaaagaagaagaagaaggaggagaacttaaacccagaggaaatactaaatagacacaagagagatcaaaattaagttgactctgcaagacttgaaaagcatttgaaattagagtgataagttgaagcgggaataaaggaaacaaagaggtatatgcatatttaggacttttgtacttgccgatccctctgttgaagaagctctttcctcaatatcatgggcatttttattattccacatttctcttccgcattgcccagaagayattctctatgagggctccacccctgcagcagacttttgcctggacatccaggcattttcatacatcctctgaaatctaagcagaggttcccaaacctcaattcttctgcacacctgcaggaccaccacaacatggaagctgccaaggcttggggcttgcaccccctaaagcaatggcctgagctgtaccttggccacttttagccacagctggagtggctgggacacagggcaccaagtccatccagaggctgcctagagcagggggccacagacctggtccaggaaaccatttttcccttctaggcctctgggactgagatgggaggggcttccaggaaggtctctgacatgatctggagacattttccccatcgtcttggtgattaacattcatctcctcattacttgtgcaaatttttgcagcaggcttgaatttctcccagaaaaaaattttttctatttcatcatcaggctgcaaattttctatagttttatgctctgcttcctcttgaatgctttgtcacttagaaatttcttctgccagataccctaaatcatctctctcaagttcaaagttacacagatctctagggaaggggcaaaatgccaccagcctctttgctaaagcataaacaagagtcacctttgctttacttcccaacaagttccttttctccatctgagaccaccccagcctggactttgttgcctgtatcactatcagcattttggtcaaagccattcaacaagactgtaggaagttccgaattttcccacatcttcctgtcttctgagcccyccaagtatctaggaagttccaacctttcccacattttcctgtcttcttcttagccctccaaactgtgccagcctctgccagttacccagttctaaagtcacttccacattttcaagtatccttatagcagcaccccactcctgataccaktttactgtattagtccattcttatgctgctttaagaacatatgcaacactgggtaatttggaaaaaagagatttaattgactcacagctcttcaggggtggggattgtaagtaggaaacttacaatcrtggcagaaggggaagcaaacacatctttyttcacagatgtcaggagaaagaagaatgagaactgagtgaagggagaagccccttataaaatcatcagatcttgtgagaacttactatcatgagaatagcatggggaarattgtctgcatgagtcaattatctccacctggttcttcccttgacacgcagggattatgggaagtacaacttaagatgagatttgggtggggacacagccaaaycatatcagactctgacctcatattacttaaaatccatagcactccatgagccaaaatctttatagcttgtagaatcaagttgatgctgaatttttttaatgagaatctagawtcttcaaataatttgaagctttattttcttgcttttagtgataacagaagcagcattgcgaaaaaacacacaaaaaaaattttaagaaagaatattttcatgatcacatcccagtttttcaaatttggaagtttagaacaattcagttaaatattctttgttaggtgcttgatttggaaaaacttgagagtctcttagctaaatctccacggtcatctttaatccctggacagcttccttggggcacttctgaactacttcatctccaaagattcagcctcttttcctattttttgtagaaccgctacatataacttgttggggagttcgtattccccagggtaatatgaggagtagaaaacatctccccagtttccctttttttttttttttcctgaaaagcagctcacaggcttttaaaaatttattgccaaccactctataagtagtatgtcaatacaagaaagttaaagttcccataatgtttgcatagttctcatagtcatggtactttcttactttctgtgtagctggttcaagaagactattttcattcctaaggacagagtttatctaatctttcccattttacagttccctgctctattctaaggaagcagcaaggtgctccatctctggaaggaaagacaaagatgctattggtagaaaataggtgtgagctagcaaaccagtcaaacaggtcatttaggtctcagagatttcaccacaagactaagtgaaggaggctcttaaaaaggttttcttaggtcatatcttcatgttaaacctcaaatttgaaccccttgaacttaattagggattttaaagtgacttccaatgtgtttagagtacttrtaaactgttttttttgcactatccttaargtwcatatgagttggtatttaggaggcagtgaccataattagcaacataataggccacactgcttgtggtagctggtgatgctcttaatttctttattaaattctttgttgctcactataacattttactgtttttaagacaacaatatgtattaagcccaagaattcttcttggtcctggggttcattgttaaataaaaccaagacccaattctcctgaacctttcattctaatggagaaaaagagattacaaacaagcatggaaacaaattatttaaaaggaaatatatcagcagttggtgcaatgcagagaattaagctattggtagctagttcagagaggaagttcagaaaatccacttgagaagtaacacttgaataacaagaagaaaacagctatgtgaatacttaaggagtagcaatccagaaaggacagctagtgcaaaggctgtgaagtacaagagagtttgctgtgtcaaggaaatcataaagccaatatacctaaagtctagtgggcaagaggaagagtattggaagataagaaaaaatcaaaaccagaggtaggtgggagctagatcatgcaggacactgtaaagtacttacgttatattttaagtacaaaaattagctgctggatggccaggcaccatggctcacacctgtaatcccaatgttttgggggtggaggggtgaggcagaagggtcacttgaggccaggagtttgagactagcctgagaaacatagcaagaccttgtttctacaaaacaaaaaccaaatattagcatgctggtgtgcacctgttgtcccagctactagagaggctgaggcgggaggattgcttgagcccaggagtttgaagttgcagtgagccttgtttacaccactgcactcaagactggaagacagagcaagaccttgtctctatttaaaaaaaaaaaaaaagaagaaagaagaagaagaagaagagaagaaagaagaagaggaggaagaggaagaagaagaaggaagaagagaagaaagaagaagaggaggaagaggaagaagaagaagaaggaggaggaggaggagaaggaggaagctcctggataattttaagcaggggagagtagaatgggacttataatgaaaaagataggtttggctgcaggctcactctggagaatggatgcaaagcagggggaagaagcagaaattccagcagggggatcattgcggtagttcaggtgggtgctaatggttgtgtggactagagtggctctggtgggaggatttgggtatgttctagagatagaatggcttttcctaagttacggtgcctcatcctcaatttgacatgattcactcttgtgatctccagcattgttgtgtgraacaggaggcaaaggccgcggcattatagccagagagaacagaatgatcatggcaagtttataatttctttgagcctcagtttctacactcaaacagtgagagatttgaaatgaatgacctcaaaggtcccgtccacctctgaaattctataattcttaagaagtatcatatctgggctatactagatttggatctgaatgcagattaatgaagatgtctatgctagtttagtaactggcatgactatagtgaaaagattcatagcaagggataaagtagagtcagagcaaagagagtcaatgtggagagtggaagcaaagttctcatccttgctgtacaattgaccatccgtcttgactggtgattctcgttgaggttgtgaaaattcatggcattcacagagttgttcatgtggttattaacagtgggcgtaagktaaattcccatttggtctatttgtctatttttctcataaggcctttgtatatcacaaagtcaggaaacacttggtgctttatgtcaaggatcaaatggaacatatggaagaaacaatgackctgctacaggtcttccttggtcagaatttgaaagaaactgttgaaacaacattcagaccagagaaatacccctgaagtctagagagatgctctagtaaataataacaactgcaagagttggtcagtgagccaactctttccagccaacgcttggctctttccagccaagagscactctaagatgggaagtaggctactaaactttcccatactctagtccttattattctagcagttgaaaataaggcatgatgctacttgccagggccatttattttttgcttattcgcttattcattctcttgatcaatcagttttaaaacagcatttattgaacacccaactcctgttctgtactagggatatcaggagttgccaccatcaataaagagataggcagcctgcccttgggggaagtcagaggctaggagaaaagacaaatacacaaacacaaaactaaataaagtatgacgcacgctatcagtrtggaggtaagaacaaagtgctaagtcatggaaggaccatgtctgattctttcaccgctgcatactcagggtctggcattcagtgtctgacaccatgcctcttgcactgtgaacctggaaacgcagaaaactcacagaactgcctcaggttattttgaatattcaagggaaacatatcaagacttaacatatgttgaacactctttgaactatttgatcatgctgtattcctttctatgacatctcatcttcgtaaagctgggtttgctttgataaaaagcaagtactgtgagaaaaacaacatggaataggaaacaagaatgaggattgtccaatctgattccaggctttgggatgtagtacaggcacacacatcccattaataaataaatgttatttatgaatgaagtaaaatagtacttttctctcaagttatatgcattgttttttcaaatggctattaaatcatcaggacacaaatatatattaagttgcttggacctaactgcttaataaatggaattgtttggtattcctgttggccggcctagaagtaccacaaaaaactcacccagacattaatggtgctgtaaacagaaattaagagcctctgatccaactcactgtagtcattcaacacataggatgaataaaaaaatgcatgacattctaaataargtgacagttgagctgagctttaaaagatgaaagggattttttcaggctgcaatgagaaagagaaagagagagggagagttagttttctgaaaaatggaagtagagtcaacaatatccactgggatttaccaggtctcaggcactttttctaggcactggcgtataatattaacagagaaagataatgcccctgttcttatgaagcttatattatagtgtgagatgcagatgataaagttttaaaagaggacagtttcatatagtgaatgattatgctacacttgatcttagccaaaaggccgagaagcgatagtgaatgattatgaaagaaataaagcagagtaatgggatrgagagtgacacagggatggagggttgctctacmtgaggtggtcaggaaattctctctgagttgacatttaaatgtccttagtatgtttggaaggtgaggcatgaaggagcccagcttatttgggggcctgtgggtcattttatcaggtgcagtacaaggtatattgtggggaaagaagtgggatatttatctatgctgaagagcctgaacttagccccacatgttatttcataagggacattcttagcccctcactcagagtgatgagctttggaagagcagaaggctgaaagaaaacttggtgactctatctaccccttctgtgcatttctcttctcccaggcccggtctgccagtctcaggtgaaatatatccaaggcaggagagggatttcttaacctcaggtaggaagactcttaagtgagaaagaaattctaattgcaggaacrttgatttcttcctaataaatgtgccaaatcccccacctactagagagggcctccaagaacctggctgctgcttcaccctgccacagacgcactctctccagtagtggaccaaagaaatatacttctccccagacccatccatgcttcaatctttcctgacctacccagctgaaaaacagaaatttccctcatactatataacctcccctaagatagacattgctctcatgttaaagtcagatgggacaygtcttttctaagtcacttgatgaaggcttgatttgtacactgatayaacaaaattgggagcaggctctcctatctttcagagtctgcatgcattctgcatttggacagtctctaaaaggctattacgatgtatgagtggcaggcgcrgtggctcatgcctgtaatccyggcactttgggaggccgaggcaggcagatcacctgaggtcaggagttaagaccagcctggtcaacatggtgaaacaccgtctctactaaaaatataaaaattatcttgatgttgtggtgggcacctgtaatcccagctactcgggaggctgaagcaggagaatcgcgtgaaaccaggaggtggaggtcgcagtgagctgagatcgtgtcattgcactccagactgggcaacaagagcaaaactccatctcaaaraaaaaaaaaaaaaatttatgggtgggaggagtgtggagagtaatttaaaggatctatttttcactttttcaatcccatggataatgaggacttaaagcagtgttatgtagcagaaagaacatgggccctcttgaatcctgagctgccacttaccagttatgtgctttcaaacgcgtttattaacctctctcagtctcrgttttcttgcatataaaaatatcgttctaatatatgtacaaacagaaaatgttaatacaatgttaatggtaattttaaaattggaaacaaatggaggatggctggttaaataaggtgtgatatgctcatagcatggaatgctatacagtcattaaaaagattaaggtggatctatttgtacaaacctgtgagttcttccaaattatcttgttaaaagtttaaaaaagcaaattgtggagtaataacctatagtatgatctcagtttttaataatccccagamtgaaatgtgtctggttgtgtggcaccatcccaaggcattgaaggacacacatccaactgatcacctaatacagagcagggagggactgaataagttagggggactttcattttttattctatatgcttttatagtgttttaattttttataatgaacacatattcctgtatttgtagtataattttaaagaaaatacaaaacaaaagaagatgaggttgggagraaayattttatacataattgagtttttatttgtttttgaaacaaagaaaaaaaataccacctcccagagttctgctgaggattatgtgagaaaatgtctaaaatgcactcagcctggtacctgactcagtcatgttggctctactcttcctcattacctgttatgttttgaattatgtcctcattccattatgtgttggaatcctaaactcccatacctcaaaatctaactatatttggagttgtggtctttaaagatgtaattaagttaaaataaggtcattaaggtgggccctaaatcagtatgactggtggtctttaaagaagatattaggatgcagacacacagagagaagacatgtgaagacacagaagaaggctgccttccacaagccaaggagagagccctcagtagaaaccaaccttgcagacccctgatgttggcctcctagactccagaattgcataaaaataaatttcagttgtttagctcacccagtctgtggtattttcttatggcaaccctagtcaactagtatactacctttcttcaacttcctcctctcttctgacaaagtactgtttctgaaagactacattattttttaaaaactgaaaattagatcactttgaaattccaaagatcagccttattctatggcatcatgggtaatttctcctgattgttttgccaagtgacaagttccaggtattctggaaggagaatgttagacctcatttccggcagaactgcaggcttataatggcccttcctttggacgaactctagaaaaacagactttctatacaatgcccagttattaggctggacagtcaggtctctggcaactatcatggcttggctgttctttggccaaatacttgattggaattgctgtatattctcagaattatatcccaggggacaaatcagtatccaccaaaagaagtctaacttactgtaaagccaagatgaatgtaggatggtgactaaactcattataggacattgtggtttgtgtgtttctcctttttggagttgagaagaactgctgttgctagaacaaaaggatgttctttaggcaacacatctgcaaaaaatcctaatttctctgatttgacccacagcttttttttttaatgstaaaattagataacaaagggaaacaatgtttctgaaaagagaaatgatgagtgactttgattgtttctctgagggcagagcccctatccaccctgtgataacatcaaggctaaataagctttcagtatcttgcaaataaattaatctctaaatgcaattgtacagcatgccatgtggacaactggaggttgactttggttcaaaacacatcatttctttttcgctagttaaacactgarcattcagagtaatggttgaaaatatttgcagcaattactctgggaaaaaaaatcctcatattttatgactaactgttttatcatttgtggcataaagaaataaacatttttttaatgattcacagattccttcatttgatggatctggtggctatagatctccctgcagtgcttgctgccaggcagctggccaagttcactgggtgccccccagccccagtaagttaggccttctgcttttcctctcctctcggccttcttctgactgtggcacacatttcttttttaatgctttttctgacatgtctttattttactcctccttattctctctcctatcccttctccttaatgtgttctcaatttcttatcctctgcttcaactctgactctctcgggagggttctggtatgaacactcgtcagtggaaagaatacaggcttgggggctctgttacttactaactttgtggtttggggcaagctcttcaacttctcgtagcctcagtttcctcaatcttraagtggaaataatagtaatgctcagttatagtattcctttatagraatcagtgcaacaatggaaatacatgggaaataacaaattttagttctttcttccacattgccttggtaaaagctaagtgagtgacactcttacaagaaacagggcccagtgaaaccacagcccacagtatcacatcagcattaaacatttccttccagaaaagttatattccttggctaaggacaatttcactcttgttcataactcaaggtgatataataaaaaactccaaattgttagggaacatatgaaagggaatatattagtaaaactgatttctgtttgatggcatctttctagtatacttaaagggccataggagatattgtcccctaaattgatcacagttttttttttcagccagcatcatcccatggagaccacgagagcggggtttagcaatagttgtaaatgaccattgagtgatatgagctggcattcctggcctgaagagtcacaccttccagctcacttgggtgatgctgactgacaagcaatcacctatattattgtcttgtggattgatggctaatgccaagcatctactttccttgactcagtatgartaggaatgcctacttggccaacccgtaatttccctcaatattgccatgatcagttgttatattgagacccactcagctagagctaactcctattattaatgacagagtgatgactaaatgcatgtwtgaagaaaagaaaaatcattcaacagctcaactttcaactgatgaagagaattaagaatgagaccatcatttccacagggttgaaaattattagattgagaaaagctgatatgagtcccctctcctggctagctccacgagcttaggcagacagctttcatctctttctgccacaatccccgttattgaaaatgacagataaagactgattacatacctcaragagaacctggcaaagttatagactcatagaatgttagaattagagaagaattagtatatttgggttgtctgccctgtgccaggcatggtaccttatgaccttttgccccaaactcaytcaattctcacmactaccttgaaaattgggcattaccttaattatacagataaggaaattggaacatttaaagacatgaaatgccttatttaggctatacagctaaggagtggtcctgtcaggtttgtaaatgccgaagcacatgctcatttcaccataacaccaggagctatatgggtgatctggactaattctcatttagtaaacagcaaaactgagatccaaaaagtttaaggctcaagcatttttacaacatatgctttttttwttaagaaaagagatattcaaacaagtctattatagcaattataattcttcaaggctagaagtatatgaactgctgagaatttttaatgtgcaaattaaatacagcagaaaaagcaaatccaagaatccttgctgaaaacatctctaattccctctcctttgagcgtctctgcctgtcaagaggatataaatttattaagtcaatactcctcagaatttactttctcaagtcctagtttctgaatttcataaaaagratgctggcctctagtgaaccagatagaagcttgaagcagggatttgagaataatttagaaagaaattactactgcagttcatcccttggcaaggccctacggaatgaaaccaaataagctgccatgcctaggttgctaacgtgcaaatacttgcatgtgttcagcctggtttctgtaagcctagaaacgataagcagcatcaaatcttctcattaacaccaagatgtgctgaaactcaagcagcatgaacttgtaggtttttccctccaagacatcactttgtgctgggtactataagcaagggccattatttaattagttaacaagtttttgtactatcattctagcagtcttgtccttcttatgttttcctttgcattttaaacattctctttcttttaagaggaaattgtgaaacttaaagaggttatctttgaggtttggctatatttttctttataatcttgctatgagcagtaactacatatggctgttggagagtgtttagtttgggtttcaactcagttgagagttttgagtgaaatatggtcatcacagtgggaaggctaaagaggcattattattttcattattattggtttttttagagacaggatcttgcctgtcccccaggctggggtgcacgggtacaatcacagctcactataacctcaaactcctggactcaagtgatcttctcattaaaaagcattattagattccttttcctttgaatcttcactgagtaaatatactttatagctctttaacacccgtatccaacaacataccaacatccctttcccaagcagcatattcattaccaaaaaaacttattccttccccaaatagaaatttttaaaagaaagatatcactgttttacaatgtgtaatttatacctttttattttttctcccattaaaatatgactaggatttatttactttgaattgttatagatattggaagtaatttagacaaaactgtcaattcttatagaacagtattttgaaaaaactatttttaagctactttttatatttgacttcgtgactgggcaatgaagacaagcagccagatttccaggcacaccacccctatttcattcaaaacaagtctgcttttaactgctgtatttattagcatcctatgtagatttctttggaagaaaaataatcattcagcaacgaaaataaagtttgaaaacacctgctttatgatatctcataaggtcttctaaattttrcgtggctatttctaggtaagaaattctccaataaatgtctattctgtacaattctaattgccaagaagatgtttcttagagcaaaatgatgtgtactttcttattaccatttaatttactatagcagatcgtttttgactacatgcaaagcattgctctaggagcaaatgaaaataagaaaatgtatgtaagactttgtactctcaaatgttttaaaattggaggraggaagagaataaagacaaaaatatagataggatttgatgcagagtaagttacaaaagtacaacagaagagctcagaggacatctatgcaatctattaatatcttaatawctattcatcctctcctttccaagcaagcaacaatcacagattaaatataaaatgataaaaccagtggcatagccaggttcaaaagcaagagaaaaagtccatggaccaaaaatggaaaataaatgcaagatggtgaatagtgctgatttcataggctttttggctccaagactgaaataaagcaaagattggcagtagcttgactctggtaggataccagggttgaatttccttcacagaagaagcaggacctaagccaggtagaaaacttgatgtcaggagtttcgaggaggctctctgttgtgaagagcggctgtatatatatawaaaaaaaaaaaaaaaaaaaaagacagttgccagttgcctagaatgagagttttctctgaaattgtgtgtctaaaagaggctgtttgatagacatagataccatatcatgaactgaaactctaccaagccatactttccctctgggtctagacttgcaatttcttcattatggattaaaacccaaaattttagtacagtatctgattctggaccgggggccatgtgaaccgtatggagataatcataaaaccattggaacagacaaagacagggagaacaaaaggaaaacaaacagcttttcactaaaaatgagcctgcaaataaaaattccaaaacataggaaaaaaatatatatataataccaagaaagacaacaaaattaacgttcacaccagataaaattctgtgaaacagtttgacaaagactttaaaattaataaagtcaatcctctttattgatggatgcttgcaattgtgaattgtctacttactaaaatttgcttgtaaccccccaaatcaacacttatggcacatttgtggtcattcatgggcatgtgaagaaaagttaaatctttgagtcgctgaatgaacatgttcccagctgtggttgaacaagggacactctgccttcctgtttgagctctcatactgtaaacaagtgtccttttggcagtctatttagtgtcaagtttttcacgtttatttttgtgcttttttggtgatttcattgtttaaaatggccccgaagcatatgctgaagcactgtctagtgtttgcaagctcaagaaagctgtgatgtgccttatggagaaaatgtgtgtgttagataagcttccttcaggcctgaattacagtgctgttggatgtgagtttcatgttaatsaatcaacaatctctacaaggagtgtttaaaaagaaacatacattaaataaggttatctacagatcagttaattaaaatgttgtgaccagagacttgaaggaactgtatttctccctaagtgcaatggttcattatttgctaattcagcatttatggtgattttctagaacgtaagtgacacaaataatgagtattgactttatgttgaaaagaaacacattaagaaataacagtgcttaaaaataaagaataaattagggagtaaagacagaaataaagcattaaatagatagatgaagaaaataaattattagaaatttgcaattcaaaaatctagtaattgaaataaaaatttatccatagataggataaattccaaacaagatgcagaatcagtgaaaatttgaagatagaagttagaaactttacccaaaatataggccaaaattccaaaatatataatacaaaagagcccttaagagatacagagagtgtacaaaaggctccaatatacatcaaataggagtgttcaatgagaaggggcagaattccatttagaatattccagaaaggaaaaaaatagttatcagactaaagttgcaatgaaagtgctgaacaggaaaaataaaaatacataaccagacatatcatggtcaaacatcagaaggagattccaactttaggataagggggaaatagtaaaagctaccagagaaaagacagagtacccacaaaagaatgaaacttagactaaaggctgaaacttctcagtcataatggagtgtaaaagatgagttaatgtcttcaaaatatgaatggaacataactgtcagtgtagaattttgtactctcaactttcagtgaagagtgtaggcaaaatacaaacatgtcctgatctacaaagatgagcattaactacccatggactttcactaacataactactacaggctacatttgaggaagaaaaatataggaaaggtgggcaaaaagcaaaacaatggtgatccccaaaggggtatgagagtgtgtatatgtatgtatgtatgtatgcatgttacatggcttctcttcaataatatttctggtattcttttcctaatgagtgtctgggactattgaacttccccaaccctttgaagttagacatgaccacatatgttgctttggtcactgaaatgtgggtttaaatgagctatgttactttctggaggaagcaatcaagggacactgtgacagtccccaagttctgtctttcttgctttagtgaccaaygagtctatgtgccctaaaacctaaaatcttgcttctcaaaaaktaatctggggtccagcagcatcaacgtcagcctggttcctgtgagaaatgaatatcaagtttcatctttggcctgcagaatcaaaatcttcagtttaacaagatctccaggtgactcgtatgcacattaaaggctgagaagctctgttctatcagatggtccttcctttcccagcctgggtcactgagttaccccacagatgacagctgctctggaaagacattttatgagaaagaaataaatatttgttttgttaaaccaaagagcttttggagatgatttgtattttcaaaatcacctaacttatcctgacatctacagttaatatggtaacacaatggttctccaaagatatctatgtcctgatccctgaaacttgtgaatatatgttacatggcaaaaagtatgtacttctgtaattaaggttgcagaccttaagatcttaaggttgcaggaagtatatcctggagtattcaggtgagcctcatctaatcacacagactcctaaaagcagagcgctttcctcagctggaggcagaaatgattgtagcaaaagaaaccagagattctaagcacaagaaggcattcatgtactgttgttattggctctgagatggagggggccgtggcaagaaccgcagagaagtttctaggagctaatggtcacccccaactgatgcctaacaatgaagtgggacatctgtcttaaaaccccaaagaactgaatttagccaacaacctcaatgcatttggatgtggattcatctccgcagcctctaaaaagtaagcccttccaatgccttgattttggcccagggaaacgctaagaaaaggacccactgagccatgctttatctgggtgtctgtacacagaatcatgagataataaatttgtgttgttttaagcacctacgtttatgataaatgtttatggcagcaatagaaaactaatattattaatccaactgctgaccataactttggtgggtttttttaaaaaaacatatttgtgtattactaacattccaatgtttagtgtgtgctaagatccctcttgtatttgggaagaaaatggaaacacaagataagtttacattttttggaaatgcaagtttagatgtacattttaaaattttaaatattcagtaacagactagaaatatcatctatagcttccamactaacagagaaaatctggagaataaagacagccttaccaatttaatagaagctaggaaaagagagaaaagaatcaaaaaggatggtagacaaaaaatacaaaacaaaatgccaaagttttccaaagtggtggtttcaatccatattcccaccagaattatacttgttctctttgcttcatatccttgccagtgcttgatattgtaagaccttttaatttattttcctatctgtgrgtgcattcctagaatatacccaacttgctcataatatattatattgtttacatcttgttttggtttcctaataatttgtttaggacaatttgcctctatgtttatgagtaattttatttcttatataattcttatctgattttaataaaagaaattgggacatgtttcttcttttctagtctttgaaagagtttattttatattgagattgtctattcctttcatgtttagtaaatcttgcttgtaaaattatgagaagagattttctttgggggaagatttttcattaccgctgaattttttttttttttttaagtctacatgcagtatagcctagtgcccaaagaatgagttttggaggcaaactgtctagattcagtctcaggtctgacctcctaactgtgtagaaagtcacttaacctcacggtgcctcagtctcctcatttgcaaaatgaggcacatagggtcgtcgtgaggatttcatgaactgatatatgtaaacatgtaggtcagtgcctgtcacataataatactataagcatttacttttgttgttatttctctttcttctcgaatagttgtgttttttgttttctctcacttgtctaagactgttttcaagtatgatgccttaaagtaggttgaacttctctgtaactttctcttcaactctggctgtatctgcatctgtctccctatttgcatctctaatggtgtttgggatttcttctttgttaagaaagaagaaattcaaamttcatcatttaatgaaatttgtcagaatttattttattaatcttttcaagtagcagcctttggctttgttgagcctatggtttttatattttccacttcattgatatttatattattttctttagcttactttcttcaaacttattttagtgtactttttgtaattccttaggtttgaagcttggtgttttacatttcagactttcttgttttcacagaaatgttaaaataaatacagctttagttgcatcccgcagtgtgataaaaaaaaattttcattatcattcagttctaggtatttttaaatttccatatgattccttcaggtcataaattacttacaaatctgttcattaacttctaaatacatggggcrtttacatttttctttattaatcgctaacaattgcattatgatttttccaaaatggtctttttattccatttctttggaatttgttgagattttgtttgatgacctgttatccacactttcttgtagagaacatgttttcctgctctggagtgtaaatttctatatgagtatatcaaatgttttgaatgtgtttattaaatgtcctagttctttaataattttttwaaaatacttgagagaatgatatttaaaatcttcttctttgttaggttaatttgccaatttcaccttgtagtccgtttgggttattttggactgtcttattaggtagatatacatttaaaattgtttgatctttctgaagaagctaatctttcttcataagttagtgactgtctttatcagtagtaatcctttttgccttaatgtatagtttatctgatataaatattcacctttcatttgattagatctgtctcttacatctttttctactcctttactttccacctttctttatctttatggatatttaatgtaaatatttttaatttttaatcttataatctttgctttcttccatctatttgctgtcactatggttactgataaaattacacttatctctatctttaaatttatggatatttaatgtaaacatttttaatttttacttttataatatttgctttcttccatctatttgctgtcactatgattactgataaaattagacttatttctgccatcttactttctgatctctagttggcctgcttttccaatgtttcctcttttcttcttgacttcttagaactagtcccagtcttttttttttttttttcttattatactcttccctcttccctctactggtttaaaagttatatatccatttctatttttttactaattaccctaacttttaatatgcatacctaaagttaaatagtatttatccccacctatcaaataattcatgtctcttcaaacactttagctctgattaaccccctcagatttatgtgctatttttgtcaagtgttttagctctatttttcttaactcacagattagacacttgatatagtcaaagtttattcagatatacttgaaaacattccactttatttgatcccattttttctcagatcatagatcttcaaatattactttccttttatctggagtatatcctttagactttctgttagtgagggttcmttagaagtgagtgcttttggttttctgtattttgtttgtctgaaatatttgtatttggtgctctctcttgaaagttagttttgcagtgaacttaactctacgttgacagttatcttgtctcaacacttcaaagagaattatccattgacttctaactaccatygttgccattgagaagccagctgtcattctaatttgtttttcctgtatcttttctgcctgacttsttttatttattgttggtgttcagtagttagctatgatctttgtagaaatgaatcattattttattttattctcattagacttctgaatctgaggatttgtatttttaattatttctggaaaattctcacaaaattattttctctatgtaattcacatttcttagtctgttattaatgctttttacatctttgtctctctatattgtattttatataatttcttcaacactttctctcatttaacaatatctcttcccagctgtatctaatatgctttttattcgacctgaaaatttataaaaacatttatatctgcatgtatatgagttctgtttttttttwaaatctacatgatgacacctgttctttggttactctttcaaaattcttcttaaaaatgtccataagcatgttaaatttttttattttgcatcctgtgtctgataatttcactatcagaattttctgtaggtctgattttcttgtttctgctgtctccttttcacgttgccttgtttcctcatgttttatgttatccttatatgctttcatgattgttggaatttaagagggagttccttgtaatctggtttacgatgtgtacttcctggaataatttacgtttgctcttgaggaggatgttggcatagggtgacccaatgcgaatccaagaccactttacattcccaaatgtccgcactaagtgaattgtttcccaaattgtcatgagtcctattgttagaaactctgaaggaaacttctacccccaacctttacccgtagccaacctgagataagcaagttttccttattatttctttatgcggatctgagtggttttttttttttattttgcttgtttgtttgtattatctcattttatttttttttttagagaaatggtaggttcacagcaaaattgagcagaaaatagagaagtttycatatgtctctgcctaccacatgtacagtctcccccactatcaatgtcctgtcccagagtggtacatttgttagaattaatgagctacattgacacatsatcagctaaagcccatagtttacgtcaaggtttactcttgtgttgtacattctatgggttttcacaaatatgtaaggaacatatatccacctctgtagtatcatacaggatagtttcactaccttaaaaatcttctgtgctccacctgttcatcctcacctccccataacccgtgacaactaccagtctttttattgtctccttagtttggtgttttttaggagctgagtatcattttcttttcctagtttattccttctctgagggttttgccttasagtcctggcattacgagcagatattcatcttcttccacaacttgccgttcatagactttatcccctgttccctgcttataaagactgttagaatggaaagttcaacaccaccagaaactggcagatccttttagaatcgacttccatcaacttcctctctggatttgtgcctttttattgtttttgtctctgaggaaacttccttgccagcccagctgtgtattaacaattttttaaatttttatttatacttaaagctattatttttagtcacttgtagtgagaagctttctcagagtttctagtcctacatcctgttgcaactggaaggtccttaattcattccttgatgaatgttatttagcattcattttgtatcaggcttggacgaggcccttgggttttcattgttttggaggacacagatagaaaaaaacaacaatgtattaagtccaaagatgaaggtatgcacagggtgctatggcatcccagagggagttgcctcacacaggctgagaatagggagttgtcagagaaggagaccaggaagtgacacttgagctttgaaggagttaaccaggrgaataagaggtgaccatattggatcatgtcagccagaggagtgaaacattgagagaatggcaaatatgccaacatcaagtgtgggctggatggtaacaaatacgaagaaaagaatctagaaaacaggcaaagctgggtcagctcctcacagaaactttgtgaggtatttattgcattgccacaccatgtagaaaggagaaaacagtgtaaaagtgttcctatgaacgttgtgcacatgtaccctagaacttaaagtataataaaaaaaatacatataaaaaaagaaagaagaaaacagagacagctcagctctcaggatctgtaaggaacactgatgacttgcagggtaagaaacagaattgacattctttttcctttaccgccttgcacagaatcagccttaaagaaagatagaataggaaaggaagttgcctctgtccagaagtaattgtccacttttcaattatctgcccctctgcctgtaattctatcattataatraaagcttgacttatggtcttagcatctgtctttcccctttaaactggaagcatcataaaggcaggtacaataattgactttttactatagctgagtacttgataagtgtctctatgtttttgaacatatgtggtcaatagttattgagagtgattaagtggaaagctttattaatcatgcaaatcttactctagatgactttaatcagtctttccccttctttacctttatctaagtgtagcccactgaaggaaatgtaattttcataggaagaagaaaggaaaattgactttggagcctaatactattcaggatgaggctggtgctaagaagctatgctataagcctcaaaggacaatctaaaagcactgggttktagaggtcagaaaacacatttctctattttttaagtttcttaaaatatgtccatgctccaagatcaacaaactaagaagtatgagcacatttgaacaaagttgaatgttgtcatccattaaacttataacccagtaaatttggcacatgatattgtttgattagactcatatgttaagccattcatatgtcactttaattaaaattatatttaaagaaattatatttaaagtggttctggaggcagcaaggcatggcctttaaccttcagtttggaaagaattgtcaccaaatctatgatgtgatgaagctttttgagacctgaaatacttttttatggggtcaatttatataccattaaccatgaacttgggtatctgtaggaggaattctgatctagaagttggaaagagattagggaaggaagtgacagggtcattaaactctttccatggttttgtccgtatgaaccctacttctttcccctcattccaaagtctataaggaaaggcacagatagtcttcactggtatcatgaaacagtctgagaactccttgctttctctctttggacaatgtgacataagagaacaccctgtctcttgccaagaagatttgcattaatggtcagggttagagtttaccacccagagaggaatctgggtgagaggagactcttttccattccagtgattagagaatagatgtctttctctttcacccatagacttggagctttctctcaggtgagaaccacttccagttctagaattgttctttaatgaactgattcaatagtgattaaaataagggcctgaccttgactttgcaagaaatgacccaggttaaccttaagttgtatgctacaaaaatgttactaaaagaggtatttcaagtcattcatggtgctgtgttgcatgccgccagtaaaggagcattgattagatatattgccaggaaatacaccatgttgtcaggattcactgacaaccaaaaagaagttaagcctgcagacaatatcaagtggtttgttggagactgggaaggagagaaggtgaagagaaatgctacagtcttctacaagcggtccatcatggcatttatcttttaattgctctaraaagtgcctttttccatttgtctgataaatgactggcataagaaccacatgttccatgaagcaactgcaatctccatatttgcaatctatcaatctcaccctttctcacttgtcttttttttctatttagcatgtttcattgyagattaaacagattttattccctgttgcctggtaattatatataattaaaaagcacagaggaatgggcataaaagcacaatgaagtaataatcataggaacagtgtcttatttgaactcactgctgagggagagttgcttttttaaaaaaatatactttaaatactgggatacacrtgcagaacgtgcaggtttgttacattggtatacacgtgccatggtggtttgctgcacccatcaacccatcatctacattagttatttctcctaatgctatccctcccctagtcctgcatctcccaacaggccccagtgtgtgacgttcctttccctgtgtccatgtgttctcattgttcaactccaacttatgagtgagaacattcagtgtctggttttctgttcttgtgttagtttgctgagaatgatggtttccagctttatccatgtgcctgcacaggacatgaactcatcmttttttatggctacatagtattacatgttatatatgtgtcacattttcttaatccagtctatcattgatgggcatttgggttggttccaagtctctgctcttgtgaacagtgctggaataaacatatgtgtgcatgtgtctttatactagaattatttataatcctttgggtatataccaagtaatgggattgctgggtcagatggtatttctggttctagatccctgaggaatcgccacactgttttccacaatggttaaactaacttacacttccatcaacagtgtaaaagtgttcctatttctccacatcctctccagcatctgctgtttcctgacttttttaatgttcaccattctaactggcatgatatggtatctcattatagatttgatttccatttctctaatgaccagtgatgatgagttttttttcgtatgtttgttggccacataaatgtcttcttttgagaaatgtctgttcatatcatttgcccactttttgatagggttgtttttttctggtaaatttgtttaagttctttatagattctggatattagccctttgtcagatgaatagattgcaaaaaatttctcccattctgtaggttgcctattcaccctgatgatagtttattttgctgtgcagaagctctttagtttaattagatcccatttgtcaattttggcttttgttgccattggttttggtgttttagtcgtgaagtctttgcccatgtttatgtcctgaatggtattgcctargttttcttctagagtttttatggttttaggtcttatgtttaagtcttattccatcttgagttaatttttgtataaggtgtaaggaagtggtccagtttcagttttctgcwtatggctagcctgttttcccaacaccatttattaaatagggaaccctttcactattgcttgtttttgtcaggtttgtcaaagatcaggtggttgtagatttgtggtggtatttctgaggcctctgttcagttccattggtctatatatctgttttggtaccagtaccatgctgttttggttactgtagccttgtaatatagtttgaagtcaggtaatgtgatacctccagctttgttctttttgcttagaattttcttggctatatgagctcttttttggttccatatgaaatttgaagtagtttttttctaattctgtgaagaaagtcaatggtagcttgatggcgatagcattgaatctataaataactttgggcatgatggccattttcacgatattgattcttcctacccattagcatggaatgtttttccatttgtttgtgtcttctcttatttcattgagcagtggtttgtagttctctttgaagaggttcttcacatcccttgtaagttatattcctaggtattttattctctttgtagcaattgtgaatgagtgctaactcatgatttggctctccatttgtctattattggtataaaggaatgcttgtgatttttgtacattgattttgtatcctgagactttgctaaagttgcttatcagcttaaggagatttgggtctgagacagtggggttttctaaatatacaattatgtcatctgcaaacagagasaatttgacttccccttttcctatttgtataccctttatttctttctcttgcctgattgcccgggccagaacttccaatattatgttgaataggagtggtgagagagggcatccttgtcttgtaccagttttcaaagggaatgcttccagcttttgcccattcagtatgatattggctgtgggtttttcataaataactcttattattttgagatatgttccatcaatacctaatttattgagagcttttagcatgaaggggtgttgaattttattgaaggccttttctgcatctattgagacaataatgtggttttgtcattggttctgtttatgtgatggattacatttattgatttatatatgttgaaccagccttgcatcccaggggtgaagccaacttgttcgtggtggataagctttttgatgtgctactggattcagtttgccagtattttgttgaagatgttcacatcaatgttcatcagggatattggcctgawattttcttttttgttgttgtttatctgccaggctttggtatcaggatgatgcaggcctcataaaatgagttagggaggagtccttcattttctgttgtttggaatagtttcagaaggaatggtaccagctcctctttgtacctctggtagaattcggctgtggtctggtcctgggttttttttttggttggtaggctattaattactgccttaatttcagaacttgttattggtctattcagggattcaaatatttcctggtttagtcttgggagggtgtatgcccagaaatttatccctttcttctagattttctagtttatttgcatacaggtgtttacagtattctctgatggtagtttgtatttctgtgggatcggtggtgatatcccccttatcattgtttattgcgtctatttgattcttctctctttttttctttattagtctggctagtgctctatttcgttaatctttaaaaaaaaaaacagctcctggattcattgatttttttgaagggttttttatgtctctatctccttcagctctgccctgatctyagttatttcttatcttctgctagcttttgaattcctgttcctgttttgaaatccgttcctgtttgctcttgcttccctaggtcttgtaattgtgatattagggtgtcgattttagatctttcccactttctcctgtgggcatttagtgctataaatttccctctacacactgctttagctgtgtcccagagattttggtatgttgtctctttgttctcattggtttcaaagaacttatttatttctgccttaatttcattatttacccagtagtcattcaggagcaggctgttcagtttccatgtagttgtgcagttttgagtgagtttcttaatcttaagttctaatttgattgcactgtggtctgagagactgttaagatttctgttcttttgcatttgctgaggagtgttttacttccaattatgtggtcaattttagaataagtgtaatgtggtgctgagaagaacgtatatactgttgatttggggtggacggttctatagatgtctattaggtccatttggtccagagctgagttcaagtcctgaacatccttgttaattttctgtcttgttgatctgtctaatattgacagtggggtgttaaaatctctcaatattattgtgtgggattctaagtctcttttaggtckctaagaactttatgaatcttggtgctcctgaattgggtgcatatatatttaggatagttagctcttcttgttgcattgatccctttaccattatgtaatgcccttctttgtctgttttgatctttgttggtttaaagtctgttttctcagagactaggattgtacccctgctttttttgctttctatttgcttggtaaatattcctccatctctttattttgagcctatgtgtgtccttgcatatgagatgggtctcctgaatacagcacactgatgggtcttgactctttatccagtttgccagtctgtgtcttttaattggggcatttagtccattgacatttaaagttaatattgttatgtgtgaatctgatcctgtcattatgatgccagctggttattttgcccattagttgatgcagtttcttcatagtgtcaatggtgttcacaatttggtatgtttttgcattggctggtaccggttttttctttccatgtttagygcttccttcaggagctcttttagggcaggcctggtggtgacaaaatctctcagcatttgcttgtctgtaaaggattttatttctccttcacttatgaagcttagtttggctggatatgaaattcttgsttgaaaattcttttaagaatgttgaatattggcccccactctcttctggcttgtagggtttctgcagagagatctgctgttagactgatgggcttccctttgtcagtacccgacctttctctctggctgcccttaacattttttccttcatttcaaccttgccgaatatgacaattatgtgtcttggggttgctcttcttgtggagtatctttgtgatgtttcctgtatttcctgaatttgaatgttggcctgtcttgctaggttggggaagtctcctggataatatctggaagagtgttttctacttggttccattctccctgtcactttcaggtacaccaatcaaacataggtttggtcttttcacatagttccatatttcttggaggctttgttcattcctttttattcttttttctctaatcttgtcttcacggtttatttcattaagatgatcttcaatctttgatatcctttattccacttaatcgatttggctgttgatgcttgtgtatgcttcacaaagttctcatgctctgtttatcagcaccatcaggtcatttatgttcttctctaaactggttattstagttagcattttgtctaacatttttcaaggttcttagcttccttgcattgggttagaacatgctcctttagctcagaggagtttgttatcacccaccttctgaagcctacttctgtcaatacatcaaactcattccccatccagttttcttcccttgctggcaaggagttgtgatcctttggagaagagtcattctggtttttggaattttcagccttctttcactggtttttcctcatcttaatggatttatctacctttggtctttgattttggtgactgaatgggttttgttgtggacatcctttttgttgatgttgatactattcctttctgtttgttagttttcctctaacagtcaggctcctctgctgcaggtctgttggagtttgctggaggtccactccagaccctgtttacctgggtatcrgcagcggaggctacagaacagcaaagattgctgcctgttgcttcctctggaagcttcatcccagaggggcacccaccagatgccagctggagctctcctatatgaggtgtctgttgacccctgctggaaggtrtctctcagtcaggaggcacaggggttagggacccacttcacgaggcagcctgtcccttagtagagctctagcgctgtgctgggagatctgctgttctctttagagccagcaggcaggaacgtttaagtctgctgaagccrcacccacagcctccccttcacccaggtgctctgtcccagggagatgggagtttgatctgtaagcccctgactggggctgctgcctttccttcagagatgccctgcacagagaggagaaatctagagaggcagtctggctacagcagctttgcgtagctgcggtgggctctgcccagttcaaacctccgggggctttgtttacactgtgagtggaaaactgcctactcaagccttggtaatggtggacgcccctacccccaccaagctccagcatttcaggtcgacttcagactgctgtgctggcagtgagaatttcaagccagtggatcttagcttgctggactccatgggggtggcatccgctaagctagaccacttggctccctggcttcggtgccccttttcaggggagtgaatgtttctgtcatgctgatattccaggcgccactggggaatgaaaaaaactcctgcagctagcttggtgtctgcttaaacggccgcccagttttgtgcttgaaaccctgggccctggttgcgtgggcacctgagagaatatcctggtctgcgcattgcaaagactgtgggaagagcatactggctgggccggatagcaccgtccctcgtgcacagtgcctcatggcttcctttgggtagggaagggagttcctcaacccgttgcacttccctggtgaggcgacgcaccaccctgcttgggctcaccctccgtggattgcagctactgtctaaccagtcccagtgagatgaccggggtacctcagttggaaatgccgaaatcacctggcttctatgttgatctcgctgggagctgcagaccagagctgttcctattctgccatcttgccagccsctgcctcacttgtaaatagaaacataaggaacttgttttgcaacagacccaaggaatagtggcaaggaatttatgtgctgaaatagctctcctatactagtccttttcacaacctgactttccaccacaaatattttggtaaatgcagtctgaaaacaaagcactgtataattgtgtgcttataaaatgaaattgtatgccatgttacaaaaggattatgaattactccttcagatatgctaattttaaggaggtgggagagaacacttattttagactataataaaaaataatagaaggtcagaaatgctgatttaagaaaagatactgctaaattggagtgaattcaaagaaagggactaaaaataataaaaagcctcaaggaatgaatattttcaaaattgagagaatttaagactctaaaatgacaaactacaaccagtcttagaaatacctctagggaactggattccaaacgtctgcattcttcaaaagagaaaaagtaaaagcactgaaacaaaagctacccagaggaaaaaaatgaacttttaaagctaaatgtttttacttagatcaactctcagatgcctggaaacattaaaaactagcctggcaaaccatttgttttcagataacaagctataatagagcaaggaaggtgggattgatgattcattatatcacacatttcatatcttttatgtctggacctgaatgaagacattggaacagtttaaagctttcartatacctgtaactagtgttctcttagtaaacacatagtagggcacacccaaagtttgaatatattagaaagagttccatattattttcaaggtcatagagttataaaggtataatttcactgagcatgaacttgatctattgtaaggtattaagatggttaatgactaattttcacaaacactcatttcccttgaatatgttattttccaaaagacttgagagtttgggggaaaagtaaaagaaatctgtaaaccttttgcaccaggaaaaagaacaaaagcaaggagttttaaactatrcctagtatacatgaaaatatggtgccctaagccatttaatcctagttatgaaaaaaaaaaaaaaaaagcctgttggccttttcaaaaaggagggaaaattagccaagaacggcctttacctgctatggcaccatcctccaaaactgaccccactttctgttctttgcacttacagtgatgtgttagagatttaaatattatgctcttaaaatgtaacagagttgtctccacgcagactgtctagacagggcagcaactatgtctgtttaatttcattttacatagcagctagcaatcttgcacaaataaatgcttttgatgataattttgatgttagtataatcaggtggccaaaatttgggggttaaagcttagtactttaatatgagtactttatagtgcgtgcttacaacattaaatgttatataaaatttacaaatgtctggctattttttaaataataaaggatttcagcacattttatgtttcttaatattggcctgttaaatttgtttacatggagaaggaaatatcagtctgcctattcagaaactaggcaagactccctaaccaactttcctagtgtctgaaatgtattagtattcttgtaaatttattctcgtaaattttttttgaaagaaagaaaaaaattagatattccatcaattagaaaactaagattcaaattcctgcaagacttatgaaagcagcactggagttcccacaataaaaaatatgacgtctgtttcctttattcaatgtgttagtcattctttcaacaaatattcgagtacctggtatgtaacagaaagccaaatgggaaaagattgctgtccttctggaggttctgctgtagtagacgaagacagacaataaaatgttaagcacagtaaatgagtaaattatccgatatacttgtgggtgactaagtgttataggaaaaaggaaagttgagcaggataaagacaaatcagcagtgggaatgggattgcagttttacacagagtaggcagcctaagctttgtggaggtgatatttgagcaaagacttgataaaggtgaggtaattcgctcctcagaatctgggcaaagagaattccaggcagaagggatggataatgcatgcatcctaaagtaagagtgttcctggaatgtccctgaagacacagggccttgattccagaaaaatcaagggtgactggagctaagtgagcaaggacaataggatgtgacaggcctgagggatgatgggggctctcataagaccattctggccactgtgctgacaaaactttccaggagagcaagggcagaagggaaattaggagactattgcaagaacgcaggcatgacatgatggctccttggacttggttgtgatcagattctgtgttttttgtgtatagaaaaatagttctgatggattggatatggaagtcaaatatggctctaaggcagtggttctcaaagcgggtttgccaaattagcaacattcgcatcacctgggatcttgtttgaaatgcaaattattaagcctcaccccaggtctactgaattagaagctctggagggtggggccccaacaatcctgtaktttaaaaaggccttcaggtgattttgatgtacgtttaagtttgaaaaccactgctttaaagtttttgactaggctgggcaaggtggctcatgccgttaatctcagcactttgggaggctgaggcaggtggatctcttgaggtcaggagttcaagaccagtctggccaacatggtaaaaccctgtctctactaaaaatacagaaaagtagccaggtatggtggcacacacctgtaatcccagttatttaggaggctgaggcaggagaattgcttgaacccaggcagtagaagttgcagcgagccgagatcatgccactgcactccagcctgggtgacagagccagaaaaaagaaaaaacaaaaaggttttggcctgaagagtatagarttgacattgggttggggaatgctgcagggagaacagatttcatggggatagcaggaggatcagggattcaggtttggacatgatgagtttccagtgtcttagatgtccagatggcaagtgagcagttgtatacagtagtcccccccttattctcagggaatatgctccaagacccacagtggatgtctaaaactgtggatagtacctaaccctatagatactaacacaaatatattcttatacacacatacaatgcatgtatctatgtacttatgtaagaaaatatagataatttctcatacatatatgagataaagtttaatttataaatcacattgagaaattagcaaaaataataaaatagaattttaacatttaatattattgatagaatttttctaacaatatgctgtaaaaacctctattgtactattataactctattgtaactatgcagttataactctatgctattataactctactataacaacatgctgtaataaaacttaagtgaatgtgatctctctttcattctctcaaaatatcttattgtactgtgctcacctgttctcaaactgtgggtgactgtstgtaactaaaaccccagaaagcaaaaccacagacaagggggactactgtatataagtctgaatttcaagcgaggaggtctgagttgcaaatagaaattgaaacactgattttttttttccgagaacaaaatatagtacattggattttatcgatggatatttgctattcagtgctttcatcttaactttgaataaaagatacagaaagccaagtaacaaagaccaaaatatgtaaaagaggcagcccaccatctacttaggtgtgctaaaagattcgaaagctttagaggatatattttccagaacatttatccatttattatagagcagccttttatggtaatcttttctggttttactgtcagtaaattgaggattcctaatattttgagggtaaaacaactggtaacattttctaacatcatccagtagctggtaaatttccacgtatgtttttatcataacgtggttatccgcagttgttggaggataaagtagatgccttgctaggcagttctaattgcgttttcttgcatagtaactgttatggagagtgagtgattaggacagtgtggaggggcagtatggggtttaagtacatttctaagagaggaaaattaagtcagaagcatggatttttttttttttyggttactacagtacatgtagtcatctgaatatgatttccaaggttcttgatactatcagataccaatattgattctacacataaaagcattaataggatggcactcatataataggttaaatgaaacaacaaaattaatagrataggactaccactgaatatttaagggaagaggaaaaacagaggtatgtctctctaaaggaaaatgccttctttaaaaagaatgaaaataaagaaaaattaatgcttctcctgaccctgaatctacattatgtatatttttcaaagccattttaaaaccttttatatagtgccaccttagctgctgcggtagaatcttgtacatttcacccggtgagtaaactgggaaccctgaccctcctttgtctcacagtgtaatctgatctactgtcatcatcaggggacatctgggatccatcttatctttcccactggatagttgattaaccagaaaatgttttgaattggattcatatatggcagaactccatggactttatgaattataatgggagcaaataaaaggtcagcttttatttttgtgcttttaaagaggagagctctgacacggttagaattgagtgcttaaaactcggggagagaaatgattatattaaatggctaaatacagtaattcgtgggatcatgttattatttcacagaaaatagacttttatagtgaggaagccttagcccagtaacatgacacagagctgtcaagccacaggtatatttagagtttattggaaataggcaggaaaccaagaaaaaaagtcttagattgctttctcttgctccatttctatttgatggcaattctggagatgtatgaggggctggatgtgggagtctgtagtcctgtgcatccctcccacactatattttttgccaggttcttgttagggaatggaatgcatttggtccatataactactagactttttgactattttaattgtctccatcaatgctttctatgagccaagttcagtgcaaaaatatattaatacatgtaagcatatttaaaccataattcatttgttttattctttattttaaatatgccaatttaaagtttattattcttaccactaggrtatgatgagagcagaaatcccacattatatatatttagtacattctacattcagtattccttaaagaaaactacctatcatggttaaaactgattacttgtggcatcaaaaagcatctctccaaaagctgatatttcaaagatgatgcccagaaaaagatggtaagtatttttcaaaacagttaggttatcagtttctaaatcttacttttaaaagagtcaggcacagtgactcacacctgtaattccagcacttagggaggcagaggtggaaggatagcatgagtccaagggttccagacctgtctgagcaacttcgagacttgcctggagaatgaagggcgagaccccattcgccacaaaaggaaaaaaaaaaaaagaccaaaaaaacccacaaaaggatcaggaagtataatggtttyatggaccaatttataattataaaccaaaacctttgtagatggtaaatctcyatacaaattatttttattagcatacttgtggaacaagaggctacaatgactacttgagtttccactcttgcagctggatgatcccagatgcattaggggttcaatggatgtcttaaactatgcttgaaatgttttgggttcaaacaaagaatgtttgccaaatccttcttccccttaatttttaaacatgtgtatttcaagggaaatttgattcatatgtttctgattcatttacacttaaatcatcaaaatgttatttttgtaaaagctatttgatgtccaagaagctttctgaacctgttttataagttttcttaagtcctttttcttaaaacaggaagttgcattttgccaagtacaaataaactcaaacactaaaaaggttcaagttcagtttycaactctgaactccaggtttaaatgcattctcaatttagcaaaatatattttcccacccctacaaaaatatgggtggaaggaaagacagtagtgataaaactgagtaaagatgctcataagcattattcttctcagacctatttctctagttgtgaaaccataaaacttgtaacaggtgttcctgaagccattagatacaggtgacttgcaaataagaacatctgtctgcatgttgagtctctaagatgtgtctaaatgtgtttactgtgtttgtcacagaaaacagaacctaaaggtcttaacattttaacttcattggtttacctttgactgcctttaggtcctatttttcttaggaaaggtggraagaaccaacacaatttattgaacagaggggaatcataggagactctgtagaggttttatgtctgtactaagatgatattgcattatcaatttaaaaacataattgacacttttatcagaattggaaacgtgcagaaaattttccctggttcatattaagaggtctcttaattatatcttctgctcattaaggcagaggcgattcagcctgacccttctaactgtttcacttgtatagaaaaaggaggcaaaggaaattttaagaggagtttggaaccatttcaaacaatttcctcaatgttctgctttattgtatttcagtataatgaagtactgtacccccagtacaatgtactctacttcttctgtacttgtactgagtaatcaagtgactcctgggatgataggtactatcaaacgaaaatactgtatttaaacattgctaaactgtcagttcaactttagacgctcccattcaatgaccaggaacttgtggatcatataaaggtaggtttattaaacatgctaagcaggagagagcagcaccttgacagagactctatcgtatctcaagtggggaaatttaaggaaggctacgtgtagagtttgggggcagttgttagttatagagttgttttagggcagaagttagtaagtgaggcctaggcagatattggtagaatttgtaaattaggcaagtggaagtcttatctttggaatgtgagttcattaagacaatattaaatcagtttctctgtgctctagaacatatggtctgaaaggagcttgtgttaaacatttaaagttgtttgtggccagttgcggtggctcatgcctataatcccagcactttgagaggccaaggcaggtggatcacctgaggtcaggagttcgagaccagcctggccaacatggcaaaaccctgtctctactaaaaatataaaaaaatgagctgggtgtgggggcacatgcctgtaatcccaactgctcagaaggctgaggtaggagaactgcttgaacccaggaggcggaggttgcagtgagccgagatcacgccactacactccacccggggagacagagcgagactccttgtcaaaaaaaaaaaaaataaagttaatttgtattgtatgtcatgatttgacacaatttacctgtgttgtaattcataatatagttttgctggttgtaggtagtttttgttttattttacaaaataaacgtgtaaacagcctgtatagcacacatatttatttatttatggatcttaaaaaatttaaactgcatcctattatctaaaaaattaataattggtaaattttattcatactcttttcagacaatattcaaaatgttaagccttgctgggtgcctgtgtatctgtacctatgttatatacattattcttttcctctgctactatggtttattcactctgagaacacataatactaacagtaaaatgtctttgacattttatattgtattttgaacaatttcatgttcatcctaaataaatatttgtttctaccccacattgcctagaaagaatttgtgctccctcaactaccagagcgttatatgctctttagtagtatcactaatgttttggaaaagagtcaaaattttcagtgctgttttagaatgcttatttaaaggtaaagagatttttcagagaaagaaaccttatataagagaactctcacaatgataatgtagtaacagggaactgctgaaggctacatggaaatcctttatttaaaacaaaaaattagaataaaagcctttctacagctggagagtcgacgacagtcttccatggtaaattttaatctgaaggcttgtagaataagataaacctatcaaaaagcccttccaagggatagrcaatatttgcctttttaaaattaaatcttacctgyttttactgagatttattattcattagataatggccattgttagccatagttttacattttaaattgccctttatgaaacttacatcaaaaagattcttattttccactgatctctaacaatataatttacaattcaaattgagagaatctcctcatactccatccctttgccttctgtggcctcattaaataatcatagtaatagctaccatctactcagtatattccttgtgcatatatttggccagcatgagttcgtgaacttctcacaacaaccttgagagctgtgcagagttattgcctctgttctaacacaagactaggcttccctgtgttagaatargggcaataactctgcactgcattgcagccacccacccatctaaggaggaagtccatgctctttccattctgccatgctgccttaagccaaagcaattcatatataaatggtttcatattttttgttccccatgtttaattctagatactatgcaacctaagtcctagacaaaaaattacaactccacaaaaactttttgaatgaaatttttataactttttactgctagttattcaaataaacaattgtcatagctctcaatatcagaactgaaagagacaaataatttcaactaatcctctgactttactaggttctacttatgaggaagtcaaaatgatagtacagtgtggaagaattcatgaaccaatagacaactttcaaaaaatgtatgtcccacctaatcagaatatctatttcaagccaattatttttccatttaaactcaatcagaaaatgtattttgaggtgattgctttatcagatttctacattttgcaagccaaataatcatataacctctaagatgatattataagttcyatctatcatgaccasgacatttgttttgctttctaagacctaagcagaccatatagctgctctggtttcatgtttgggggtatcctcctaacctttgtatgtcctttctctcttttttctccaggactgcccaccagaagcaggtgatttccgagctcagcaatgctcagctcataatgatgtcaagcaccatggccagttttatgaatggcttcctgtgtctaatgaccctgacaacccatgttcactcaagtgccaagccaaaggaacaaccctggttgttgaactagcacctaaggtcttagatggtacgcgttgctatacagaatctttggatatgtgcatcagtggtttatgccaagtaagtgctgatttgttctcattcaacttgtccagagggtttcaatgtctttgtgtaaatggtttacatagtctcactctctgaatcactcatctttacactttttagagtttgtaaatggtgaaagatttgaaaattaagstatgatttcagtgaaaagtaccaagtgttgtattgtgcraaggaaaagtagactagagttatttttctttccttgagtgtcacttgaatataaaagaataaaaatttttgaatagtgtttatcaattatgtactagactttgaaattatcccctggattggctattcctgaagtgtgtgtttgtgtttgtgtgtgtgtgtgtgtgtgtgtatttagagactggattttcattgactcagtttcagaataaatcaggtaagaccaattctaaaatccccaagtaaactstaggaaaacttgctactttactataatttccattgtattgaaaattcagacacactgtagagaaagtcatggaagagccagctaggttggacttaagccagttaaatctttmaaacaggattacaaaaaggtttgatttctggtatccatccattcatcaatgtctactctaggtagggaattagtaaggtgaaaaagrgtttgtatgtttgtcatgtctttgccatctttattttcaggtccactktttggattaggattaccagtctagtttttggagcaagcagttgctattgtttttctgtgtgctgtatttgactatatgcttttatatttcatgaagcagacacaaaattttgagagtatttgccttttccaacatggtgtcagctgaaattttctctcttcagaatctataatatcacggctaggaatgtaagagaaatatatgttttagtaatttgttgtttcaaatttatttttttaaaacttacatctatatttggatgtaaaggcaaaaactgtagtgtaaatgactataagagatgtgagatgtcaggcaaggttttatgcatgcaagagggaaacaaacatagtcaaccttcctaaagtttaaaatcatgaggcagagaaactgatgtcatataggagtttgtcactgatgaaacatatcttaaggtttccttatatacaagagatatatgaatttcaggtgtaaatttgaatgtggmattttactattttaaagctagaaagggccttagagttattcaatcaacattctaaaaagcaatatatctgaataaatcatttctgatctttgctatttacttcctcctctaggactcttagtggtaatgaaatggaattagggaatctgaaaaatctttaggaatagtagagaattgtaaagcaaatagatttagaaaggggactgtgttgtagggaatggcaaacaaaagaataatmactccctatgtaygtatactgtttgagtaaaagcaaggaagatttccattttagaagtgaaaaaactgaggascagaaaatatgcttgatctcctgaaagctgtatgtttggtcatgccagaaatgggactaaattccacatctcctgagatcccattcaatgttattgctactatattaccctgctgaatgaaccaaaataaacaagacagctcagcaaattaggtttcatttrtttcttttgcatgggagttcaacgtggcatattttttcctaaactaatcctgccagcaggcctcatggtaccttagcaactgaaagagaatcctatctcagttgctaaggaataaatttcatatataataaatatggagtgatagtactggactttgggttacaagtataaacatgctttaacttakrttcttatgagtatgacagatttgagagcaaatacggtataatttgtaaattataccgtatttgaaaagcattgtaacttatacgtagaaataatgactggttattattattattttcttcatttatttgtcttgttagaggcaatcatgtagtaaaggcgatggaaaaacaaagattgcatttaagcactaacaagaaatttagtttggctggagagccagataagacctagctatgcagtaagaatagggaggtagtttgggagagaaacatggaggcttgaacggcagacaggactgtggtaaaccatggatgaccatagtctcaccttgatagaaaatgacagcatagctatagaaatttgtcattcatatgcactaatttatttcaagtatacctgtttaatactcttcaaagagccacattctcaagactggttctttaactcttaaatagaatcacagagtcctggactttttagagccagaagatagcttagcaactcacagttattgccgtttcatagaagaggaaactgagacctggagactgtcctgagatcacgaataatttgggtggcatgtgtttgttgtaaatttcttcaggaaagttctagaatcattgctatttataatatatacctaattcttactcagtagtaatagagcatcatacgaggtagtagtagtaatgataatagcttccatttttgagtgactaccgtatctaggtactttatttttttttcaaatatttacagttctgcatgttagacatcattatccttatttcacagatgaggaaactggaggctcaggtcgattttatatcttgcccagagacwcccagctctgtctgagttcaaaactcctattctttccagcgaggccaggtatacagaggcgcagaccatttggtaatggtccccagatttggctgcctatcagaatcacctggagagctcttaaaagacacaactcttaagacctgtcttccagaaattcagatttattaattctatgtattgaaaacacttttcttatgattctatcatggccagattcacttacagattggaaagcagacagaatttaaagtcaaaagacatgagttggggccaggcacggtgtctcatgcctgtaatctgggcattttggtaggctgaggagggcggatcactcgaggtccrgagtttgagacctgcctggccaacacggcgaaaccctgtctgtactaaaaatacaaaaattagccaggcgtgatggcaggtgctygtattcgcagctatttgggaggctgaggcaggacaatggcttaaacctgggaggcagaggttgcagtgagccgagattgcaccactgtactccagcctgggtgacagagcaagactccatctctaaataaataaatacaacatgagtttgaatctagctcctctttaacgagctgtgtaatcttggtcaagatacgcaacgtccctaagctccatttttcaatctgtggaaaatgaattgtctcctagaccatagtgtaccaaagtgagaaaatatatgtgaaaatgtttaataaactgtaaagtgctgtagaaatgtagaagactctgaaaattttaagttgaaaaatatattaaactagtggttccctgtataagattttataactgtaacgtttcaaaaaacttcccaggatgtgacaagtaacaaacttcttaattggttaggtaatgactttaaaaaaaacaaaaagagaccttctaccatgtactatccccatcatcatttcacaattgaaacgttcatcacaaggaagtagtaagaacccagtttcagaataaaggacaattctttgaactggagatagtttgtcttatgagaaagttactgccctttacttttctcttttttttttttttttccagagcacagaaattgtcactaatagcacttcacagcccagcgtttgaaagcagggcctttgagatgatctagtccagccccagcaaatcattgtatgattttcccaggatcctatggctagttaatgacagactagaaggcagagagtgctggtgtttatcaacattttctaattatgctccttacattatttcttcagtttatcccatgagctgagattttgtctagctgyaattctgtcattaatattatgaaaacaataggtttaatgaatataccttttcaaaccacattctccccctttctctccctctctccctcctagattctgacaatcatccccagtgggtgattgtgttatccctcttcaccctgcatctcagactgagaaacactgggattcttatttgctcactatcattctagactagatgaagttagagagaaggctgagctagggaggcaatttgtcattgtatgaatagttaaagacaagaggctctggaatcataccatctaggttggaatctaagctccaccactcattggcatgtgcctttgagcaagttcctaagcctcagttttgtcatctgcaaaatgaggataataattgtaaaaataggattagaaggaagattaagtaatcaagtgcatttaaagtgcttactatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtcatgttgcggcattattcacaatagcaaagacttggaaccaacccaaatgtccaacaatgatagactggattaagaaaatgtggcacatatacaccatggaatactatgcagccgtaaaaaatgatgagttcatgtcctttgtagggacatggatgaaattggaaaccatcattctcagtaaactatcgcaagaacaaaaaaccaaacgccgcatattctcactcataggtgggaattgaacaatgagatcacatggacacaggaaggggaatatcacacgctggggactgtggtggggaggggggaggggggagggatagcattgggagatatacctaatgctagatgacgagttagtgggtgcagcrcaccagcatggcacatgtatacatatgtaactaacctgcacaatgtgcacatgtaccctaaaacttaaagtataattaaaaaataaataaataaaaaaaataaagtgcttactatgagcttgataaatactacttgtattaattgtacccaagttatgtcttatctttttctttttcttccttagagcctttctgagtacatgatttaatatgggtacacatacgaaaggggcactgacttcccaatgaatgagcagaccttctgttaatttcctattgcagtcatcttttgcagatagctccacattgtacaattatcaactcctgatccagggcagtgaattgcatcctgtacagagttaatgagccatcacaaataggatcagttctattagtactgctgttattcatttattttcattatccaaattacccctatttatatttgttgtaaagcacaaagccggtttctgttttaaatatattttttraaagagtagcataaatgtatggacagaacatgtgctgctgttaaaaataattttgaggttattttgaaagcaaatagagaaaagtatgttttatttttgtaattaatagaattcatcagatgatacctgatatatgtcaaaagaaaaagtatgattataaacaagccttttatcatgaatctgcatatttataatattgcttattgctatttcaaaaaattaagcatttcaaaaagggaaagaagaattcctttcaagtaatgccttatataatattgttttaaaatgaataatacagtacagaaataagcaataaaatgaatcacagagttttgatgtctttattctggcaacatcaaaatgaaccatatttctaacaaagaaattcttttcatttttaataattcctgtggtgagtagtttgaaatgaattgaatagaatgattatttctccatctctgtctgtgacctaagtcactagtatcaaatgtccaccagttattccaaaggtgatgatgtcagaaataaggcgttggacattttttcttctgtactttataatctaattccacatggaagcatggtttttcttaaaatatttaatgcatagtctttcttattctgctcttttcatagcatagtaaagataaaactaactactacttactagttgaatttccttagtttctgaatcttgtttatgcattcttccaacaatctgctgtatgttgattattgaggatataaaattgattaagatctctttccataggagtgatacatttttagagttattgtgaaaaacttttaaaaatatatttgtctaacaaattttacttaggaattaacagtatgctaaatactgaaaatacattaatggacaagaaggatagtccctgcccttccagaattttcactgtgagaggagataagtaaatatgaaagtgtactatagtcactatactatactgccctcactgtaaatggggacctcttkctaaaatacagatttggtttcatttatcatctgcttgaatcatttcaattgcattttttttttgccttcaggttaaaaaaatcccaaattcctttacatggtggcttaaaacaacagaaatttattctcccacagttcatgaggccagaattcaaaaatcaaagtgtcatcagaaccatgctttctctgaggctctgggtggaatcctttgcctcttttgcctcttcctaacttctaatagtagccatcaatctttactatttcttaacttgcagctgcatcactctaatctctgcctctgttatcaaatggcattctaccctctgtgtctgtgtcttcacctcttcttataaggacagcaatcatattaaattgagcccaccctaacggattatgaattcatctcaatttggttacatctgcaaagattctatttcctaaaaaggtcacatttataggcatcagaggttttgactttagcttatcttttgggggagacacaattcaacccatgacagccagctgtctggctcccaaatttacatccttcacatgtgacaaatattcacctgatcccaatatcccaaaagttttaacccatttcagagtcaactgtaactctaaaatattatcaactcagaaagtkccaaattctatcagctgaatcagctatgggtgagacttggatatagtgcatcctgggacatcatttgtctccatctgtgcacatttgaaaccaaaaataagttatctgcttccaaaatacaatggtgggacaagcagaagcagattcccattcccactcaaaaagggaaaaacaccaaagaaaaagggatcataggtcctaagcatgtctgataccgagcaggaaaaaaatccactagatttcaaggcctgagaataatccttgtggctcagtgcttcaatctatgtgcctgccaaggaggcagcccttccctctcagctcaaggaggtagagtcagcccaggcttctgcatctgtgcctcagacctaagagtcattcttctttcactttgtcccatctctgagacatttattctaggctgtcagtatttctgctggyatgaaattctcagaaatcacgtcagtctttcttgcaattaacaggtatccaagccatcaaacaagggggtcctctrcagttcttttctgaataactgcatctctattcctggcttctgctaagatgtttgagggattcatgggtcacatgcctaatttctttagcaaatggttatctagccataaccttggccctgttaccagagcacactacctaaataagctgaaaatgtttcaaataatcaaatgctagtacctttttgtttaacagttcatctctcagtttatctcttggctctcacattttactataagtaccaaggagaaaccaggctgtagtcatccatactgtgtttggaagtctactcagctaagtacgtaagtttattgtttgatatggtttggctgtgttctgacccaaatctcaccttgaactggaactcctgcaattcccacatgttgtgggaggaacccggtgggaggcgattgaattatgagagcagatctttcctggtctcttctcatgatagtgaatgagtctcatgagatctgatggttttgaaaagggaagtttcaggctgggtgcagtggctcacacctgtaatcccagcactttgggaggctgaggtgggtggatcatgaggtcaggagattgagaccatcctggctaacatggtgaaaccccatctctacttaaaaatacaaaatattagccaggtgtggtagagggcacctgtagtcccagcttctctggaggctgaagcaggagaattgcttgaaccagggaggcggaggttgcagtgagccaagattgcaccactgcactccagcctgggcgacacaacgagactccatctcaaaataaaataaaataaataaaataaaataaaataaaataaaaataaaataaaataaaataaaaaggggagtttccctgcacaagctctcttctgttgtctgctgccatgtgagacatggctatcaccttctgcaatgattgtgaggctgccccagccacatgaaactgtaagtctaataaacctctttcttttgtaaattgctcggtcttgggtatgtttataagcagcgtgaaaatgggctaatacagtaaattggtaccagtagaggagggtgctgctgaaaagatacctgaaaatatggaagcaactttggaactgggtaacaggcaggaggaaaaagtggtttcgtgggccgggcccaggatccccatgctgtgtgcaccctagggacttggtgccctgcatcccagctgctccagccatggctgaaaggggtcaaggtagrgctcgggccgtagcttcagagggtgcaagccccataccttagcagcttccatgtggtgttgagcctgtgagtgcacagaagtcaagaattaaggtttgggaacctccacctagatttcagaagatgtatggaaatacctgaatgcccagtcagaagtttgccacaggggtggggctgtcatggagaacctctgctagggcagtgcagaagggaaatgtgaggtcggagcctccacacagagtgcctactggaacaccwcckaggaaagctgtgagacaagggccaccatcctccagacgcagaatggtagatccactgacagcttgcactgtgtgcctggataagctgcagtcactcaacaccagccagtaaaagcagccgggaaggaggctgtrccctgcagagccaccaggacggagctacccaagaccgtggggacccacctcttgcatcagagtgatccagatatgagacaggagtcaaaggaaatcactttggggctttaagatttgactsccctggtggattttggacttgagtagggcctgtagtccctttgttttggccaatttctcccatttggaatggctgtatttaccaaatgcctgtatccccattgtgtccggaaataactaacgtgcttttgattttacaggctcataggcggaagggacttgctttgtctcagatgagacgatggactgtgggcttttgagttaatgctgaaatgagttaagactttgggggactgttgagaaggatgattgtawtttgcaatatgagaaggggatgaggtttgggaggggctagagtggaatgatgtgttttggctgtgtccccaccctaatcttaccttgaattgtaactcccacaattcccacgtgttgtgggaggatcccattgggaggtgattgaattatgggtgcaggtctttcctgcgctgttctcgtggtagtgaatgagtctcacgatatctgatggttttaaaaagaggagtttctctgcacaagctctcttcttttgtctgccaccatgtgagatgtccctgtcaccttctgccatgattgtgaggccccccccagccacatggaactgtaagtccaataaacctctttcttttgtaaattgctcagtctcaggtatgtctttatcagcagcatggaaacagactaatacatcgctgaaagttctactttccactcaatggcagaaaatgacacagccaagttctctgccactgtataacaggactcatctttcttccagtatccaattaaatgttcatcatctctttctaaggcctcaccagagttacctttaacatctatgataattaattttaggtgtcaacttgaccagatttagggatgcctagatagctgctgaagcattgttaccaggtgtgtctgtgagggtatttttggaggagattgccttgtgaatcagtggactgagttgggaaaatttactcagtattggtgggcaccatccaattgactaggggcctgaaagaaaaaaaagatggatccatggatgatgtagcaagaaggtcctcaccaaatgccggcacctggatcatgaatttcccagtctccagaattgtgaggaaataaatttccatttattataacttactcagtctcaggtattttgttataacagcacaaatatactttggtaacatctatatttctatcaactgtctcttcgatctaggtttttttctatgaagcacctcaaaattcatccaagctctacccattatccaattccaaagccggaaagtgacacttcatagaaattcatttatttcgtaatattttatttttgtcaccgtagctgggtcttttgtgtattcaagtattatttttattcatggaagggattcttctgatatattaacattgttttccatcttgctattccatttatgaagtgaaagagtttctatggcttaataaaaaaactttttggaaagttytatctgtttaatttttcctttgaaattaagtgtaagcttcacaaaaattgatgagtttgttttcccaaagagattcagtgaagtaaacaaggcagagcaaatctaaaatagaaaacattttcaaattttattatttttagtgatgtatagtttttttaatatactcatgcscatcattatgtgcttcttctgccaattctgtgggataactttatttccattttataaatgaggaaattgaggctcatagaaagtcatacaactggaaaaaggcaaagtacacttcaaattatattatttctattatatgacacccttttctgtgagaccagcaccatcctgataccaaaacctggcagagagagacacaacaaaaaaagaaaacttcagatcaatatccttgatgaatattgatgcaaagatcctcaacaaaatactggmaaacccaatttagcatcacttcaaaaagctaatttagcatgagcaactaggctttatcccagagatgcaaggttgattcaatgtatgcaagtcaataaatgttattcatcacataaatagaactaaagacaatagtcccagatgcaggaaaatactttttataaaattcaacatctcttcttgttaaaaatttaataaactagatattgaaggaaaataccctaaaacaataagagtcatctatgacaagcccacagccaacattatactgaatgagcaaaagccagaaaattcccttttaaaaccaacacaagacaaagatgccttctctcaccactcctattcaacatcatattggaagtgctggccagagcaatcaggcaagagaaaaagataaaaagcatscaaataggaagaaaggaagtcacactatctctgtttgcagacaacatgattctctgtctagaaaaccacatgggctcaacccaaaagctccttaaaccaataaacaacttcagcaaagtctcaggatataaaatcattgtacaaaaatcattagcattcctgtacaccaacaacagccaagctgaaagccaaatcaggaatgcaattccatttataattcccacaaaaagaataaaatatctaagaatacagctaatcaattagagaggtgagaactttctacaataataattacaaaccattgctcaaaaaaatcagagataacacaaacaaatgaaaaaacattccatgctcatggataggaagaatcagtatcattgaaatagccatactgcctaaagcaatttacagattcaatgttattcctatcaaactaccaatgacattcttcacagaactagaaaaaaaactattttaaaattcatatggaattttaaaaagagccccatagtcaaggcaatcctagacaaaaagaacaaaactgaatgcatcacattrcctgacttcaaactatagtacaggactacagtgaccaaaacagcatggtactggttcaagaacagacacatagaccaatggaacagaatagagagcccagaaataaggccacacacctatgaccgtctgatctttgacaaagatgacaaacacaaccaatgaggaaaggactccctattcaataaatggtgctgggataactggctagccatatgcagaagactgraactggaccccttccttatatcatagacaaaaattaactcaagtagattaaagacttaaatgtaaaactaaatactattaaaaaaaaactgtggaagacaacgtaggcaataccattctggacataggaactggcaaatatttcgtggcaaagatgccgaaagcaattcaacaaaagcaaacattgacaaatgaaatctaattaaactaaagagcttctgcacagcaaaagaaactatcaacagagtaaacagataaccctacagaatgggtgaaaatatttgcaaactatgcaactgamaaacgtctattatccagcatgtataaggaacttamacaagtttataaaacaaaccaccccaagaaaccccattaaaaagtgagtaaagggcatgaacaggcacatttcaaaagatgacatacatgcagccaacaagcatataaaaaaagctcaatatcattgatcattagagaaatacaaatcaaaaccacagtgagatacatggtatacaaggtgtgaagaccaaatcagagttactggggtatctatcacctcaaacatttaccttttctttgtatggggagcattacaattcttcttttctagctatttggaaatatacaataacttattgtcactataattttccccactgtactgtcaaataccagaacttattccttctatctgtgtttgtatactcagtaaccaacttctctttattgttcccctcctgcttcccttaccagcctctggtaaataccatactgctttctatctcaaacagatccactttttagctcccacatatgagtgagaacatgcaatatttgtctttctgtgcctggtttatttcacttaatgacctccagttccatccatattgctgcaaatgacagsatttcattttttatgactgaataatattccattgtgtatatataccatgtgtcataaccatttattaattgatgaacacttaggttgattatatatcttgacttgtgaatagtgctggaataaacatgggaatgcaggtatctctttgatgtagtgatttcctttcatttggatatataaccagtagtgaggttgctggatcatatagtagttctagttttagttttttgaggatcctccatactgttttctataatgagtgtactacttcacattcccaccaacagtgtgcaagtgtttctcttactttgcatcctcaccagcatttgctatttttgtccttttartaatagccactctgaggcgaaatgatacattattgtggttttgattcgcatttccctgatgatttgtaatgttgagcatttttttacatgcctgtcagctctttgtgtgtcttccttcaacaaatatctattcaggtcttttgtccattttttatcagaaattttttttctttgctcttgagttgagctccttatatactctggttattaactccttgccagatggatagtttgcaaatcttttctcccgttctgtaagttggcttttccctttttgttttctttgctgtgcagaagtttttagcttaatgtaatctatgtgtctgtttttgcttttgttttctgtgcttttgagatcttatccaaaaamtctttgcccagatccttgttgtggagcatttccctaatcttttcttctagtaattttacaatttcaagtcttacatttaagtctttaatcaatattgggttaattttatatttactaaaaaatggggctctaattttattcttctgcatattgatatccagttttcccagaaccacttattgaagagactattccttccccagtgcatattcttgggatctttgttgaaaatgggttggctgttggtgcatggatttatttctgggttctctattctgttccattggtgtatctgtctgtttttatgccagtaccatgctgttggggttactatagctttgtgccatatatatacatatacatatatatatatatatatacatatatatacacattttttttttgagacagagtctcactctgtcacccaggctgtagtgtagtggtgcaatcttggatcactgcaacctccaccccttagtatctgggattacaggtgtccactaccatgactggctaatttttgtatttttagtagagatggggttttgccatgttggccaggctggcctcgaactcctgacctcaggtgatctgcccaccttggcctcccaaagtgctgggattacaggcatgagttgccacacctggtcttgttaacaatattaattcttctaatccatcaacatggaatagctttccatttttttggtggcctcttcaatttctgtcatcaatgttttagttttacttatacrgatctctcacttctttggttaaatttattctaaggtattttttctttagtagctattttaaatgggattgctttcttgatttatttttcaaattgatcactgttaatatataaaaacactatggatttttgtatgttgattttgcatcctgtgattttattaaatttgttcacaagttataagagttttgggggaaaattctggggtttttctaactataagattatgtcatctgcaaacaaggataatttgacttcttcctttacaatttagatgcccttaatttttttcttttgactaattgctctggctaagatttccagtactgtttaataaaagtgatgaaactgagcatccttgtctcatttcaggttttagtggaaaggctttcagttttttctgttcagtatgttagctgtgtgcttgtcatttatgacctttgtcatgtagaggtaatttccttctatacccaatttgttgagggtttttgtcatctacagatgttgaattttatgaaatgtcttttcagcgtctattgaaatgatcatatcattttcattcttgattttgttcatgtactgtatcattattaatttgtaaatgttgatcatccttgcatccctggaattattccctcttaatcatggtgaatggtctttttaatgtattgttgaattctgtttgctagtattttgtggagtatttttccacatacgttcatgaaggagcttggcctgtagttttctttttggttatgtctttgtctggttttggtattagggtaatgttggcctcattggataagtttgaaagttttctctcctctttgattgtttttttaaatgtttggtagaattcagcagtgaagtcattgggtcctgggtgtgactttgatggaagaccatttattacttgtttgatctctttattcatcattgatctgttcagttttctgttttctcctgatatgttgaatgtgtcaaggagtttatccatttctaggttttccaatttattggtatataattgtttataatagtctaatgatcacttatatttctatggtgtcacctgtaatgtttcctttttcatctctgattttaattatttgagtcttctctatttttttctttgttagcctaactaatggtttgttgatgttgtttatcttttcaaaaactcaacttttcgttttgttgaccttttgtattagtttttagtctcaatttcatttatttctgctcacatcttcagtatttattttctgctactaatttagggtttagtttgttcttttttttctaattccttgagatgcatcattaggttgtttatttagattatttatattgttttgatataagcatttattgctataaatgtccatcttagtatcactcttcctgtatcccatagtttttggtacattgtacttccgttttcatgtttctcaagaatttttaaaaattccttctttatgtattgactcagtaagcattcaggagcatatttaatttccatgtayttgtatagtttccaaagttcgtctatatttgtatagttttgaaagttattgatttctagttttatttcattgtggtcaaaaaagatacttgatataatttgaataattttgaattttttaagatttgttgtgtgtcctaatatatggyttattctggaaaatgttccatgtgttgataggaaaagtatgtattctgtagcagttggatgaaatattctgtaaatgtctgttacaccatttggyctagaatatagtttaaccctgatgcttttttgttaaatttctgtctggatgatctgtccattgctaaaagtggggtgccctactatttttgtattgccatctatctctccttttagatctgttaaaatttgctttatatatttggatgtgctagtgttgggtgcatatatatttactattgttacatcctcttgctgaattaactcttttatcattatataatgacctttgtctctttttacagtttttgacttaaagtctcttttatatgatgtaagttgagctacttctgctcttttttggtttctatttgcatggagtatcttttcccatcccttcactttcagtttgtgtgcccttataggtgaagtgagcttcttgtttacagcgtatagttggrccttattatttattccattcagccactctttatcttttaattgaagaatttagcccatttacatttaatgttattatcgataagtaaggacttcttattgccatttggttagttgttttcttgtgattttgtaacctctctcttccttttttactgtctttctttgtgcctaagtgatttttctctaatattaggttggtgcaaaagttattgtggttttggaccataaattttaaatcactgtaactaggctcaaacacatctttattaaccaraataggagccattacaatcagtacattttggccaatgagaaataagtttgtttattcctgtagcataaaaattcatgcttcaggatttgactaactsttggaaagcattttctgcatcctgctggttgtggaggcattttccctgcaaaaagttatcgagatgcttgaagaagtggtaagcagttggcaagagttcaggtgagtatggcagatgaggcaaaacttatagcccaattcattgacttttgaagtgttggttgtgcaatatgcagtcaggcattgtcatgaagaaaaattgggccctttctgttaaccaatgccggctgcaggtgttgcagttttcagtgcwtctcattgatttgctaagcatacttctttgagataatggtttcaccaggattcagaaagctgtagtggatcagattggcagcaaaacaccagacagtgagcatgacctttttttttggtgcaagtttggttttggggagtgctttggatcatctcttggtcaaaccactgagctgttcttcattgcttgtcatataaaatccatttttcatcacacatcacaatccaatcaagaaatggttccttgttgtcgcacagaataagagaagatgacatttcaaaattatgatattttttctgatcrgctcatgaggtacccacttatcaagctttatcatctttccaatttgcttcaaatgctgaatgtccacagattggttgccattgagttattttgcaacttctcatgtagttgtaagaggatcagcttcgatgattgctctcagttggttgttgtcaactttcgatggccgaccattatgctcctcatcttcaagcctccttgactcctttgcaaaacttctcagtaccatgctattttcgttactatatctctgtagtaaaatttgaagtcagataatgtgattcctcagttttgttctttttgctcaggatagctttggctattctgggtcttttgtggttccatgtacatcttargattgttttttctatttctgtgaagaatgtctttggtattttgacagagattgcaatgaatctgtagattgttttgaatagtatagacattttaacaatattgattcttccaatccatgaacatggaatcttttttcattttttggtgtactgttcagtttctttcatcagtgttttacagttttcatcatagagatatttcacttctctggttaatacctaggtattttattttatttgtagctattgtaaatgagattactttcttgatatctttttcagattgttcatttttggcatatagaaatgctgctgatttttatacattaattttgtatctggcaactttgctgaatttgtttaacagttctaatagttttcttgtgggtctttaggtttttccaaatataagattatataatctgcaaacaaggataatttgacttctttctttccaatttggaaaccctttatttcttgcagcagtttgatttctctagctaggacttccagtagtatgttaaataacatgttggaagtggacatccttgttgtgtttcatatattaaaggaaagctttcagtttttccccattcaattttatttgtcttctctaagaaactatttttgtttccttgatcttttatattgttttcctcatttcaatttcatttatttctgctctgatctttatttttttacatctactaatttgtgtttggtttgctcttatttttctagttctttaagatgtactgttaaattgtttatttgaaatttttcctcttttttgatgtaggtgcttataggtataaacttccctcttagtactgcttatactgtatcccatatattttgttatgtcatgttttcattatctataatttgtttcaagaggtttttcaattttcttcttaatgtattcattcacccactggtcattcaggagcatattgtttaatttccatgtgtttgtatagtttccaaaattcctcttgttattaatttctagttttattccattgtgttcagagaagatgcttaatattatttcaggtttttttttaatgttatgagatttgttttgttacctaacatatgggctgtccttgagaatgatccatgtgctaaggaaattatgtgtattctgcagccactgaatgaaatgttctataaatatctattagatccattttgtctttagtacagattaagtccagtgtttctttgtagattttctttttaccatttcttgtagatggttttgtttggtaatgataaattccctctgtgttttttgtttttttgttgttttgagttttgagggttgtccttttggtttatttttagtctggaaaagtctttagttctctttcatttctgaaggatatttttacagggtacaatctttttgttgacatttttttttccttcagcgttctgagcgtattttcccactccttcctggcctgtagggtttctaagaagtctccttccagttgtatttgatctcctttataagttatttacttcttttctctttctgctttcaggattcttttcttttacctttgtgaatttaattatatctgattggtgacttttgactttcctgtatctggatacttataactgtcttcagatttggacatttttctgttactacttttttgaatattgtctctacacctttctttctcagttccctctttaacaccagtaactcaaatatttgctttttgatgtcctgtagatcccataaactttgttcattccttttcattctttcttttctgactgtatattttcaaagagtctgtcttcaagtgcactgattgtttcttctgtttgattaatccagctgtttatgctctctcttacatttttcactttattcattatatgtttcagctccaaggttgatttttaaaaattattttaatttctctatttaatttctctgataaatttttgaatgaactctctgtctcttgaatttcactgatcatccttaaaacagctattttgagttatttgtctgagaggtcacacctctccatccctttagggttgatctctggcgtcttgtctgtttggtgcagccatattttcctgaatgttcttggtgcttgtgaaagagcaayaatgtctgtgcattgaggaattaggtaattattttattcttcaaagggtggttttctttgtgcttgtccttcttcagagggccttccagggattctaagctgactgactatggtgttccctgagtcattcacaggtgaagatgtctcagcactagaggatgttccaagccctatcttgcccacaagtctcacaaatgctcagaagttgatgtggccatctgtcccagatggatctggggaagatccaaggagagtaatagggctatgtgggaatgctggccaaggaactgagtgcagaagactatccttttggcccaagagagggatccttgcctgtaggcctctgcccaggtaggatgggtcccttactgcagtgaaaggggctggagttgagattgagcatttggggatcttctgtgagaaggaggctggtggtctgtcttattggatcagatggacatgcatcacccagcaggtccctgcacagacgggagagttcctcaactgcagcaggagaggctggagctgagactgggcccccttgagatctgctatgggatagaggctggagagcctggtcttagctcagaaaagtaagttcctgcacaggtaggatggttctcctactgcagtgaaagggccagggctgagactggacttcttggaatctgctktgggacagaagtagatgagcctgtcagggaggctcagactgccaggcttgacgtatggacaagtctccctctaagctgggatcttagctgaggaaggctggaatagtgccccagggcaaatttcgggtccactgccaaggccaatgtcagcaagctgatgagcctttctaccaaggcagtagtgtacacagttctttctggaccccttggcagatgattttggttgtaggcttaaggccaaatgcggctgtagccaagccccttcagggactgggctgtttctgggcttgaaccmagaagcaagtttggcagagcagatctgtcagctgggtattggtctgcactctcaaaatgaccctcctaggtcatgggctctgctaggctttcacagactcctatctgaattccaaggctcaaacagagagactttttactgtggataggtgcagaattgttgttgtgggggaatatgagcaggttacctcctattctgctatcttggtgacatcatccccacagaagacagttttgaaactgaaagggaatttgaaattttgtagtttaatrtttccatttacatttaagatatctgaagcctaagtgggttcaatcaatttttaaaaaagttctgccgtgtgggtctgaattaggttcaatggggacatgaacgtaagtgttataccatcatgtctttaagaagcttataattgtgtagtgatgagattcaaacaaaaataactataatcagcagtacgtggtgtgggctttaattttgtatccawtcagatacaaatttgaagtccagcttctgatcttactatctgtgtgatcatggactaatttactaggttcttttagcttcaattttttcatctgtacaaacagaggtaacaatatctaattttaatgaaagccaatatttatttatttattgggcactgagcactgacatggtgcctcagcctcctgagtagctgggattacaggtgcgcaccaccacacctgtaagacaccgtgctatgtaagcatatgccaggcactgtgctatgtgaacatttcacatatgttaccacctttaatccttgtgtgaacctatgtgaggtgatattgttacaattttatagaggaggaaaatgaggttatgasagattttgtattgttgatttattcattcaacagatttttaytgagcatctactaatgctagacattatgctaaaataccagaaatgcaactatgagtacaggatgcaatgggaacatacagaagaagtgaaacactgtaattcagttttgaagacgtagacaaggctctaaggtccagctctagggtcactttctttctcaggaactcatgtaagtccttcagcaaaactcctaggggaattaatattcattttcttctcttagcacctgtttccttcttctttcttttgtcttatattaaatttcatgaccatatagccaattagattgagaacttcttactaggagagaccacatattactcatctttagtttctttatattatgttgctcaatatgactgccacagcatggatggagcaacgagtcaataaatctctctgttggctatttttgtctcttgatgaccaagccctccctaaaacacataaattattcatcttaaatgtcttttttatcttttartatatttgtgccttgctctcatttccttcaggctgtgaaacagagcctgttgatgtgagctaaattttgctgtattctaggctaggagtaatttgtaatttgggatctgctgccatctactccttatttaccatggcttaggattaaattggataatcttcagtcatatttctaattatttcaaytctctctattattaatatgcttatcaagttgttgaccctaaaatactagtctttccaaaacttgaagtacaaggtttaaaagtatattaaaaatttgaaagatttgaaaccttgtccttggctttttgtttatttaagtcaaattaaaaataggcaaagtagaattcaggaagcctttttgagactgggtgtcttatgacacttcatgtaattgtttaaaaaatgttaaaaatcaaattcaaatgtgaaagacaattagtaattatacatgggctaactggcatacttccaaggaaatatcaagtgaggaaagggatgattttttttaatgttgtagctactttaattgtaaagatccttaatgaaaaaaatttaaagcatcaagtaccttccagattttgagcctttgaacataattgtacccaagttttagcacattcatggttgccaaagactcccttggaacaatcctaataagggctgctttccagagtcaggaaaatccacccaggccctaaaattagtataataaaccccacctgtcatctctattgcctctttggttagactgccctgaggagcccaaatcaagaaggaacaaagtgtttttgatgtggactgactgcttgtgatccaagagaacacttaagattctgaaaaatctagggagaatggcaagcaatgatctgtgtggttaatagaacaacaaggccaagacaaattcagagaccctggggatattttgaacctctctacaaagctaatcgcaaatcagtacctttgaaagggaccgtggagaaattatcagctgaatctccttattttgttttattttattttatatgaaacataaaatrtgaccagcatcagggcaggatgtgacttacccgaagtctctcaactagcaagtggcaaagccagaaacactcaaacctgggtcttctggctccaagtccactgctctttaatctgaatgaagtgagaatgctttttatgtgtgtttttaagaacctttaaacaaaaaatttaaagtactttatttggattatttattcatttttgttcrtctctttttatttggattattcatttttgtttgtcyctttcaccattwctaagtgcacttcagtccctgtgctaaatttccctcccttgtggccagatgatcacaggaacattccatttacttaaaagtagttgtattatttaaaaaaaaaatcaagtgggaaacttcaccaacaatgcaacattccaaaaacataatgctcatcatttccactcctgtagaaatgccgagtgcaaacccactgcacctgcacaccatagtgatctcagggtggccaagagctggtggctgactagtsctgtgtgagcatgggtttataaatgcacttgagtaccagtttagtttctttgccatcagcgttacaagtgatttaagtaacagatatttcagagaaagggacggggtgggctggggaggaaagcttgagaagaagcagccaaagtcacactcaaatgaaagaatatacccagtgttttgttttcccaagtttttgactatacttcatactgtcctctctgccccacaggttctcatggtgggggaggatttctgtctcctycctactcctgagggtgactgtcaacttctgaggcagaaatctcagtattagggttgattgacagaaagatttattaatttgttgatgcacccatccatgcaatagtcttttattgagccacatgatataatgtccgttcagcagtttccactcttggcttttttatttgacacaagttagggatgaaaggatttgttttttgaatagggtaacaaggatttgctttgcttgggtaaaaatacaatttggcttgttaaagaggcaaaggcacacttagtggtgaagcaagtccagctctcctggcacctgtcttttcctttctgaaggtgtgccttgggacaggcatgggcctcaattattgaaggggtgggtgcttaggaggaggtaggatcatcttgtcagtttagaggagcactgattctcctcatgcatgggtttctattttttaatctggagaaatatttttatgctcacttaaaacatgctctcttaggcagtgggtaggaagaatggttttgtcaaggctatttgggtttagcctcccattttcccagtagtagtctccaagtttctccctataattcaaagtatcattttttagttttctccctgagtttcgtggctctaaagcagaagttgcaaactagcaatgctccagccagatgcagcctatggataacttctgttctgcacccatcatgggcttctgtaaaaatttgaattagttgccagtatttgaatataattaaattatatttatataatttatttataactgtaatatttccagtaaaaatctggattcaaaacagatttttaatcctttaaaaatcagatctggctgggcgcggtggctcacgcctgtaatcccagcactttgggaggccgaggcgggcagatcagaaggtcaggaaatcgagatcatcctggctaacatggtgaaacctcgtctctactaaaaatacaaaaaaaaaaaaaaaaaaaaaaaattcggatctgcagcatttggtctgtactccaatacagcaaacatctgatagagctgaaatgacactgctgccttgagatgctgcatactctttggggcctctttcactcactgcacagcctggacctgtagctatctgcttctctgatgcttccccaaaggctatataggctaggtatttctaaggggaaggagaaagaactattgttatcatgatggtaatgataagaatagaaaaacgatcctcatatattaagctctaaccatgccagacactcccaagtacttaacatgctatttaaacctcagagaaccccatctactgcccaaaaagtctagttttcttgcccaaggtcatgtaacttgtgagtgactgaattaggatttgaactcagatctgtctgaccctatagcctgtgctttttattttactgtactgattcatagaattatacttccctcctagacaaccctccctgaattttaagcccctgagaatctatgactggataccaagaattggggtccctacttgccactggtttttgggtttctatgagaaacagtagaaaagagaagttctgattatcactggtggggctccttctgctttcatctcatctagctcaggatcagctctgggtgctaaggcatacagccattctcctgagtaaaaggaactctttggaaactttttctactaaatcaatttgatgccacattaaaggctttaaaaagaacatttgaggtaaagagcaactactcaaatttttaaaatctaaagaaacaaaaatataaactcttagcctgtacctatggttgtttcaaaagaaaaagaataaatttcttattcttggaactatacatctcatttacgttatttttctttcttcctgttgattccaacccccacatcatctttaaagcctactgcttttcaaatccagagtattgtcaatttcctattggtttccttcagcattattctccttcacttgtgtttcttttctttctratttctcaaaaccttaaactaactctctcagttttctctatctccttttgaaaactctgggaatacatttcctaataragtttccttctgtatactcagctccagaataggacaataagtgcccttcctggtgaaatacatatactctattttaggattcttttggttacaagcaatagaaatttagtctgctcaacctaagatcaaaaggatgaatcattgaaaggataaagattaatgacaagaacatcaactawgtatttagcaaaataagtattgggcaactagaaccaaacagaaagctcaaaggccaggcctcaagaagcacaagtgccagggcaactttgaggtcctcagctacaggtgtgcacagatctggcaaaaaataacttagctctaatcatattctgactctttctgtctccarccaattttcaaattcccagggaagagagtctggcctagtctaagtgtctctattactgaattaattagccatggccaggggatggagtgactaacacagtcatrgccastgaggatttcctagggatgctataagtgaccatgggcatagtgccaggtctgtaattatttttgtatatttatttctaaattagggatttggtctatatgaaaggtgattttattaaatatgtgtagcatatatcatacatcataaataatgtatagtataatgtagcacatatatacacatttatatattacattatacattataatatacattatatatagatgtaatgtagcatatmtatacatttccatagatattatatatatagtgtatattgaagtacatagcttctgatgtatagtaaaataatttgacagaaggttcttagaacttttaaaaatgacatttttattggttagagattcagtctgagaaatatctcatatcttttcctataacaggaaagaatttattaaggcaatagttttgtaaatctcattaaagttttaccatcttcgtgattgttagcaattgtaagcagggcaatgcagtacaggcttctgcataagaaatgtcttcctagttagtgaatggatgtgatttcactactgcctactgcctatgagaaggtagtcatatcttgagtcattcttctgctgcctttacaatgaattgcatcttttatgctttggtggatgtatttgttaggctgggagtgctcagaagttgataatgatagacaagccatggaaaacttctgtcttggttcatactaaaatctttttgcactaggacaaaacgaaacttctgctgcaaacatgagcctcctctcttctttagccaaaagttcaccagggttcaaacaatttcttaatggattccagcaagattytgtggggctataagaaatgtttctggtttgcagcgtagaggaatgtgtcttgcacagtaccagcactggaatcaggacccacctggattcaagccccagactgggcttctaatctggttctgattttggggggacttggcagcctgcctttattgttccagggtattgctgccattctttaattcagagctcacatctcacctcctccatcaacccttcccaggttgttgagaaatcagccccatctgtaccccaaatctagtacaagttccttttattctccctctcaaacaaatctgtcagacacagtcacttctcagttgtccatactgataaaggaatacatttctgtaggtaatctatgatatctagtctatggagactttttcttccctgtagaaaggtatctgacacatgaagttaagtaggtcggacaatgagaactggcaacactggaatgcccactgaagggactgtgtgtttgtgtgggtgagttttctctgaatttttgatacttactttctaaatactcccatttttcttccttagatcaataggcaacttctaagaggtaaaaaatgaggtaaatatttttacgtaaaatgagagctaagtttctgacttttgaagaacatcagaaaataatattttaaaacaccaactaacatccacttacttttgttcttcttcaacccctatggctgggtttgttgttgtaatcattaatagtaatggtaggtgttccatgattaaactctgagagctttctattcctttgttgaatccttataacaacaactcttggaggtatgattggtaccattttacaggtgaagaaaccaaggcctagaaagatgaggtgacttggaaaaagttatgcagctaataaatagcagaacttagattcagatttagatccatctgtctccaaagctatatgctatgctatgctatgctatgctatgctatgctatgctaygctagctatgctatgctatgctatgctatactgtgctatactgtactatgcagtattgttgggtccatatatgtcttgctcagtagaagaacagtgagtgcaaacacatggagttttgtccacatcttgttagaaagaggccataggaccagctggtatttagggcagaggcatcattccatacctcctcaacaaccaacccacatagcagatgtttacttttatttgtttctataatgacacagctctatgtattccttgtattagttgcttctgtgtctgttgcttttctgcctcctattctttttttattatagtaaaatgtaacatagattttaccatttgaacccttttaagtatatasttcagggacattaaatacattcacgttgttgtgccatctccaggactttttcatcttcccaaactgacactctatgcctattaaccaataactccctgttagaaataccaaaattgttagaaatagataattggtgccacaaagaaaagacagtacagagacaaaagatctctcagcaaggcaatctttactttctgcagaaagggtgctcagtcgcagatggaacaatggcgagagcacacctgaacaaaggaaaagcagrcatatttatccctatgcatttgggttgtccttactgctgtgtcctgcatccattggctggagctggacctcatattctgaaactgacacccaatttgctaacagcctaaaactttcctaaataggtaagtgcaaggaagaacaaagaatttgcttacaaaaggtttaaggargcaataacatttccaaataaggaaggggcataggctgcaagctggaacgtgcctgtgagcatgtccaacaattacatagggtagggcttaacaaagagttattagcacaaagcaaggaggcttgaggaaagttagtctttaaaagaaactattatttctaacacttatggtttactctttaacaagaaggaaaactttgaagaggaaactttcactttctatgctccccattttcccctcttcctracccccagtaatcaccatctattttctttctctatgaatttgactatttggggtgcctagtataatgaaatcatataatatttgtcctttttttgtctggtytattttacttaacctaaggtcttcaaggttcttctatgtcatagcaagtcataattacattcctttttagagctgaataatattttgttgtatgaatatataacattttatccatttggcatctatggacacttgggttgtttcccccttttggctattgtgaattatgctgctgtgaacataggcacacaagtgtatgttcaagtccttgtctgcaattcttgtaggtagataggcgcaaaagtagcattacagaatcacgtggtaattgcatgtttaatttttttaggaacrgccatactgttttctgcagggctgcaccattttacattcccaccagttctgcctcctactcatgcctactcttagtttatgaagccctctagagcatagctgctgcaacttttgagtcttttaccctttaacagctaggacaataccattcccataaagagtgttgattaaaagacatgctcactgtagtggagatcatgatactaaaattacttcagcttctccaggagatttacaaatgttcggccatggaactcctctcacttgtattcttccctaccttttttccctcttctgctcccaagctcagaaaataaccatgaaaatagtgagatgcctctctgcaggaaaaaaataaaagtgtaactgtgcctctttgcataccaatggggtatttcagagagtggcaacctgtttatctatgcagttgttgatttatgatcgccagtacatgtttggcaggctgaatccacatctgcaatttaaatgactgcttacaaaatgagccttttttccctaatatccaattaggaccaagcgctggcattgtagatgaaaaagcggttatgttgaaaacagttctaatcccaattgcaaaagaagttatcactggtggaactatcagaaaaacacttgcttcaggcatgcaatcttgacagtctacacattttaaggcaagagcatgtttgtactcagcaatgggttctgcactccaycttgggaaagaagaacagaaaagacagcctgcttttggtgtaggcccagagacagcatcaggcctcagatgagtttcccacgtaactcttcctatatccctcattttgtaactgcatcaccccggtactataatcttgaacacttttggtgctaaagctgccaattttcctgattttgtgtaattttttgaggttcacaaatagaaacaagtgtacaaatattcyattcacatgctttctaaatgtttttattttacctttgactgaaaggggtcaaagctgagtataaaggtgctttgatattggaacacactctccttgcgtcacgcttgacccaggctgggtggtggaagcagaggtaggtgctacttgtgtgaactgtgtgttcaagtcagcatgctctggaattgatagtgtgtcattctgggctttctacccctttctgacactgcgtggtacaaaccaaaagttcacattggggtcatgattgctggcttttggcagggcttggcgagaaggtctctgcagggttaggccgcccagatgcgagctgtttgggctgagttcagtttgtttccatttgctccctctccctcctcccctctcctcagtcatgccaactgctactggagatgtttttcctctgtttaaggtaataaccgagtcaatgctgaagccaagctataggcaagcattgaaaataaattttcaagggggttgttttcatattattaggaaaagccttggaatctttttgaaartttttgtttcctgagaaactgccctttgggaatatctttgttttttgagtgcctttagcttggtgctgagaaataaacttaggaaatatgattgagatgtagtgggctaggtttttaaacaaaatgctctaaacattccctcaaaaaccatttctctaaacagagcgctcgcatgagtagctgattagtacatgtggtgctgcctgacctcttgaggatacacactgtttgcttgaaagtcccctggtatattaggtgacctagtgtaataggaatgacattttttaaagagactaaatcccaattctgtcattttctagataggtgatataggcagttgctytggttttgtcacctgttcagttgcagagtttgttttacaggcttcaygaactctgtaaaacacctgacaggacttgatccacacaccgtacttcataaacaccacaattccttccccccmagttttcttatttattgcctcttctcggcctcaagtttggtaagtgagaaccatccrctgctgcagtctataatttcctaatgtaatttcccactcttcagaataattgtggctcacagtatttattttctcccttcctgccaactgagatacaacctccattcacttgccctaagacaaaaggttttgtggcttccagctgtgaagaccagatctcactgagacaaacaactgctgttatcttagggaaaaagacaaaccagccaacaatgagcaatccatgtaagccttgctcttaacacactcattaaaaagaattttgaaattgaggttggaaatcatctgacaactcaatgcctaaatgttgtggggagcatgttcataaaaattcttctagtaagaaatgtgttcatctcccctttgatatgtatcccagcctgtgattcactggaacatgcctgcacctacagaatatagttcaactttcgattgtaaaattttaatgttgaaaaacagcccgaagtctaggtcaacactctgccaagaattcacttgaaacaactgttgaaaaccataaaattcgtggtcaaatatgtttttctatcgaatatggcatttgatagacccactttgtagaatatggggacttttcaatttagattcacatagayatattgaaaagaacgcattgcatattttttttcaaatgactcaaaatttttttaattgacgctgtattatgcaatacatttgaaactataatctttggtgatgattccatgcagcattttcataatttcttttattattattattattattatgctttaagttttagggtacatgtgcacaacatgcaggtttgttacctatgtatacacgtgccatgttggtgtgctgcacccattaactcatcatttagcattaggtatatttcctaatgctatccctcccccctacccccaccccacaacagtccccagagtgcgatgttccccttcctgtgtccctgtgttctcattgttcagttcccacctatgagtgagaacatgcggtgttcggttttttgtcattgcgatagtttgccgagaatgttggtttccagcttcatccatgtccctacaaaggacatgaactcatcattttttatgactacatagtattccatggtgtatttgtgccacattttcttaatctagtctatcattgtcggacataaaccacttattgcaaattacatgcttttttatacataatacatgcagaagaaatgcaacgtgatgcaatatagccaaatttgattgtggtgtgaaccataaaaattggaaatgccttttcttcttttcccatggtccaccatgaagcagtaaggttagggtacagaagcaggtaatttgggtacttttaaggggatttgaagatagcatatacacttcctgtgttaaggtaattctttttaactagtttgggacaactgactaaacaccaataactattataaaactgtagtgtttaaaaaatttctgaacttaaatattccagttactacacgatttaatttcactctctaattagatatatgctgtgtgttgaattctgtcagatttggaatttatagtttcagctggatttaaactagactatagcaggaaagaaaaagaattcatttctatgcatgtgagtggggggttagtggaatcttaatctttctgaatggkaaratgtatgcagtcctttcttttcatctcagcgcctttgagtgaatttgcttttgtctaaaatgaaaggagaaacagctcatttttccattgtcataatagtgcagtgattcagcaaaatgtaactgattatcctgaacccacaaggctagagttagaaagagtagccaaattgctacctccagctacttccaactcagtcccatcactatatccagcagctcacctttcatctggctctggaaatttggggatcattaaaaatcagccagctcacttttctcttaggattttgtgactcctgtttgattggytcattgttaattctgattaataagaatttaaattcccaacttccagaagactacttttccttytaaaaagatcgtaactgatttgcttttggcttattcatttagattcagggattcttctccattaaaataaataaattttgaatatcccttatactaagatgggttgctgaatgcccactttctttcattacattcaactggcatattgatacattcatatgggcaggaactccaaaggagaaaaaaggagaaaacttgtcccagtccctgaaaatatgtctttcccagcaccttaggttttagaagaatgactatgagaaatctctattttgtgctgacagataaatttaatgatagttactcgattgtatatatttgaaagtggttcctgaattaactctgaaaaatcagtagtcctggagttggagagctaaggaaggatgttttcagaattctaaacatttctctttaatttgagtagaatgcagaggagatgatttgctactccacagcaatttcagaaaagyatttttcatttctaacagaaccctaccagaggtcatttcccaaagagccaaccatgcttgctggtattccattggctactttagcagggtagagggaagttaaaaaaaaaaaattatccaatggaactccatctgctctgacctctcaaggagagtatattccttcaatggaatttgagttgtgatcttacttcctatatgctgttgtcaaatccaaaggggctgaaatagatctgagcttttgcaaacttgaccctgtctccagagctgtgggacttggagtctacaggttcccagatccctaaggcaccctttatagcttcagatgcatttcacatatataatgagaaaatacctgctatttgcacagtgactacatatcccccccctaaaataatcaacacacagggtctgataattctggagactatgaaatagaagatttgaaaatagagttgtctcagaaattccaggatagtggtcagagttgttatgtgctaggcaatgaactggatctttttatataagctatcrcctcaaatccttagaacaagtatataaaataggttggattatataactcacaagagaactgaactcgtactgagagtgatatattcaagccatcacatccaggttgagttgttggttgcaccacaatgtcatgctgcctcttttgtggtttaggkttccacatcacatagattcttggtataaataatgatgttccagggtaagaagtggccagggaagtgaacatgtggatcaaaaactgagatgcagcactatggtctcgctggtcttaagtgtgacatttccagaggggtaaatatacctttagcaattgtaaagtttatggtagaactgggggtcatgtcatggctctatttgttctgtgacagagtaaaaattatattttcttagcagaagaaatttactatttcatccaaatattttgtgctatggctttttccgctgggaaagaatcttacattaacaacctttagtttctcaagctgatctgaaaattcgctgccttgtccatgcatttgagatacttttgagagacagaattttagagttactttacagatgatgcttttgcttaaactctgcttttgatcaattctctccaggctctaccctaaagagacccaatttagacagatagaaatggcagtagagaaccaggaaggaaaaagggttatatttgttaatattatcagttgaggatgtctttaacagactttgaaagcaggatatcgatagcactgtcaaagaagtttcaaattaatataaagtaataagttttgagaggtaaccaggtaagagccaaagaatgacacaagccctgctaacttggaaatctgagatgcataaacaattgtgatgggaggagaattgtttggggacatagataaatccctcttcacctttccttttccatcctctctaacgttgacacacaaatgcagccagcacactattgctgttggaatattgacttcagataacatatccagacatgtaaacaagagtttaattgtgtgtagaattttgtttaaattatggaccatatctggaatttaaaactctttaaatataaatttccagaaaaattttcggaggtacacgtgtgagttccagccatcatagtagaatagctactttgtggtgacttactgarcagacacattccagtaagatccacatttgtaccagggcagaataccagctgctatcctgtcttctcaacaaaggactcttgtgtttaaacaaaaactgtgtactgtatgcccagcagcagaagggagtctgagcagtgatgtcaaagtataccatgatgtcaccacaattcacaaagaattacagttaatgccatgtgaagtgaggccaaattcaacactttccctcttgggtacttcacagtctgagagamagaagcaaggccagaggtcaggcctttgtataattttgtttcgcattctccagacaccctaattttggaagcaggggagggagaagacagcctgctaaagarcagtccctgaccatctgctgagaatgaattgtagtgtctgtatgcacaaatgtctataccaggatagttcttaggatttttgctgaagactactaaagaaacaaatttcaccaaaaacaatacacaaaaaaatccagatgtgtttagcaaaaaatttatgtaagaatttgtccaagaccctgaagtaaataagacgagaacacaataaatcagactgggagcacctgaagagttttaataaaygttagaaatcagacttacttattctctttttccctttcagagtgtttatccagccattagatggtttagattcttgrcttcaagaaaggcaatataggaaaaaattatttaaaatgtttgccatcttagctcaaataataaaggacagaaatargactcttaaaaattagcacctggcaaaagtttattcctatgaaaccacgtcctcctctataatttaaccacagaggctgccgaagttcctaccctttggtggaggtgggagtgtgtaggttggatgcagaaagagtgtggctttgccccagccagaccaccagccaaagggtcggagctcacaaaaggtaaagggaagagccaggccagggggttgcccaagctgaagtctattaggaagagccaggaatcaggaactcagtagatcaagtacaaagtgaatctacagatccagagttggtgtcagagtcagggcatgaagcctggggcactgtgcctagcagraaagaagtcagagggaggtacacttggaaataatgagcatttatgccccaaggcaattctggagtagtgggtgaaggaccagagacatagcaggcaaggtgacaagtggaaattaaactctcagattacagtgttataaaatgatttgtccttagagatctttttcttttagagagtgttcttttggtctttggaaccagtggcagagagtttaaatggtaacagctgttatgttttagcttgagacaaaggggaaaattctttgaaatcgcaatatatccctgtcacttgtggtgttgcctataggctgaatccattcattcattgaacacatatattttagttgcttgctgtatgccaggcactgttctaggtggacagtgaacagggcatccaaatatcattgaaatacgcttaataaatatcaatggaacagaatagagaacccagaaataagactgcacacctacaactgtctggtctttgacaaaaacaagcaatggggaaagkattccttattcaataaatggttctgggataactgtctagccatatgcagaaaattgaaactggatcacttccttacaccacatgcaaaaattaattcacgatggattaaagacttaagtgtaaaacctaaaactataaaaatcctggaagacaatgtaggcaataccattctggacataggaactggcaaagatttcatgatgaagacgccaaaaccaacagaagcaaaaattgacaaatgggatctaattaagctaacaaacttctacayagygaaagaaactatcatcagagtgaacagacaacctacagaattggagaaaatatttgcaaactatgcatctgacaaaggtctaacatccagcatctataagaaattaaacaaatttataagaaaaaaacaatgccattaaaagatgggtaaaggacatgaacaggcacttctcaaaagaagacatttatgtgaccaaagagcatatggaaaaaaagctcaayatcactgatcattagagaaatgcaaaccaaaaccacaatgagatagcatttcacaccagtcagaatagctattattagaaggtcaaaaaataacagatgctggtaaggttgtggaaaaaaaggaacacttatacactgttggtgggagtgtaaattagttcaagcattgtggaagacaacatggcacttcctcaaagacctaaagacagaaatactatttggcccagtaatcccattcctgggtatatacccaaaggaatagaaattgttctgttataaaggcacatgcacatgtatgttcattgcagcactgttcacaatagcaaagacatggaatcaacctaaatgcccatcaatgatagactggataaaggaaatgtggtaaagaaacaccatggaatattatgcagccacaraaaagaatgagattatgtcctttgcagggacatgaatggagctggaggccattatccttaacaaactgacacaagaacaaaaacaaaaaacaaacaaacaaaaacaaatactgcatgttatcacttataagtgggggtaaatgacaagaacacatgaagacaaaaaggggaacaacagacactggtgcctacttaagggtgaagggtgagaggagggacaggatcagaaaaaaactattgggtactaggcttagtacctgggcartgaagtaatctgtacaatatagcccacgacacgcatatacctatgtaacaaagctgcacatcatgcacatgtacccctgaacttaaaagttaaaaattaaatattatgactgaggagaaatacagctttaaatagtctkatcaaagtagatcttattgagaaggtattaattttctcaaacgaagacttcaaagagtcagacaactgccgtcgaagtgcctgagaaagagtgttacagccagaggtagcaactcagggctgtcctaagatgagaaagtgtttgttgtgtttgaagaacagcaaagagactgagccagaggaagtgaggtcagagaggtcgttcacatagatgctgtaggacactgtgggctgttgtaagggtctggtgaacctgcaaggaaatttgctagtcctggctatgactgctaaaccccagaagagagaacgccaggtgtggggaggatgtgtatcctcgttctgcgtgtctcttcattgccatctaaacctcaaggggaacatggtatcttatagactagagagatgctcattgatgacacagtgctattcagcctagacttcaactctggtgacaacaaatcctagtaatgcgatttgcggcaagttgtgtwatctttctgtttcaggtttatttttgtgaaatagacacaattgtagctaattttcaaggttattacaagaattgtgtgagaagctatgtatctaaaaatagcaagttttggcaaacactagttcacatttccttctgtaagcaggtttccctcctgtctttctcctcctccgtgcccctttgacctttagttatactgatcttactccctttctactctcacctgttctgaggaaataatctgattaaaacccctcaccctagattgagaccaagcctaccacctatatgtattygcaatagcaccataacagccagcgtaatgccttatgctcagttgatttggtctaatttaagtataatcagcaacttcatgtgttactcctcccaagggtattggaacaacaaacagaggactacaccagtggttcccaacttcttaacacaaaggagccctttattttttttttcctatgggccttgtgttttggaagtttccatctactcaaaacactgcatgtattaagtaataatttgttttcccattttatagctaaaagacctgagtttgcaattaaaaaataaatacagtaagggtcaggattcagcttatttgtataatgagatgattggtgttttggtgaccttatgtagttttattgcagataaatatatttccattaggcttttggaaacagtaaacatagctcatggagcactgttaccacctttgcgaattactggagattctattttctcatattggaaaccttagttgtaaaccaaaaacaaaacaaaaaacaaacaaacaaaaaaaccaagtgtgtaaaagagggaattttggtacccataacaaaccatgagagaggtatgtatgcctgcctgtgtggcagggggaggggtaggaggtgaccgcaggtgttgttggggctgagccccttccccttcacttgctatatgtgcttctgaggcacagatcacagatgaaaccatcrttcatccctgtgygtaagtgtagctctagaggtaatgatcttgattagaatattcaaacttgttattaccactcactattgccatataaatattgtatagtatgccttttcatggttaatgggcatcctactataatttatagtcaaaaaatctcaaggtggaattttggttatgttattcaccagctatgtgaccttggggaatttatcttctctgaacctcagtgttataatctgaacttgaaatcattcaaatcttaagttaaataatgtctatggataattgtctaaaaggtaggcaaccaattcctttctctggttctgaaatggtaaatgggtttagtttcctgatttgacaactatagtctattggattcggcttctagagcccagtgtctttacgaatctggagccacataaaacctcagtgacagagagtgctgctgctgattagtaatatctactgtggtcctggtaggaggtatagctgcacatgtgccagaattttgccagccctgccctaagtactccaaagtctgcccttggagtaaatcagaccatcataatgctctttacctggatgatttgttttggcttcttaaaaattgcttttttttttggagacaaagtctcgttctgttgcccaggctggagtggagtgacgccatctcggctcactgcaacctctgcctcccaggctcaaacaattctcattcctcagcttcctgagtagctggggctacaggtgtttgccaccacactgggctaattttatatttttagtagggatggggttttgccatactggccaggctggtctcaaactcgtggcctcaagtgatccgcctgccttggcctcccaaagtgttgggattacaggcataagccaccacacccagcataaaatttgcttttatcaaatgtcccctgaccattaggcttcatcagaggttattagagccacctctttgaaactgcttgtatgtatttgctcagatgttattgggacattgttatatgacattgtctttcagaagactcacaattaatgtgtatctattattttggtactttaattatggtgctcccgagtggtttttgatttattcatttattacacaaatattcattgtctactataaagaacacattattgsatacattttctaaaagatccagtagattctctgactcttacaactgcttatgtgttcctattttctaggaagctcaaatccagatgtgacctccccccaccacatctagcaactgtacaggacggcatagtgtgcattatgtttagttctctcatttctagatttatctttcttacctttgcctttttgctccattcactcwtttgttyttgtgaattttatggttatttatatgctataaatctttttattatttaatgaaaggttaagcataagcaaattaatgaatatctaaatcttttgaggatgaggttagaaatgcactccctcccctatttattaaaataattagtaaataaaggataatccatgtaaaccacactgttacccataaagttctatctaaattaagtaaatataaataagaacagctatggtcagatttgcacagtttagttttccatatttgtctttcccagtgctgaaaatagaaagctttaaaagtttcttacctcatgatgttggatcaagaaaagcttgacatcactggctcagtatttgatgctagattgagttccttatgggaaaccatttgaaatgaagccattgtgaacccatcctaagaatgtcagtctgaggcatgatatctgcttatggattatgtttatttatgttctccaaattattagcatggtgatctttctttctcctgtggctactaatgaagacattttattaaacatatttcagtgtctagagaatttcagtcttgcatactgcctgttctcttgctatcagctctgtaaagtgaaggaagaaacccctactgcaggcctgatgcctaaaatctgcacgacatactaagtctctgagccaacttggattggatgctatgatcctagtttatttttttttttggcaggggggagggggctgggtcggggggcagttctctccctccctttagtaaatctgaaagaagaataaagaaaaatcatcagtgttaagtgtgcttgctcaactcaaaaataagacaagkggctgcgtatctttgtacacatatatgtatataagagagggtacaaaaagcatacatttaagatatgaaagcagaaattgataacccactagtggtatctaaacaatgaaaacactattaatttggtaagtttcagggtgctattttgcctttctttaaatttttcttggagcttcttacttttttrttacctgagattaaaatattgcaaaataagcaacactgtgcagtgattctggatgaggatgaggtcagaccactgcatccagctgacacctcatagtggagtactaataaactgtattagaccaaaatattcagttttccactgtttgcaaaaaaatttcatgcagttgccaaagttatgagtggtcattatctcacttaaatgttttgtccagaatggggtgggtctgggaactcagtgacctaaacattgccttccatgacatttctctaataattaacatcggtgtacttgggaaatagtctctaaaaaataatagccctttacagcaattcttgttgatgcatcagggcagaggtttasgtttagcctcttgctgtcatttatggtatgtctgtttctttgtgtgcacagttaaaaacacatgtacatatacatacctacacacatgcatgcacacatttttgcagactcgtatgtcaatggctgcagtctaaggtcgcctatctgtaaactacattgaaactattagcaaaccattatgtgtttcatcgattcagcagcgtttattgtgcatctcaaatgtctgatactgggctgagcagcagaaatatcaagattagtaaaacacaggttctcgggtagcccaggatgttgtgtggagatagacatgttaataaactcaatgtaagttatataataatttgaattgggtatacatgaaaaaaaaaacaaaataatagtggcttagacacataaaagatttattctctcacaaaaaaaaaaaaaagatgcaatccgtccaagtgcggttcaggaaacaggatctttctctctttctgctctgccattctgagtacaaggcttccattctcaagattgtctcatttccaagatggctgctagagccagcaggaaggtaggaaggcagagggcagaaaaggcattccccagccaagtcagcttcttttaagtagccttcccagaagcctcacttctacttttatttcagtaattatgattttttctcatgaccaatgagaaatgtattcttttaactgcatataatgctaacccagataaaattggggtccagtacaagaaaaataagagaagatggatatttgatgacaaccagaaacctctgccacatggaggtatgaagaaacggctatggaaacatacagcaataaggcagttacctctggaatctggacaggctttcttgagcagacgcctratttgggatttgaaggatgagtaggagtttgccaaataaagaatagggaaagagtattctaggcaaaaaataatagcatgtgcacagagggccaattaagcccatttttgtatttctgtttatttttctctctgttattaatagtaggtcttaaagtaacaactaattttaattaatctaatagttactcaaaatcaacagattaagatatgtcaagtatgattatcctgatatccctgsaaacaattttccacttggaccaaagtaagaacattttatctgatataaagtattccacattttaaaaataattgagttagaagattttggcatcttgaagaggaattgataacagagaaaaggaagaaaaaaaaaacaattgtgtcagggagatgttagtcttttaaattctgaagctaaacaaagcccatttaaaactgacttggttcatatcctggggtccgtaaacccacactgatagcactaagtcaggcgtctagccaagctactcttaaagtatgtcacctcctatttagctattcctaatattaccgttgctttggatctgtgaagctgaattgttctttacttaaaatggttttggaaccgtaagaaatctttagacttagagagagattttcatgattatctcctttggctccattagaggcatcagagtccgttaaaaattttccagagaaacttaaatcctttgagaaacctgaaattcctatagtttaaggagtaaacccagttagatttggacgcctgagagtggaaattcctgtgcccaatgcctgcgctgtccttccacatggtcaaggatcttgtcagattaagtcctcttcaatcccaaaaaccacaacaatagtagagtcaataatgctttgaatgttgcctaaattaaaactgtcatgctttctcaaaggatttggtccctccaaggcaattaggttatcagttttctgatwwttttttttttttttttttttggccaacttggttttttgcttcctctccaattagttagtatccaggcatttctaaaggacatggtgaacctcatgtgacacctcccttccattgttaactctgactcttcattcacatctcagctcaaaaaagtctctccctaagagaaatcttctcttgcctccctaatcaaattgaattcttcatattttatgctctcagagtgtcatgtgtctgtgttttataccttttttcatgattatcattttacacttattgcgtgtgatgatttgggcactatctccctctgccactagattgtaaagtctcatgagagtggacccatagatgctgaaattcaccattgaatgttgctcctagcacagtggctggcccatagcaggtcctcaataaatattacctaaccggttaaatgaattcttttataaataaaatacttctgtaatcctatttcacactgtactcagaatataacagtgaatacagaactgatcagctcatgggcgggcccatctacagatatgaattttgaaaataattttactgcagttatgtagaaatacaccaaagaagtcttaagccagcacatgtttggcactgcagggatgaaattcggttgctttctgaagtggcctcactgcagcctctgaatagattgaggcaaactgctcctcagctacactgaacccatagggatagagcccgtctgcctttgtccctgactttagaactcagcaccatgttttcctgacatctttgcatttaaaaaaaatgtacagttattgaaggggttgttgctgttcatctatttttaaaagacgttcatttgctattaatgaaaaaacatacattaccacattttaaaaatagagtacatatataacacaatgttaaataattatgtttttaaaccttcatctaaacatgtgtttgcaattattattaataagaggaataaaaaagaaaatcaagcctcaatcctctggtcatattaacaaccagatttttgaaaggcaagacgaactgtgaggactttatgaagagaagccataagtcccttcagttgtcactaccattattttattttgtcaaagagagtaattgaaatagtttgggagtagaataaatctttccatatttgatctaactagaactgtaagccatacaacctggcatagtttggatttgaatttctaagactcagatattagaaagtaaagaggaaagacacaaatggcattgcccacatactttataaaagcctgtgatgttgttaagcctgatttggaccgggcataaatgtttcacgaggagtctttagaactcagctgcttattagctaagtgaccttgggtaagactcatggcctcaactatagaatggagatatcttacttgcatggctcttttgagaatgaatgagatatttgtactgtgcctgatacaggacagggtaaggcaaatgacagggtcttagtggtattcatccctgctgcccttcatgcaaccgtcctcttmcacacacacacacacacacacacacacacacacacacacacacagtaagtttgtatctgtttgctgattctctcctcttttttaagctggagtactagctagaaaaggaagtattttcattattactcagcaaatattttttgagggcctacaattgaccaagcactgttctcactgcttggaatacattaattaacccaatatacaaatcrcccacccttacgcagcatacgttctaacgaaccatgtggaacatggagatcatttataaaatgtttcctgctaccattacctcttggttgtagtttttgtcatttgagtgcatcataattattaacataggagttattcttgaattaaggccctaaaacatcaataattcaggatcttctcatctctcttactttctccccatcattccctaccctgctccctattctstctcattctctttcttttacccttctttctatttgtatatctgaactktgaaaacatctttacccatgctacctttttttctttcttagcttgatttaaattccagttgaattcagtccccttcacggggtatgttttaggcccctcagggatgaagggagggttatttcatggtgattggcctcataatggattttgccatcggtaggtgcttggttgaattacacatctctctttcttgttagattgttggctgcgatcaccagctgggaagcaccgtcaaggaagataactgtggggtctgcaacggagatgggtccacctgccggctggtccgagggcagtataaatcccagctctccgcaaccaaatgtaagacacacagagatgggcgacctttggacttgttgacttatcctctcctggcttaggtctggccccactaaacagccagggaacaacacctccaccaaaacgataatgaacctgaaaatgtagaaggcttcatgctctggcatgtgaattagcttaggtgggacaagtcaggttaccagctgcagtcccaaagaggaagcctgtccttctgaggcacatcaggagtgaaccagacatggggctacaaatactttctgtacaaacatgagctttgctgtccaacatgaggacagactgtatcccagctcctgcgtgatgtgtagtgtgctatgcctggtggaagataacgaggaaagtgggaagatagcacaaattcactcctgtcactgtgaagtcacatggccttcatttacaaggtggtctttggtcagtactaaaacaagtcctttcagaattaatgtagggcagtgattacgtgacgttttggatttttggtttttgagttttggtgttttgtttttgtttgtttttgtttgtttttgactgagtctctcattctgttgcctaggctagagtgcaatggggcaatctcagctcactgcaacctccgcttcccgggttcaagtgattctcttgcctcaaccttgcaagtagctgtgattacagatgcatgccaccacacccagctaatttttgtatttttagtagagacagggtttcaccatgttggccgggctggtcttgaactcctgacctcaagtgatccacccgcctcagccccccaaagtgagggattacaggcatgagccactgtgcccagcctatatgaagctttttattgacctttgtgtcctggtatctcaatactagcaaaaaaaaaaaaaagtgtacttattagacatgtacttgctgagaatttcacacaatcgtcccatgtaattgttataacaacctcatgagcaaagtactattaatccccatgttatggatgagataactgaagcttagccagattatgggacttgcacagagtcacacagttgtaatggagccaagatttgagctcagagtctgattccagagcctaagcacttacttgtttctctggactggtcacagccccgctgatagtctctgtggtgggacatttgcaaagcagatagatggatcaagggaaggtgcctcagatgtctacccagtcaggtcctgctaggatagatggtacaagttctcatggtacctacgccaaaaattgagtcattaatctgaggcattttatgatacacagtctgacaatcactattctaggcactgcagcagatacagatagaaataagacagcccttgtattaaggacatgcatttttagaattattttgacattgcttggcatattgtctscagattttgctactatgcagaatccttcaatagatccctgactgagtatttctttccatatgtctctctggtttgggaaatgagaatgaatatctttactgaatgtgttttgttatctttacttgctgactagctggaggaaaacaattgacatatggagagtttgttgctttaaatggacttataggtcaaggaagaaaggcagatgcagttattctggtatgcagtggaggaatattctcagaagtcctgaaaaggcagcttgccaaaggattagcctcgaggtaaaaagaggaggcagaaacaaagaatggggacttacaaacacatgaaaaattggagataccagtttagggaactctgtacattctaactcccttggaaacagtggaaaatgtaattctgcaaaaaaaataaaataaatttaaaagattctggcatatagaataaagaatgaggtaacttagacattgatataacacattcaggtgagatttttctttggtcatgtgggttggtagcttcttccataagatgaaaaatttctaaagttagaagatggaaaccagaaatggatagaggcataattctcttgtaaatcatggttggatgttagaaaagagttacatttaaaagatcactcttaagaactcttcatggaatgctaaaagaattaaaatcctctaattatttctggcatgtaactgaatcagtgttcattatctaggaatctaggaattactgttaggtacaaaaggaaatgtcatgcatgtgtgcagtgatggctgtatagtgtcctgggagcatgtttttaatggtaaaggtgcttctttattctcatgcccataccttcttgttctcatagaggatctagactactgtgctcagatagacattcctcttaccctactgttagggagggatgggtgacctctagggcctgaatcacaaaacaaagatggagaagctcctaaggaagaaactgaagcaaattgagagccctatatcatctccaagtctgcaaataaatacctcaatgaaaagtgccctattcaagaccgacagtaggtaaattatataatacacaacctgatgattatacatactgacaaaatgsaattgattcgtttaccttagcactgatgatgtctcatsacaaaatgattgatatcaataaagcycaccatatgcatgcacctcaccacaatctatagcagatgctgaacaaactgcctcacttatgtttctctactctggaagaatcttccatcttatatttacagactgtgaggcgacccactggcagggaacatgaggctgctctgcagggcccagtggagaagccaggtgagcagttctccacacctggaggagtcctgccagatctctcccctgtcttctgccaaaaggcactgtcagctcgccacatgctctcttcaaacttctggcactcagattccccacattgaactcactttctttctgaacttatatccaagtttttttttttttycccttatgttatcaagcctcagaggaacaaagcaaaaacaggaaagtggagaaaaaccatggtagaatgtgccagaaggataaagagaagtaggagaagtttatcaaatggctgccatttgctggtgatttttaaaaaatcatctttttattaaaagacattacaattgcctaatacaaatacagacaatggaaatagagcaagatcaaagtactctttctcctttcttaaaggaaaagactacccactggtagcactcagccttttcattttttctagttacttctcaactcccccaacccaataaaaatagtcaaatatagctgacattaccttgcttttgattcttaaaatttaaaagttcatttctcacaagatttattgacttatactatgttctatattttccaagtatactcagaatattcttagggctagagccagcctatttgctatcaatttgatatttccagctttgcagaactctcgtctgtatctgtatgttttgaaatcacctggagatcctaaagctctctctctacctttcttgcatggtgaggtcacttaactcacttatatcaagataaaattaagcttttaatacttaaaaatgtgcttctcagactgtggcttatgctgacgtataatggctatgggtaaacatattcttggactatcattctagctcaaagattttgaggtaaagtacgcttataataaaacacaggcctctatgttataaagtacaaaatacatatggattttttaaagaaagcacaaaacaytaaagaaatttccacctgcccctggctgctttgggctatcctcacaagccactcaaggatatattcattcaacagcacatatttaatgggcacctgctatatgctgaggaactgttctaggtgctggaaacagcacagaacaaaacagacaaaatccatttatcttccyaggagccatggaaaaaacaaaccagagcaggagaacaggaaatgggtataggctgccasccacaggtgatgcaggggagctgcaattttcagtaaattaataaagaaaggactcactgataacatggcatttaaacaaggatctaagggaagtgaaaaggggtcaccatgcagaagtcagggagaagaaaattctaggaaaagagaaaagcaagtgcagacgtcctgtggtatttgcattcgggatatatttcatgaagaacaaagaagccagtgtgactaaaatgaggtgagtttcaaaaaggctagagaaaatgatatgaggctgggggaagaatggcacagatattgtggggttttttgtaagtctgaatgaaatgggaagttgttggaggattttgaacagaggaataacttgatcagatttctgctatactgagaatagactgtagttggaaagatattacactaagccaggccacagatgacaatggcttggactgtaccagtagctgtggaaatgatgagaagtgatccaatcatagatatactgcacctgtatttattttctttctttctttctttcttwcttwctttytytttctttctttctttctttctttctttcygtctttcttccttccttccttccttccttcctttctttcttttctttttttctttttctttctttctttcctttctttctttcttttcttttytttttctttctttcttctttttttcttttattgaaacagggtctcactctgtcactgaggcttcagtgcagtggcactatcacagctcagctcattgcagccttgacctcctggactcaggtgatcctcccacttcagcctccccaagtagctgggattacaggtgcacaccatcatgcctgagtaatttttgtatttttagtagagatggggttttgccatgttggccaggctggtctcaaattcctggcctcaagtgatctgcccacctcaacctcccaaagtgttgggattacaggtgtgagccacggcacctggccaccattttaaattttagccattcttatcagtgagtagtggtatttcatacttgtttttatttgcattttcctaatggctaataatgttaacatcttttcatgttgtattatcttgcaattgctgctgtaactaattaccacagactaagtgatttaaagcaacacaaatttattattttatggttctgggggcgtcagaaaactgaaataggtttcactgggctaaaaacaaggtgtttgcagaacacagctctggaagcattgagggagtatttctctttcttcaattttgattttcctgctcctggagcctatgcacattctttggcatcttcaaagtcagtagcttagcatcttcagatctctctctgactcaagcttcctcttctgcctgcctcttccatattaaagaatgtttgtgattacattgagtccactcagatcatccaggataatcacttaattttaaggtgacctgattagcaatcttaattccattagcaaccttaattcccccttgcmacataatattacacattcacagatttaaggacatatttggcaggggagagggatacattagtctacttacsacagtgtgctttgttcatcttttgcatagtgtcagttcaagtctgttgctcatttttaaaaaatgtgttgcttgactttctcttgttgagttttgggagttctttatatatactaggtacaagtcctttgtgggatatttgaattggaaatattttctccatcatagcttttttattcaaaattgcttaatgttatctttcacagagcaaaagcttttcatttggatgaagaccasgctatcattttttttcttttacggctcatgcttttaatgtcatgtctaagaacttcttgcctaagaccaggacacaaagattttctcctgtgttttcttgcagaaatacatttcacctttagatcagtgacctattttcagttattttttgtataaggtgtaagtttgataggtagcttgaattttttttcgtatagacgcccaattcttccagtaccatttgttgaaaaagacagccttttctcttttgaattrtctttaaaccttgtcaaaaatctattgcygtttctctgagggtctgtttctggactctattctgctatgtgtctgtcccttcatcaatactccattttttttattacygtggctttaaggtaaatcttaaaatgtggtagtgtgatttctccaactttgttcttgttttcaaattcattttggctattctattctgggtctttgtctttccatataaattttactatctgcttgtccatatctacaaaaagtcttgctgggatttttttgtgttaattctacagattgatttggagggggtaggaattgrcatctttagcatgttaagtcactcaatctataaggtatgagaattttatgtctctgtttacttaggtcttattttatctctttgattagcctttattagctttcagcatgaagatcgcatatactttatatgatttacatctgttgtattttttgtaactattgcaaatggcattatattctcttttttaaaattagagatgaggtttcactatgttgcccagactgaagtgcagtggctattcacagatgtaatcatagcacactacagacccacattccttagctcaagtgatctacctgcctcagcctcccaagtagctgggactacaggagttactgcgcttggcttggcattgtattctttatttccatgtccaattatatattcctagttcacagaaacatgattgatttttgtgtgttagccgtgtattatgtaaacttgatacactcactcaatacctctgagttttttggtagatgactgggattttctcartaaacaatcatgttgtttacaagtaagagtggttttgcctcttttcaatttgtaagccacttttttttttgtagtcttattgtactggctacgcatgcaatacaatagtraataggaatgatgacaatggaggtccttatcttattcctaatcttaagaggaaagcattcagtttctcaccattgagtatgatgttagctgtaggtttttataaatgccctttatcagattgaggaagttcccttcctttcctggtttgctgagagttaataacatgaagggatgatgaattttattaaattctcttttacctcaactgacaaagtcctgtggtttttcttctttagattgttattgtgatgaattacattaattggtttttaaataaccaactctgcatttctgggataaastgtacttggtcatggtgtattattctttatatagatttctagtttgattcggcagtattttgttgaggctttttatctgtgttcatgagagatactggtctgtcgtattcttttttgtattgtctttgtttggtgttagtattagcacaaaatggcctcaaacgatgagtagagaagtaattgcttgtcttctttttttctggaaragattgtatggaattgaatwtatttmttctttaaatggctgctaccaygccccagtgaaattttctggatctggagatttatttttcagtatgtaaccttatgaacttatggaacaccattatagtaactattttaatatccattctgtgtttggattgattgatttttcactttaatatgtgctgttttttttgtttgtttgtttctttgcgtgcctcattattttttgacttgatgccagacattacaaattttactttcttgggtactagatatttttgtatttctataaatatccttgagctgtgttctgggagcagttaagttactgaaatcagtttgaacctttggggtcttaaaatgtggtagacaggaccaaagccatgtttggtctagagctaattgtacccttttactgaggcgggacctttctgagtagactacttaatgttccatgacttacaaagtttgtcactttggctgatgggataagatactattctcagccctgtatgagcaccgtgtactcttctctataattcttttgtgtagttctttccccaggccgggtaatttcctcacacttatgtattgattagtatgctgctggctactttaaggaaaccctcttgggtgtccagagttgtccttctgtatagctctctcctttctgttactttgtcccagaaattctaactgtttttgtctccttggactcttggctttgtctactcaattcagggaatctactgagctctacaggtcttcatacttccaaagctgtagcctaggaactctatcaaggcagtaagctggggcaatgttgggccttatctgatgtgtttcctgagtatacagaattgctgcccttttttgcctgatgtccaatatcttaaaaaccatggtttcatctgactttttgattgttttagacagaatattaaatctggttcctgttagttcatctttgtcagaagcagaagtcttggtgctgggctttcaattcagctctgcaattacatagagctagccaacttttgactccttctacgacaatgcagttaagcacctgtaattctgattcctcatctccctacaacctccacagccatttggttcctagaggttgaatgtgttccaatattgtcttataattttctcccaagcggctgacactcattttgtgagtttgatactggctgttttgatgttagcacctgtgtaggcaacggtatctatgtcaggattatcgcctgagtgagagggaatataagatactactgattgtgagatgtattctgatttcatatatgttaaagcatgaaaagttgtccctcttggaatcaatgaaatagggtattttgacaacagaactttttaactgattacatataaagatgaagtagaggatggctccaagttttctggcctaggcaaatggaaggatgaagttctccagatgggaatgaggagggcatcttgtttggcctgtccagtatatatcttctattgtgcaattacagataaaccagggagaaaattgaaagcctcagatgctcaacttcttattttgttggatatattttaagagtaataaaaccgtcacgaagatgtaaaacataccatttaaacctcctcaagattggcagactatttttatacatagtcaattgtattttaaaatgactctctcatttttaaaaataaaataaaataaagtgtcagctccataggcatagagggaagagtctttaaaaacatgaactcatcaacggatctaaaaataagataaactcagatatcagaataggaaattctgtctttcaaaatattatcctcatcacctttctctgacacagctgtgaatcacgcagaacatccacatatgacaagattttaaaatgaatataaaatattctatatagaaagttgtrtgatatacatatagatagatattttttaaagaatwcttttaggtacagtccttgggaagaattttcttgagaaaagacatttgcaacccatatctgtgaaatgacagaatttatgattcccatggaaattttgttcattgaatggagaaatgggttatctggtatctgaagcagatcatttagaattgttgattaataagctagaaatatgtcctgaagactggcatcatggttcagtcaacaaagccagaatagattagggcagatgcactcaatcgtaaaacagtgtgcctttgtaggaaagggcacccagaggaatgtgcagcayggtgggagaggatgtggcccctgcctcgccagctatactaatggcattaatcaccaaggaggcaggtgttgcmaccagattgctctcacatcctaagagatcttaaacaccactctgtgcacaatattgtaatagatgccaagtagaagcatcttccaatccatcccaaatcattgaggatttatcagaaagtgagacaattattaatacataaacaactcaaaagtggctttttatgaacatgcagaaaatgaaatttttaattgttttccctattttgttttttgttaaattaagagtactgttccttaaagtatgtcctaagatatatcagctgattttaacagatgacacataagaaaaagtttttatggataaacatcttaggtatacacggggttaaatagagtgaaatgggtttctttggtgcagtgctcctaaaaaaatgaatgaatatgctttgggaatttcatctgtggggtgtagtattttgtatttcccccatattttatcttagatccctttttcaggaccatctcgtggggctagtgctttgtttatcttctttgtcactgaatccctagtacctagcatggagcctgacactaaaagacactcaaaaaatacttgtggaataaagtaatgaatttgcagatcgtttaatgtctggccaggggtccatcagcccttttcagaataatatataagagaaggctgtggctcttcctacttctgtgccatgtgctgccaactgctagagtttgtaccagcctgacttgcttcatttctctttgactaggtgagtgcaaggggcatcaggaaatactatttcacctggtctactttctccatataccctcttcctcaacaactttctaggaggttcttctcctctcttttttgggggtgcatgctaatgttaccacaccctgtcttctttagggaacatacagatattacagcatcagccaagagctagggtattaatgttccagtttatggaatgtgagtcacttcccagcagagcaagagggaggctgcatgagctgtgtgtgggtcagaagactgctgctgagcatggcagggccaaacagaaagctttccttttacttgcactttatttgaactgtgggtaaacaaagactttctatttctagaaagtcccattgttttaactgctttgagtttcttttgcaaacttaaaaagtcatgtctttatgcaaggcgtttaaagctctgtaggcccagtctcsgccgggtgtggtggctcactccagtaatcccagcattttgggaggccgaggtgggtggatcacaaggtcaggagttcaagacctgcctggccaagatggtgaaaccccgtctctactaaaaatacaaaaattagccgggctgcagtggcagaagtctgtaatcccagctacttgaggctgaggcaggagaatcacttgaacccarggggcggaggttgcagtgagtcaagatcacaatcatgctactgcactctagcctgggtaacaaagtgagactccatctcaaaaaacaaacaaaccaaagaagctctgtaggcctaatcttaacttttttttttttttttttggttccttttctatattccccttacacttttttctgttgttgttcttatataccacaaattcttagctctctgaaattcaacaatgtatgacattaaaaacagctataagattttgtcatgagtggaatattcaactttgtagagaactcgataatgtaacctctccagggaaggaattgggagcatatgattcttttttctcattcaacagataatgtgctaggggccttggagagttgaaacacwatttaaaaaaaaaatagtttttcaatccctgtcctttaagagatttggggtagagagaggaaaataatgtttacagaatacttactgtgttccaggctatacatccctatatctagattcatgtctatatttatatctagtcacgacaatagtataaggcaagttttgttttccctgttttacaaatgaggaaactgaagatcagagaagtcaggtaacttctgagattcactaatttaaactaaattctcctaaagataggatgataatattaaggttcagagaaattgagtaacaattgggattatcttatttaacctaaatccttccaatgataggataattatgtacactgttaaaaaaaaatatgtctgaacaggccaggtgcagtggcttacccatgcaatcccagcactttgggaggccgaggcaggtggatctcttcagttcaggagttcaagacaagcgtgggcaacatggcaaaaccacatctctacaaaattacaaaaaccatctgggcgtagtggtgtgcacctgcagtcccagctacttggggtgctgaagtaggaggatctcttgagcccgggaagctaaggctgcagtgagctgtgatcacactgtgatagcgagaccctatctcaaaataataataagggctgagtgcagtggctcaygcctgtaatcccagcactttgggaggctgaggtgagcggatcatgaggtcaggagttcgagaccagtctggccaatatagtgaaaccccatctcaactaaaaatacaaaaattagtcrggcgtgatggtgggcrcctataatcccagctacttgggaggctgaggcagaagaattgcttgaacccaggaaacagaggttgcagttgagccaagatcacaccactgcactccagcctgggtgacagagcgagattcctcaaaaaaaaaaaaagaatatgtaaatatatatatatatatttatatatataaatatgtatgtaaatatatatttaaatatatatattaaataaaaaagataagtatgaacaaagaatcacacagggcttctgaatatgctggtaaatattttaaaacctgcctttctcttgtcttctgaagtgcctttctatccatttgatcttggactatgcattgtacttcccagaaatttcatttgttcatcagaaaatcctctgtgccaatgtcagaagttttgggtgagggagtaaatagtataatttaggtgaaatttaacctctgcagtaccataaaaatataagatactgtcattacaaatggagttctgaataagaatgcctgtgatggtatttgagatgcatgtaatatagctctaatttttaaaaatgtctgtgtctaatgaatttaagctcaatttataaatagagtgaaaagaaatctattataaagtgatctgtggttcagtcaatttctaaaaaaaaattttaaaatagagtatagtgtagagaaatgttaagaaacacttatggggtgctcactacatatagtattaggaatagatattgtgaaggatatttaagaactagaaggcatgatttctgcccctggggtgttcagcgcataccaatatatcttccacttctcttacctgttctactcatccaagatactctgctggagagaagtccagattttgatgtaataaattcatcctttaaacattataatgtatttttatgttttaattcagcccaagtgtttttgatcatataagaccagattttaaaatcgaaaatgaaaacttgcaaaccaatttttcagtatatcaaaattcctattttttaaaaggccaaatcctctaggagttaactagtgactagcatctttggcatattttattttgagcaaagtgaaaatgttgatttctaaatattggccttcacatttcaaacacttaaaaaaactgtagtttttaaggtatggaagtcagtgcctttatttagaaggcaatcaataattttgtgtcaagtgacatgcttttaagattttgctttgtttctctctagcggatgatactgtggttgcaattccctatggaagtagacatattcgccttgtcttaaaaggtcctgatcacttatgtaagtaactccattgttttcctttgggaattggkaattgtagtcattattatttattttgtcttcccagaaaagattaaaacacaagaatacaaatctttctactctatcataatatgatattttgagtacctctgtttatcttttagctgcctgatgagatggcagaaacccctgtagtaattatctttaaccacagtcatcctgaaaaatacaaaatagatgctcccaatgggttgttcatgggttaagcacatgtttatgctcttgcgagtgttatatctcattctctttcttcttcctttccaatctcaatctttttttgccttgcctctccttttttcttctttcttctaacccacttctcttttcttcctttattctctttttctacctactttcatgtttcattacttccatcaatccagaggaacatagaaacaccaaacaaccttaacactgtagaatttaaagaaaaccatcatggtgtaattaagcatcccatgttttaaagaaaattcagggacctcatatcttaaagatagctactgggattcaggattgaatggtaatcataaccccaaagatcaaatggcagcatggctcctccagggtttgtgcaaaaattgatcttcaatcatgccaaggcagcagtacagagccacctatttcttattatttagtgttgtttagatacagacctgtaaattacaagaagaaaattataggctataaacaaagaagaggatgggaggggatatggtagcattttctgtaaaattcagtttcactgaaaggcttcacttcagttggttccttgagcatttctgatttcctccactgtgattgttcctgggtttccacaaagccatctatcgtctgtcctttctcccctcccacacaaatgcctgtgaaaccaatttagatagcaagtagtattttttagtagttggattatgaatgaaatcacgctaaaaaggcaaacaagaggaagacaaattgaagcccataaaagtcaagatagcctacagtagtctttctagatataaaaataaatacatgtcatggaagaggtgggatttgaaaggccttgtgaagtaaaagaataagtaaggtacagttcaggcaaaaccagaaaatgatgattaagtcaccttctatggattcaagtttgtttctaatcctgaacaaccctgtaaaatacagtgttcacatgtcaaaagataatgtatgtgtgtgtattattaccactcaaatgattcatttttccccatttgagaactggagagggctaactgtccactaactctscactcaactaactctccactcaaaaatagtacttttgtgagcagtaacagatactgaaataaaatattcaggccaagaacatcaccaagtgggggactgactcttcattgcggaagraagaacccataggagtagatttaagagggaaatttatttttataaatgtattagtctcatagatttcataattatgtgatcacaaagaagctgaagaattggccttgtktgatttaattatcctaaagatttgatgaaaagcaaactggaacctgcttttttctcccaacaaacatactattggtagcawatgtatagctaaatcatttttccttgtgtgttctttttttgtatttgaaatataattcagcaaaatgaatgtgggagtgaaagataccctgtttctcttttgcycttcactcccagaagctggtacagtgtgaaascaaccttaaatattttggaccaaaccagaataagatgaggcaatctagtctgcccccttggctcatctttaattagaggtaccttgagaaggacagmtgtaagcctcttgataaaatggaatcagatgctcagatcaggcctacaactgcaagattttcccaaaactaagttaattgatgtcctagaaatatttctacaagtgcctgtgaggcagtttgaggaatgaaggctggaggaaggagatttagtgcagttgctttcccctgatgacaacaacgtgatttcctccctgcaatattcctttaatgtgccctgtrtttttcggtgggatcccctctgttctggggcaagggagtgaagcctggcctactcyagaagaaagtctccacagacttcatttgagaatcactgggcatttaattgaacaccaaggttttccasttgttgatattctttgcaatagagaactacaagtagaccccctctacaataatgtaatacaagtactttaggtacttgagtgcctccagagaccttaaaattgttttaacccagagccccatccaagcactccatttttctgctgaggaatctctgccaaaaccaaacgttcttgtcaagttttggaacccattagccttagtccatccatctttcttcgtgcaacrtaacagacagttgttctaaatcacccctcagtcacatgagaacttagtcttctctgaatcacacaacataattaccatcatccccagcatgctctgattttctacaacaaaacatgcttcataggctttgtcattggccaaatctggatttgaatgctccagaaatcaaggttttttttctatctcaagcagttatgaaataccttatatatgcataaagctgaactaagtatcaaaatggattttaaaaagaaaatactgaaaatgatagttcttgttcttacatcactatcgtttcttcattttgagcaatagcatcagtgcagtaagtaaccagaaagtataaataaacacaggctaatgcacgaatataaagtcatacgggtactgaggcaactcagagatacaccctggatcttgtagagcaaaaagaaaactggagggtatcctaggctgagggccatcaagattgaagtcaaaaagagacatatgagaattggtttagtcaaaggaatagggttgcagtaaagcgggatgcccaaataacatcatctggagagtcaaagatttttttgacaggaacccttgaatgcctggctaatgacttttgaaataatttcaactccagcataaattcctatgtgactcagcagtgcctgtatagtttgttgatatcacaatttcaattttgtcagctatataaagaatgatgtgtctcccttacctagctctaaacattgttgcatgaaatgtgcttgcctgtggttgccctakgaacatctttctctcatcttcacgtgtttgatcatatagatctggaaaccaaaaccctccaggggactaaaggtgaaaacagtctcarctccacaggaactttccttgtggacaattctagtgtggacttccagaaatttccagacaaagagatactgagaatggctggaccactcacagcagatttcattgtcaaggtgagccctatttagatacctccttttcaagccacatcccaaatgrtgttacttataatttcctgagcagagagygatttttggttctgacatatgtttggaaagcccgtttgttacccaggaaatgtttaatctgagggtgttgagctagctgcatcctggaccttatgaggacatatgatatttcaaggtcatagaaaatctttattatataattaatacaatctttattatgtaattaataaaataaccccacctaagaggccaatgtatcataagttggtggctatagattgtttttaaaatagtttggatacagtcattgacttatatrggctatcctcagtaaaagagaaaaacaaactaattatccatcawcttggtcaactgatcattcttccaatggcaagctctgttttcttttgtgctggcaagaaaactaagttgtttccttctatcagagcttccctagtcttcaaggtaatataaaacacattgctggaagcaacatgcacattctgctggaaaagtgcacacactagaagaacttttgggaatcacaataaaataaaacatattttttccttcagtaggtcaggagcacctgaaggatttcagctgtaaagctgtaaaacttgtaatgtgtccaggactccataaatttttcatcatgggacctggagccagaggacatttgatttaagctaaagcttgatgaccccatggcagctggaagtaagaatgcatataggaaaatgcaataggcagtaaggttagagggagaaaggttccagaatactgtcctccgtctccatctgcatggtagttctttttaatccagtccagacgccagccacatgaacgtgagcaagaagctacaagccatccgaggtagctcacaatagaaatgatgctgtaggtagttaaatgatttctgttaagcaagaaaatccartaaagaagtgaaagatgtctttattctttgaagcccttggagtaccattaaatagaccaagtatacyatagtaatttccctagtggccttgtgagagttaatacacatactgaaattatataactggattcaagcaatattgcttacattggaacagctcacagcattgtcaaatgtgttacatctatccagttgccttctgcacatcactgcttgaataacccayaggcacaacaagcccgacatgcgtaagtttaacttgagccccagaaacctgctttatcatctttatttttttaatcttataaatgaagacactgtctgcccaggcaaatcagaaacctttgattcaccctgattttcccttctatatgccaccggtcagacttcatccaaactatctctcaacattggtttttctcctccatccttgctgccactgcgttagcrcasgcctttactttttctcatctgaactagtaccatggaccctgagctagtttaccagcctctgatttcattgcctatgttaccttcagagtgcgtttcctaaaatccctttcctaatccttcataacccctcaccttcactcattgcctctaggttagaagacaaatccatagccacagtatctgctactctggtttagctggattgtgcccacctttccaatctcacctttgacttttccccttctgtttcagacctgaatgccgggcaggtcccccagcaccttacactctcataactcattacctttgcaggatgctgtgccctctacctggaatgctcttatcttgtcttcttccattctcttcactacctcttatttcttcttcaagatctcctccttccaggagtattctttgactctaccccaaatttctgtctgtatctccccacctctgtgttccttgagagaagaaactgaattgtatttgtcttcatatctccataagaagaacctaataagyactaacaactgctggataaataaagaatttttgccacacaacaattgtttaaatagagcagatgctgacatctctattatacccacaaggaaacttagcttcaggaaagttgagtgacttgcctgagttcacactgatgggaagccagcactgaaaatcacatctctttacttctggtccagaacgcttttaatattttgtgttgcttctaagagtakatatctttttcttcagtgtttctttagaaaacactgggaatcaaataaatgtaaagttattctaagatagattatgtaattcttaaattagtttgcttaaactttaaaakgagccagattattgaagtacgtacagaaaaaaagaaraaaattatcttttttctagtacttcgtaatgaaacaactttctcttccctaattttcctcagagaaatagctgaaaacaagatattactattatttatcagttttcatgacttagcttttataattatatatatcatatgaattaagctttcagtagcattcaaagtatagtctcttttgcattatatatataatacatatgtatagttgattaatcaaattctctttatagatttaaatggccatgtacctaagtctcaaaccaacctcaccttgacaaacgtcattagaaacaccaaaatccatcttcacaatcagcaaaatagcatcatccttgagatggggtcattaccctggtgatctggtggtatgaagtcaggtgattcagaaagtggaataaaccaaacatacagcagaaagccatcagtgtggtgcttacacagaggccatgactatctgggtcttcacagagagctatccaacagctatytgaagatttttttttcytcaaggcatggcaggattttatttttgagatgtggacattctcttaaaacagtgtaattgaaacaagttctcttttaatttttattaattaatttttaattratgagtaaaaactagattcatcatatacaacatgttttcaaatatgtatactttggggaacagctgaactgagctaattaacatatgtgttacttcacatatttatcaattttttgtgttgagaacacttaaaatctatctcttggcaactttcacaaatacaatacattgttattaactgcagccaccgtgttgtaggtagatctcctgaacttatttctcctaacgaaattttgtatcttttgaccaacatttcccccacagttcacttccaccccaaccccctggtagccaatattctactctgtgtttctattaggtcaattgttttagatttgacacagaagtattattaatatcacgcagtatttgtctttctgggcctagcttatttcatttaacataatgttctccaggttcatccacattgtcacaatgacrggattttcttcttttttcaaagctgaatagtattccattgtgcatacatattacattttgtttatctgtctgttgatgaacacctaggttgatttcacatcttggctgttgtgactagtgctgcagtgaacacgagagtgtagatatctcttcaacatactgatttcatttccttcgagtatatacccaggagtgagattgctggatcatatggtagttctgtttttcaaatttttttagaaatstttatactgttttctacaatggctgaatcaatttacattcccacccatagtatcmaagggttcccttttctctacatccgtgccaatacttaccttttgtctttttgataacagcaattctataaggtgtaaggtgatattatagtactgaatgcctttccctgatgattaatgatgttgagcatttttaaatatgcctgttggccatttgtatgtcttctcttgagaaaartctattcagatcctttgtttatttttcagtcagattgttttcttgctattgagttgtttgagtttcttgtatattttgggtattagccccttatcagaagtgtgatttgcaattttttttccattctgtaggttgtctcttcactctgttgattgtttccttcactgtgcagaagctttttagtttaatgtaatcccatttatctatttttgcttttgttgcctgtacttttgggtcatattcaaaaaattgcccagaccaattgcagattgtcacctatgttttcttctagtaattttatagtttcaggtcttacacttaagtctttaatccattttaagttgatttttgtgtatagtgtgagatacgggtctgattttattcttccacatatggaagtttttccaaacactactgtccttttcgcagcaactttgtcagaaaatcaattggccttaaatttctgaattaacatctgggctgtcttctctttcattggtctatgtgtctgtttttagactggtaccatgttgttttgattactatagcttttcagtagattttgaaatcaggtcgtatgatgcctttatcttttttcttttttgttctagattgctttggctatttggggtattttgtggttccatttgaattttagggtttttttttccatttctgtgaaaaatgtcattggaattttgatggagattccattaaatctgtagatagtgttgggtagtacggacatttaacaatataaattcttccaattcataacacatgatatctttccattaatttgtgttttcttcaattttttcatcaatcttttatagttttcagtgtctttcactttcttgattaaatttactcctaaatattgggggtttttggtaggtattatacctgggattgtttcattaatttcttttttgaatggtttgatattagtgtatagaaatgctattgatgtttatatgttgatttttttatcctgcaactttactgaatttattgattagttctaaaagttttttggtggatgcattatatattaatttaagcagtgcattgctttttgaaaaagatattgcaggaatcagaatggccacttgtcagtatctccatggaattttattttttttatttttatttttttaattattattatactttaagttttagggtacatatgcacaatgtgcaggttagttacatatgtatacatgtggcatgctggtgtgctgcacccattaacttgtcatttggtattaggtatatctcctaatgctatccctcccccctacccccaccccacaacagtccccagagtgtgatgttccccttcctgtgtccatgtgttctcattgttcaattcccatctatgagtgagaacatgcagtgtttggttttttgtccttgcgatagtttactgagaatgatgatttccaatttcatccatgtccctayaaaggacatgaactcatcattttttatggctgcatagtattccatggtgtatatgtgccacattttcttaatccagtctatcattgttggacatttgggttagttccaagtctttgttattgtgaatagtgccacaataaacatacgtgtgcatgtgtctttatagcagcatgatttatagtcctttgggtatatacccagtaatgagatggctgggtcaaatggtatttctagttctagatccctgaggaatcgccacactgacttccacaatggttgcactagtttacagtcccaccaacagtgtaaaagtgtttctatttctccacatcttctccagcacctgttgtttcctgactttttaatgattgycattctaactggtgtgagatggtatctcattgtggttttgatttgcatttctctgagggccagtgatgatgagcattttttcatgtgtcttttggctgcaaaaatgtcttcttttgagaagtgtctgttcatgtccttcacccactttttgatggggttgtttgttttattcttgtaaatttgtttgagttcattgtagattctggatattagccctttgtcagatgagtagattgttaaaattttctcccgttttgtaggttgcctgttcactctgatggtagtttcttttgctgtgcagaagctctttagtttaattagatcccatttgtcagttttggcttttgttgccattgcttttggtgttttagacatgaagtccttgcccaggcctatgtcctgaatggtaatgcctaggttttcctctagggtttttatggttttaggtctaacgtttaagtctttaatccatcttgaattaatttttgtataaggtgtgaggaagggatccagtttcagctttctacgtgtggctagccagttttcccagcaccatttattaaatagggaatcctttccccattgcttgtttttctcaggtttgtcaaagatcagatagttgtagatatgcagcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggtgatgtgggctcttttttggttccatatgaactttaaagtagttttttccaattctgtgaagaaagtcattggtagcttgatggggatggcattgaatctgtaaattaccttgggcagtatggccattttcatgatactgattcttcctatccatgagcatagaatgttcttccatttgtttgtatcctcttttatttccttgagcagtggtttgtagttctccttgaagaggtccttcacatcccttgtaagttggattcctaggtattttattctttttgaagcaattgtgaatcggagttcactcatgatttggctctctgtttgtctgttattggtgtataagaatgcttgtgatttttgtacattgattttgtatcttgagactttgctgaagttgcttatcagcttaaggagattttgggctgagacaatggggtttyctagatatacaatcatgtcatcttcaaacagggataatttgacttcctcttttcctaattgaataccctttatttccttctmctgcctaattgccctggccagaacttccagcactatgttgaataggagtggtgagagagggcatccctgtcttgtgccagttttcaaagggaatgctcycagtttttgcccattcagtatgatattggctgtgggtttgtcayagatagctcttattattttgagatacgtcccatcaatacctaatttattgagagtttttagcatgaagggttgttgaattttgtcaaaggccttttctgcatctattgagataatcatgtggtttttgtctttggttctgtttatatgctggattacatttattgatttgcatatattgaaccagmcttgcatcccaaggatgaagcccacttgatcatggtggataactttttgatgtgctgctggattcggtttgccagtwttttattgaggatttttgcatcaatgttcatcaaggatattggtctaaaattctctttttttgttgtgtctctgccyggctttggtatcaggatgatgcaggcctcatcaaatgagttagggaggattccctctttttctattgattggaatagtttcagaaggaatggtaccagttcctccttgtacctctggtaaaattyggctgtgaatccatctggtcctggrctctttttggttggtaagctattgattattgccacaatttcagatcctgttattggtctactcagagattcaacttcttcctggtttagtcttggagagtgtatgtgtcgaggaatktatccatttcttctagattttctagtttatttgtgtagaggtgcttgtagtatcctctgatggtagtttgtatttctgtgggatcggtggtgatatcccctttatcattttttattgcatctatttgattcttctctctttttttctttattagtcttcctagtggtctatcaattttgttgatcctttcaaaaaaccagctcctggattcattaattttttgaagggtttttttttycyccatttccttcagttctgctctgattttagttatttcttgccttctgctagcttttgaatgtgtttgctcttgcttttctagttcttttaattgtgatattagggtgtcaattttggatctttcctactttctcttgtgggcatttagtgctatgaatttccctctacacactgctttgaatgtgtcccagagagtctggtatgttgtgtctttgttctcgttggtttcaaagaacatctttatttctgccttcatttcgttatgtacccagtagtcattcaggagcaggttgttcagtttccatgtagttgagtrgttttgagtgagattcttaatcctgagttctagtttgattgcactgtggtctgagagacagtttgttataatttctgttcttttacatttgctgtggagagctttacttccaagtatgtggtcaattttggaataggtgtggtgtggtgctgaaaaaaatgtacattctgttgatttggggtggagagttctgtagatgtctattaggtccrcttggtgcagagctgagttcaattcctgggtatcctttttgactttctgtctkgttgatccgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttgtcagagactaggattgccaaccctgcctttttttgttttccatttgcttggtagatcttcctccatccttttattttgagcctatgcgtgtctctgcacgtgagatgggtttcctgaatacagcacactgatgggtcttgactctttatccaatttgccagtctgtgtcttttaattggcgcatttagtccatttacatttaaagttaatattgttatgtatgactttgatcctgtcattatgatgttagctggtaattttcctcattagttgatgcagtttcttcctagtcttgatggtctttacattttggcatgattttgcagcggctggtactggttgttcctttccatgtttagcacttccttcaggagctcttttagggcaggcctggtggtgacaaaatctctcagcatttgcttgtctrtaaagkattttatttctccttcactgatgaagcttrgtttggctggatatgaaattctgggttgaaaattcttttctttaagaatgttgaatattggtccccactgtcttctggcttgtagagtttctgccgagagatccgctgttagtctgatgggcttccctttgtgggtaacccgacctttctctctggctgcccttaacattttttccttcatttcaactttggtgaatctgacaattatgtgtcttggagttgctcttctcgaggagtacctttgtggtgttctctgtatttcctgaatctgaatgttggcctgccttgctagattggggaagttctcctggataatatcctgcagagtgttttccaacttggttccattctccccatcactttcaggtacaccaatcagacrcagatttggtcttttcacatagtcccatatttcttggaggctttgttcgtttctttttattcttttttctctaaacttcctttctcgcttcatttcattcatttcatcttccctgactgataacctttcttccagttgattgcatcagctcctgaggcttctgcattctccacgtagttctcgcgccttggctttcagctccatcagctcctttaagcacttctctgtattggttattctagttatacattygtctaaatttttttcaaagttttcaacttctttgcctttggtttgaatttcctcctgtagctcggagtggtttgatcgtctgaagccttcttctctcaactcgtcaaagtcattctctgtccagctttgttccgttgctggtgaggagctgcattcctttggatgaggagaggtgctctgatttttagagtttccagtttttctgctctgttttctccccatctttgtggttttatctacttttggtctttgatgatggtgatgtacagatgggtttttggtgtggatgtcctttctgtttgttagttttccttctaacagacaggaccctcagctgcaggtctgttggagtttgctagatttccactccagaccctgtttgcctgggtatcagcagcggtgtctacagaactgcagattttcatgaacctcaaatgctgctgtctgatcgttcctctggaagttttgtctcagaggagtaccccgccgtgtgaggtgtcagtctgcccctactggggggtgcctcccagttaggcttcttgggggtcaggggtcagggacctacttgaggaggcagtctgcccgttctcagatctccagctgcgtgctgggagaaccactgctctcttcaaagctgtcagacagggacatttaagtctgcagasgttactgctgtctttttgtttgtctgtgccctgccatcagaggtggagcctacagaggcaggcaggcctccttgagctgtggtgggctccacccagttcgagcttccaggctgctttgtttacctaagcaagcctgggcaatggcgggtgcccatccccaagcctcgctgccgccttgcagtttgatytctgactgctttgctagcaatcagtgagactcygtgggcgtgggaccctctgagccatgtgcgggatataatctcctggtgtgccrtttcctaagcccatcggaaaagtgcagtgtttgggtgggagtgacccgattttccaggtgccgtctgtcacccctttccttggccaggaaagggaactccctgaccccttgcacttcctgagtgaggcaatgcctcgccctgcttcggctcgtgcacagcrcgctgcacccactgacctgcacccactgtctggcactccctagtgagatgaacccagtacctcagatggaaatgcagaaatcacccgtcttctgcgtagctcacggtgggagttgtagacaggagctgttcctattcggccatcttggctcctccctcctccrtggaattttattgccaaaatatcatttttgtttctttaaaaggagaagactttttagtgcaaaaggaagattttgtgacagtgagcaattgttatatattgcccttagttctaaaataatgttttggaatatccttctcttgccacctttaaaactagactgaattctcatcttgcttcctagagcagcgtttcttctaaaaattttraacttgttccrttggctctacatacatttttgtcaatgccagtttagtgtggtagaatagataatctgctgcttactgggtgtgtgaccttaagaatattgctttgcctcatcaaacctgtttactcttttatggaatggtaataaaatactccctactcttgaaggagcctttttgagggattaaatgagataatgtatataaaagtggatagatccaaattacttactttccatctttttgaaacacttaaactttcagtcaaaccaatcactatactctatctaaacaacagcaggaagctgctttgctgaagatggtgagaggctgccgcatttaccagtggtatacccaggaacaatgtggcagatgtggccattcagataaatggctatgagagyagactgggggtgacatctgtcagtacattaattattagagatgatctggccatcatctggataactggctgacttagtatcccctccctcccttaccatgccatgtgcatcttttctgaagctgcrgacccaaggaaagagaatgactttcccaggtagaagagtcctccttagtcataggtccattcttcattagaacctccaactcagctctacctgttaaagcagctaagatattttggtacatattctggttttgttcacttgaaagatctatgcagaaagccrgattagacagagaggaaggtgatcgatgaatatctaagctaccaaagtagcagaaacwcacagcagaagagaaaataatagcaaactcagagctaagagcactaactcataattcatgcactgataacaagagaacacttatttcctgcagaggacaatttttaaaaggtattgcatatctatagttggaaaatttggttaggaagagtggcatcattccaattgttaccaaaattgcatcttggagaattctaagggaacagaaactttgcgatttctgcttgcatcagttagagtattaggcaaagatgatgccttcatattttgttctagatagccttgaacataaccttgcacacaatttaggatacaaaacttgcttttattataagaggtaacaatacaaggagtctggagagaaatcccatgtccaaaataatgggaatttattaagtaagtttataaaattatatatatatatatatatatttccttcrtttagcagatgattgatacatgaggcagattgaccatcctatatagtatcttccctctcctagcttataatgtcatttggaagataaaagactagatagacagttttgaaatagtgatacatatcattgaatactaaagaaagaaagacacatagtgaaagctatagatatgcactacaagctaatatgcttaagaaagcctttgtggtgggtggatcacttgaagtcaggagttcaagaccagcctggccaagatggtgaaaccccatctctactaaaactacaaaaattggctgggcgtggtggcaggcatctgtgatcccagctactcgggaggctgaggcaggaaaatygcttgaatccaggaggcggaggttrcaragattgcaccattgtactccagcttgggtgacaagaacaaaactccatctcaaaaaaaaaaaaaaaaaaggaaaaaaaaagaaagcctttgtgatacygggcagcctgtaaatcttgggtaggattgaaatacarttagtcctctacttacaataaccaacaacaaattttttactttattttggtgaaacagcaatatgcattcagtagaaaatttatttcaagtacccatacaaccattctttttttcacttttagcacagtacttaataaattatatgaaatattcarcactttattataaaacatgctttgtgttagatgattttgcccaaytgtagcccagcacatttaaggtaggtgtggggaagctgggatgtttggtaagtgaggtgtgttaaatgcattttcaacttacaatattttcarcttaagatgggtttatcaggatataaccccattgtaagttgaggagcatctgtaaccaattcctttatccgctggaggctgaggtttggccratgtgtaatcccagattggtttcaccctgacacccagcctgtttctagacagtctccccatttcagtcaacccatgcttataaaagggaaaaccattgtcctaagccatgtgttcttgagaggaaaagtttaaatcaactgtaggaaagagaagaagtgaatagtaagtactggttcattttcctacccaacttttagaggtagtgactctgccaatatgccccttttgctgatagatgccaagcgtttagaactgagctaatcagaatatactgcatttcttgttagatttcacacattattttgcccatcacacagctaggtttaggatgcagagacagagaactggttcctcatctttctttcactcttgagagttgcagatccctgcccaatcctgcctcgctccccaccaccacaatattaagttcagctctggtcattggtttcctgtcctcctcctccatctgaccactgggacartccttcargaaggctacagtctgctttgccactcagtatctccttcctgacaaatctttgccaycttcttcgttctttagacaacattatacctgttgtttccagagaagcatctctgatctactgccctactcaagggttgtgggcagcattaatcataaccctgagctaggtaggttgggcacagyggcttatgcctggaatgctggcacttttgggagctgaggcaggagaactgcttgagctcaggagtttgagactagcctgggcaacttagtgagaccccatttctatgaaaaagaaaaaaaaaaaaaaactctgagctaggggcctatgggctgaactgcactattttccaatatggaggtctggagttctagaaaaactagaaaactctataagaagtatagaggtaaagttgggtactaacattttttaaaatcatttttaatctrctaatgcctaatcttagcatttccaactgttaaaattatcaggtatttcaaacagtgagacaactgaatctgtttcattcccatagtaagtagcattttggcaagccctcttcactatactgtcckacctaaaaagacagccttccaaggagggtagaaagtgctcttggggttgggtgtggtggctcacgcctgtaatcccarcactttgggaggcsgaggcgggtggatcacctgagatcaggagtttgagacctgccttgccaacatggcaaaacctcgtctctactaaaaatacaaaaaattagctgggcatggtggtggacacctataataccagctactcaggaggttgaggcaggaaaattgcttgaacccaggagacagaggttgcagtgagctgagatcaygccacttcgctccaccctgggtgacagagtgagactccatctcaaaacaaagtgctcttggataaacattgttttgtaataatattgcttccatttatgaattttatcatttgatgataaaatcaagtgatcagtaacatcttcaaggaaactggcagatgtatataaaaagataatgactcatctaataatttatcacaaacaatagttagaaatttcaaaagtacctgaaaggtatataattcaattgtgtgttcattcatgcattcgtttattcagccattgtttggatacctactatgtgccagacattgtagatgatgctgaaaaatgatgagcaggataaatgtacctgcctccatggagttttcagaatgtgaaggagaaagataagatcacaattatttcaaaattaggtatttatagatatataactgctataaggaagattttattattgttgcatatcttttcaagcccaaacaaaagcattttaaaatagtcttaacagcagttcctgaggatacagtatctctgtcaactaccagaacagccaaaaattgagtctagtagactgacacatttaatcaacagatttaccagttttccatgttattctctccctagcaggcatactgatgtatgttcactgtttccaagctttccaaagtcatgacatccctgtcgctctgagagcagtgtgaccaagtcacataacactgtggatcccagctcagagatacacagtagtggttcacctgtggcttccttttgcctccctgtcctcatgagagcagcgactgaacagctaagccaggctggggggacccctgactgccagcccccttgctggcccatctgaggcacagcttctacatcagtgagagaaagaaacttagggaaaatcccaaagctcacatattgccttttgccagtgaaaaaggaaaagatgctttaacagtgctttctctggaaaagcctttgtgtgcttaatgatgtcttcatgtgcttatactatctccttgattccttgaattytacatggaattaaagctcaaccataaccccccatacacatttctatggccctccagctctgtcatgacagtgcagtcaattgctatggaaaatttttgtcttgtcttttcaggttagtgtgagaaatcattatgttgaattagaaacactgaaacattgtgattatagaaagaagagcttggttcaaatactcttttttattaacataaggaggtcaaaattacatataccagatgtgtttagctccctaaaccaaatgtgtcaaactgaagctttctagaacagagtttctccaagtattatgatgttatatcctcctcacattggctgtaagaagctaagatttttttcccttacttcccaggactcaggttaacattccaaaaagaacatctgcaaaaacaaacaaaaaaagtaaaaaacaaaaacaaacaaacaaaaaaacctcatctctttgaatctaaacaaatgctctggtcttttattttttcatgaatcttgtgtttaaatgaaagtttttttcttataactttccagtgtgataaccacacatcccaagagagctagaggcttttgtgagcttaaaaaaaaaaaaaaaaaaagaactttccaaggaatgtgattaatactacatccctaagcaagcaattaggtacccttgtatctgacacataaaaatgagaaatagaaatctataggcagtgctctttttttgtgaaagacactgyattgcttcagctgtttttcttttaaagtagggaatggtatcactgtttattctaattagaaaatacgtaaatgctctacaggtcaaaatcccagggtatgagayattctgtagggtttctctcttccttctttccacccctctcagactttctgagaaacatttccatattcccatctaaactccaaaaactgatgtagagtttagcatccatcrctttttcttggccctgtttcttcaatattcttattttccccctgcatccgagatgtttaatccacttgttaaattaagtagcacagaaatagggctatttttaaaakaatctgaaggccaaatccatccatttatcctacattatgggcaattaagaaaatggtaagacttggccaggcacggtggctcacgcctgttwtcccagcactttgggaggccgaggcgggcagatcacgaggtcaggagatcgaccatcctggctaacaytctgaaaccccgtctctactaaaaatacaaaaaattagccgggcatggtggcaggcgtctgtagtcccagctactcgggaggctgaggcagaagaatggtgtgaacccgggaggcggagctggcagtgagccgggatggtgccactacactccagcctgagcaacagagcaagactccatcgcaaaaaaaaaaaaaaaaagaaaatgttaagactgaaaaacacttaacaaatacttagggcaagtggttcagttggactctgatacttctctaattgttgtaatgtagagtaagaagtaatcctctcaattgtccttggaacctccttataaaaagtagtccaaaccttgcccaacagtctaaatgttgtatcattctgtcttcatgaaattgttgacataaggtwctttttccttctcttcagtttatgttttctcaaccttgtactcttaagaaccattaaggacttgtctcacataccccctttaaaaaaaaaaagaaattgcaatttccattaagtaccagttttatttaaaagcaaataaattgtttttaagtaagtaatcrtttttatracataaatttgtgttttcagtttgattcttaaaccatcaacrtttgaattacctagttcgctgggcatgggcccagaagtttgccttttagcaagcatctagttggtaacttcgcacactaaatggacaagaagcccaatatgtgtctctgaatgggaagtgttatttaattcttcaactcgtcttttttcttaaccaaaaccagtatcttttattttctgyagtatataattttcttagaacaaattgtctatttctgaatctacattttaaaatccacataattttatytattataccaaagaggttggaaataaaggacggaaagggaatacaggcttggaataagatgatagtgaaatcacaaattgagatattgttctcccttgctctgtggcaacagaactcakaagataatgatagtgaaagcttatgcaaggaccattcactggtaaaatggtaggatamatgatactgccattgccacttctcccgcagtgcagtccctcacacagcctaaaaccatcagcaytaccatrtactcttgttcgaagctgcaagggaccagaaagcaccgcactgtcacattacttctactttcctgttgactcctgcagattcgtaactcgggctccgctgacagtacagtccagttcatcttctatcaacccatcatccaccgatggagggagacggatttctttccttgctcagcaacctgtggaggaggtaatggtgttcacttagtctaaaaactgttggcttctgtraggaaatacttgggtattataagagtagagttacttcagcatggaagaaattttgtgctgtcttggaccagatcctttcttctgaacagagtggaatctcgaggccctcctgtaaggcagatacctccgccaagatgccaaagacattttctgtctgtaaagtcccattagaggaaayagtcttttttttttttttttttgagacagagtctcgcactgtcgcccaggctggagtgcagtggcgccatctcggctcgctgcaagctccgcctcccgagttcacgccattctcctgcctcagcctcctgagtagctgggactgcaggcgcccgccaccacgcccggctaattttttgtatttttagtacggacggggtttccccgtgttagccaggatagtctygatctcctgacctcgtgatccgcccacctcggcctsccaaagtgctgggattacaggcgtgagccaccgtgcccgaccgaggaaacagtctttacttctctccttgattttgtagaaggccagagctagaaatattctaatttggcagcagtttggtcctgaagcaggcaggtccattcacttacatataaactactcatgtggttgaagtaaagtcatctatttagcaatcaattaaagagtgtttatcaggcttacttaattagagaaaatagtttgctaccaggaaaaaaaatctctgcattttagacttaggctcagttatttttcaactccaccccatcatccatgcattaaaagaaatgccattcgttttattcattaaaatgcatctctcctgaaaagtcacaaaataaactcctgtctctgctccatcatatttgtaacacgaacagcattttgtgttactagaaaaggcttttgtgttactacaaaaggttatttttcctcattttctgctcatcataattatagtgtttacataataattgcattgaatttcccaataatttatttagacatttccctacagcaaatcatttagttcctttaacttttatgcttttataatacaatgaataacttaatacctaagtatttttctcttttcaaattattttyttggtataaatactcaggagtgagattgttagatcaaggaatttcagaatttttgtggctattggcacacattaccaaattctttccagaaggataacaatcagtgtgtgaatattttagattcattgccaactgagtcagtgtttgtggattattgtttttctaacgtaatggatataaaattatatgtctattcttttgaaaattagcacatcaaataaattctagctctagtttcatagaagccagttaattggctgactttaaatagctaatccacagaagtatcactatattaatttgacaagatataaaaggatagtacctgaaaatggagacaaatgattacccataaatttttggaaaacattgtatgatgtaattcatctttacctatgttgtttctatctacacaatgtaaacaaactactgaaaaatgtggttctatggagcaatgttggattttagcttaaaagaagtcagtagaagtgccatgaagtacttttactcagttgataaaaaactatcaattcaacactttaagcatttcaatagaatgagtgtttctagttgttccatctgtcatggatagaaaatcatttagctggccaggtgcagtggctcacgcctgtaatcccagcactttgggaagccaaggcagaaggatggcttgaggccaggagttcgagaccagtctggccaacatggtgaaatcccctgtctctactaaaaatacaaaaattagctgggtgtggtggcgcgagcctgtaatcccagctrcttgggaggctgaggcatgagaattgcttgaaaccaggaggcagaggttgcagtgagccaagatcatgccactgtactccagcctgggtgacagagcaagaccctgtctcaaaaaaagaagaaagaaagaaggaaaatcrctttgtttaaaaatgaactgtcaattactttgatgttccatgggaatacattattttgatatttttactaatgactggcataggaaatagtttcaaggaaagaatctaaggtttgtttttttywtaaaaaaaatgaaaaccatgctttgtgagaaatagcacttcagttatatgcacacatagagctgctattagagtgtgatgtcagcaaccttgataatcgttcattacataatagggacattgatgttagatttacatgtatcttacttctttgggcctcattttcctcacatggaaatgaagaagtagaactatcagtggttttcagatgtttctgggtatcaaatcttgcttcaaaggaaaccttaactatgaagccaggataaaaggaagactgttctgagtgaagatgtgagggatgtggagaccagctgtccttccactttattttgaaatgtactgaagttaccagcttgaaaattactgaagaaatgatctctaagttctcttctctgtttctggttccagattcaactggttggacattttgcttagtgtaaaatttgctactccaaataccttataaaactttagaaaacatgattatctgatgattttggtcatttccttcatttttgctctaactcttcattttatacacgctataatagcttcaaagcaacaggtttaggctgacaaattttgattttgaagaataatcatctcagattaataatttactgcattgttcctgtattttactacatgataaattctgtccctgtgtagaaattattatctggaaaattataaaataattagcctgttataaaattagatgcttttagagtacagtgtaattgaaaagtaaaagtgcatttacttacttaaaatgtcattttgctacttgatttttttataaaacaaatattggatagaaaaagtgttcttatccattgctttcgttacttttcatgcttttcatctttatagtcaaattttaaaaggccttttttttagggtctttaatgaacaattaatttctgtgggtggtctgagaacacagccttaagccaggaaatctggctcataaacctccttctgatttcctaaaatcttttgcaagtcccttaatgatttaaatcttgcttcctaatatgtatttagcaataaccgtgttcaacccacctgctagggataatgtatttggcagattgattagggtaagaatgatataaaaggcctaatttttwaaaattctctatgcacatttatttttcaccccgagaatctaagtcttgatcaccaccctaccagaaatccacaggacaataaaaaggcaggtaggaaagataaaacatatgaaaagaattaactattactcaacaatactttttttaagagaggcttctttaaacagtgacaatttgtgggtggaggctaagaaatattcgctagagactttttaaagagaatgacagaagattttgaatataacaaaaatggaacagtaacagggaggtgtttttactaattctgcagggaaacaggattcgtgatgtctactgttggaatctcaatggtacatttactcaacccactcaggttgaatttgggcaaaaataatgttcccaggcatctggtggaacctgatcctgtgctggccccccatgtgcaaggggagcaatgtgggatttattttgtttatctatttgggagtttattctccctagtgccccaggtactaaggaggcaatttagcattcttgtataagatggttggtaaatcctgatgatcttttttggacacagaattctgcattatatttttagatcatataaaagaaataacaagaacagttcttaccagagtcttattatctggctgggcccttaagtagttcaagcctaattatataatgtaattattaagatttgagtggattacttgagaaaagcacagtacttgaggtctgcaaaaattaatgagccttccaattatgtgtcttttttcctggaaatgactaaggcattggggaataatttccaktgatgtgagctggccaaaatgcataaagaaatatattgcattggcatgtacatttaaacttgcctggatggtttgatactacaggttatcagctgacatcggctgagtgctacgatctgaggagcaaccgtgtggttgctgaccaatactgtcactattacccagagaacatcaaacccaaacccaagcttcaggagtgcaacttggatccttgtccagccaggtcagtcaaatttgctagttcatttgtcataaacataactcaagttccaaataggttatttaaattaaaatgaaacgttttaattaaaaataaaatgaaattaaacatcaatagtgttgctgtccagtgttcattactaatcacgtgttattagtacccatactccttgctctggctgctatgcgaggccatctcggagtctacagactccccttttataragcagcaggtgacatgctcttcagagtcattttctcttctgatttcctttcattctggttccttgtttctttccttaacaaggtccaggccaatggaccactcaacgttcttaaccaatgtgatgacacaatgttctcaggattttttccattttatctctattcccgatcagggacaagatcagagcagaccatatttcagggccacagctgatcccttctagcctgtccacactgattatatagagtcaaaacaagccttagaacagttctgctgcctttgaacatactcagtctttgctaaagagaaagaacttattctcggtagtcagattcttaaaaggtctttgaaagtagaagctttaaacaggcacttgacactttcacacatgattatttgctttttggaaactacagttagccctcagattatctgcagggtcaagaatctgcctgatgaatgaattatctcaagtgaagagtagtcatggaagtgcaggtcaagaatcttttcataggtgtaacgtttgcctttgcagtcacaatacttgctggtgattctctttagtatagtgtagcttactcatcctcaacttatgagagagaatataagaaaaatcttcccctagaaaagcaatcaggaataccaaaagacaaagattcattttcaaactccttggatttttgagaaacatctcaatgttattttttaaaatcatactatactgatgatgtatgcataaaaagaaagcttcatctcattaaaatatgacttgggcaatgtcgatgcaaatcattctattttgaggtgataagcaatgcaattttagtttttgttttctgctgtcaatttcttgaggtgtatattcctctactcttttatctttatatttatgactgttaagttctacatgtgatatgaaattgctgttattaattaattcacaggaaccatattccctacctcataaaagtgaactcagaataacaggttttcattaaaagaacaaaaagaatagatattttataattgtaaaatttaggtgaagtttaatttagcatcatattacatcagaaaattatatattaaaaattggatacgacataaaaactgaataaggtgttgaaattgtgcttggatttctttattttggaaatcttaagggtttgaactttttagccaagacagttataacccatgcaatttgatttcattttaaaattattctacttatatatttttatgcatarctgtaataggaagaccagtgtgtgaaaggcacagttatcctaattcagacaggtcaagtcagccctwgagagaccttgaaagtcttttacacatttccatgaaaatttgtacgtgtatttctaggagaaatgacaatttcacttcccacaacttcataaagcttttttccacaaagaaaaaaaatgtcaatcaagagatggccatggaagagagttatgtgaaataaaagcattttgttaacaatttgaaagaaatgtttataataatgtttactcaatctttcttgcctctgatttttacccactcttgtctgttggagaaacttttttggcctatttcttattacccaaagcaaaaggccattctgcagtgaaagaagtctgcctgtgcaatttatgccttttctatgtccagtgttattttaaaacatttattacagcacatgagtaaatgttgggacagttggctatgtaaaaaagaaagacacaaagaaagayaagtgagaaaagggaaaagaaaaaataggcaaatgtcaggaagctgcttttttttattgaagaagtaattagacaaagctgagaaaattaagacttagcagtaggaaaggtctaagggacagctgcttccgaaaatgtaagtacgctactctgaggttaagatacttcagaaattgccatgaaattcattgaactcttttgcatacctggaatcaaagcaacccttctgaattctaagagaaaatgagaagtgatgacctaagaaaattagatagaatagactccagaaaatagatctgctcttccatcagacagtgcagaatcaaacccccaggaagctgttttctcactcagatttaatggtctaatagtaaaatcragagtgaacaatgacattcaaccaacacttttgtgtccaaatttagaaattcccaaaagggaaaaccaacgttcttggtataaagtcacatgtttttaatttcaaaagaaatttattatatctagccactgagatatttattcatttttcctgaatcacactaggatttttacctattttagtatttaaaagtagagtcccttgtagtaagaaaagagaaggaaaaagtaaaaaataaatttaaaaagaaaagtcccagttagacagccaactttattccctatcaaggcttgcatgtgtcattgacagcaaaaaccgcattaaacaattaagtctataaccttatatttattactttacccttctgggcttccattttctcacccaccgaatgggaagagagggtcatttgttgttaaattaatggttttcaaactgtgcccacagagcctgttgttccacagttttttaaattaaattttgttttatatattttaaagtatttttaaataataattcacaaaaatatattcaaacatgttaagcaactaattttaactgattcacactaagttaaattataaaaattatcacaattttaagtgttgtactaccgaagtaaatgcttttgccctcatcattaagttcctcagttatgtctagttgaaaaaataactatcctaagattgcaaggtaagctgtaaaaacagttttcattacaaaacactctctgtgataataagaattttctcattactacatatctaaaaccaaaacaaagaagaaataaactagatatggctaccagtagccataatccctgatatccactttttgtgtttaccaaaatagcttccctattctcattattttgctttataataggtaaacattatacatttgaactaatcaactaaaatcataaatatcatcagtatttggtctatatattttggtcttttacacaatataaagcctcccaatgaccaggatgtttccagtcactgcatgtgattgtgtccacagtcccttccaacttcaaactcagtgactataaatatcagtcattattttagttttaggaagtttacaacagcttcctaaatacatgaacaacttctaggaattgtctcaaatcaacagagaacaggcaaccagtggcatggaggggtctcaggaatatctcactctacacatctgtctattttttggttctcattctcttttccttttgttcccaccatcttctttctttactttcccatctcattttttgttcctcctccttacactcactgacaacatccactggattccatggtggtggattagttcatctactagttcttgaggctgaagagattgttgacatctcgcctatactcttcaaaatactttttatrttttcatggcttttttgctgattctaaatgctaacttagaaatattgataagttaaaagactgtaatgaaaacaatgaactcactaataatccccaatgcccgcagataacctctgttaatgcttttgctrtatttctttccagtcttgtctatagctcataacataattgagatcatactttatacagtagatacttggcattgaataatttggcattcttggttctcattcttctaaaagcaagcctgaatatccatgacacatagtaactcgacattgtgctgaggtaggaatttaagttcactggactataagaccaacaattgagccatgctggctgcccagcagtttcatcccaagaaggctttgttgctctctgctggtgtcatttacacagttatttttctgaagtgataaaacactttgtttcctggccaaaagtggtaaactaggagccaaaatttaatccttataagggaagtgaagagaaagtaaagtataaagatttaatgacttttagataaaattaataaggcttttcattagagactcagagctatgacatcactaagcccatcatatgctctgtacacagtgtattacatgttctactggtagtcccaatgggcattcccagaagtccagagacacaccctcctgcatgtcagggatctaccacgtttgttttctgcttcatacatttaacactatgttmtgtatgctttcccatgtgactaagacatttaggatctagtaaaatgtaaaatcctctcttgtgcctaccatggtataagcaaagcttctgtcttacgccaatggaaatatttttggaatttgtgcaatgatgtgtggcatttttacctcttgggtgaaaggtcaggtccatcatgtggccagaaagcctcaaagtataagcctgtggttcagcaacaactaaaaaggcatagcatgaatycagctaataaacaccttgatgtttcaaagcagctttagatgtaaaatatacaacatttagccttacatatcttaatctgtgagatggtgagacagttaaggctgtctggaggaaattgtgcaagttacactttgtgagacaatcagagaaccacctttgcagattttctttttttttttttttttggcacagacctttagttttctctccaaggcagtaatgaagggggcttaaattggcaagaggtggacaagtgaaaaaagatctcactcatcacactatcacggccacaattattagcaaacaaatctgtttctagctgaaactgcatccagattcccccttccctcaaggaattcagagcaacagtcctaagcaaatgcccaaacttgtatacccccaagcggcaattcttggcaagtttaagtgaactttttttttttttttgtccagctccatttagtttcacagtaaattgcataaattgtctctggccaggaaccaaaaaaaaagtctcaaattctaatgcaactatgaagaaataccctgtattagaacaagtgttatgtgtagtaggcatgtaaaaatactgattctcacaccaacttggtgaccaactagtcaatggcaatatagcctgatgtttaggagtgggagctttggcataaaacgtcctggcttgagaccctggctctgccacttactagttgaatggcctttggcaaattccttattcccactaagcctcagatttttcatcctacgaagtgaggataataacaatacttacctcataaagttgtcatgaggaatacatggcataatacatttaaagagcttagcagagtacctgastcatgataagcgctcaataaatgttagctgcagcagctatatartgactaagatcacggttatgatgatgttgatgttagctgagagaaactcttaagctctccagaaatcagctttctcatccatgraaggaaaagatggaattctagaattctgtatgggtctagaaagatggttctctgtttgttgttttaacaacaggaactgtaagtcctaggaaaatatgatcttgagagtaaatcacatttatcagatttttwwaaatataatgatcacaagaaattaagataattggcaactcctgaagtctcagttcacaagtgtctgataacctctactttaccagctgtgagacattgccatttaatttacatgggacttaggccaggtatgtctccaaaaaaaaaactcagtgtaaggacaagaaatggttgacttatttagcaattactgtataatgaaatgttttcttaattatggaggtctttagttttactacagtaagtaaatgatttagaaaagtaacaacttcttaccttttgatcaacctcatttaagtaactgctttgtgcagctaataagtaaacaataagaaaaaaatacccataaaatctcatttccacattcatgtattattcataatgagataaatgatacaaagttagggtgcttcttagaatgcatgatcatacccttcccatgcttatagatacaccacacatcatcagacaatcacataatcaactataactcaattatctgggaaattcaatttactacaaagccagatcattcctaatagtagtatcacttcttatagtacactttaaagttttttaaagtgtaattatttgtgtaattcttttaattggcctgtgagttaatagagtaggtattatttccatccttatttttaacttccgtctgtcagtttgtagccaaaagactttactagctaagtaacttcttatctaggcctgagttttgccctctgtaaaataaatataatattcctgtcagagagtaactgtgagaattaataagacaacatatgtaaagtccttagtgaggtgccaagcagtcaccaaacatcagctatcatgattgaattgagaaacagactggtaaaacaacttgcccaatgtcacttctgtttgaagtttataaggtgccttcacatccattatcttatttagttttacagtccctaggttagcgggctgggggttgtcacctttattttacagatgaaaaaactgaagctcagagaggttaagtgttagggccacttggcaaaagcaaattgggatgtggatctaagttcttccagttctacagtatctctacataaagacaggcataaaggcaggcaacctgatgcctggtgcagccttcatgccatcaaatcccacagtcatccttgttctgcataatgccttaagcaacctatgagatctggttccagcccaacgtagaacagcacagccagcacagaaccattaaccataacaatgccaagtctgggtgtttgaattgaccacatacccaggttaggcaagcctctttcatgtaagtgtaaatactgacgtttactcaaatcaaacaatggctaaatcactcagtacagaaagaagtaaacaaagaccaaggaaatattagtcccacttatttaaaagcagttcagaaattacattcrttaataccaagaatgtttaaccccacaaatgtagatgtgaggaagtattcaatgatttgacccaaattattaaaactcttcagtatttagtttattacagaaaatgaatttgtgtccaaaaaactgttttcagatctgcataaagcagactccttttgatctgatttcggtggaagcccagataaatgaatgttgctgcttagtttatggttttttaaaaatgggacctaattatagaatattttccgatttatgggatcccaacgtgcctctgtaaatgttagggaaactctctgtgttttaagaagtcatgaagtgtcacaggaggtaaattttgagagaattatcttagttcagtggttttcaagctgtggcccagtaagctctgagttctactcttagcatacactaggaaggggcaggtaagatagagtccaatagcatgggtttccaggcacctactcttacttcatcttaaaacttctgatctcatccagtacttagtttttgcggatggccaaaccttgatgtaaggtattcaaggttacatagaaagaaagtagcagagaggagtaytgaccttccaactcccagcctctcaggtgatccttttcctcattatggccagatcctccatgctttgctactcacgaaatagcaaagtgcttgtatgtcttccaactttttattacttctttcctgcacccttctaaactgttgcttagaaataggctggtttctattgccctgaggttgtctagagaagatggagcaccattttctatacaagagacccttctactacacacaattttgttcattttttaaaatatagtcacctattttgtgaaaggttctgtgcttggtgccatggcaaaggcaaaaatgaatcaactagagtctgggcccccacactgtccagggcaggttgagttgtccaaagcagcacggtatctgaaagacacatgagaaagagagaagagaagatcttgttaaaagctttcagagttatatctgggagatagccaatgaaaagatacagaggtaacctaagcaggatggaagcatagtcactaatctgtcctttctctgctcacatcagccaatcacccccgcttgcctgaacagccttcctaaactgccagaccactctccatatcagactgccctctctcaaagatggcagggccagcaaaaggcaagacgtgggactgaatatgtgcacaacagtggcagtttgggagtttctttccttcctttcctaactagcttttaaaaacttgtttttgcttttttgttttaattttggatgtggttgcattacttgcctttgcatctgcacacygatgacataagttcactcaatgattatttactaatcacctgtgtgcagaacactgtcctaagagatgcagtaaagaaccaatatagcttctgcctcatggtgataaactaaagaaaaacttgtgaaatagttagaagttagtacagttggccctcagtatccatgggggattggttccaggacccaccccacccccacctccacagataccaaaagccacagatgctcaaatgccttccatatataaagtggtgtagtatttgaatgtgacttatatccaccctctgtgtactttaaatcatctctagattatgtataataccttataaaatgtaaatgctatgtaaataattgttatactataatgtttagggaataatggtgagagaaaacatctgtacatattcattacagaygcaactatccattttttttcttcaaatattttcaggctatggttgaatccgtggacgcaggacccatggatataaagggccaatagtacacagttaaaagtgaggagaggagttagtattaggggtgttaagaagaaggagagcgaatttctggctagatgttaagagagaaaataggcaagaatttaggagaagtagcatttgactaaaaaatttcactgggcattatggaaccatgtgagtcttctaaatggtgaggtgaagtatcaggtgctttggcagcagagtaggctggattgatttgttacgagactggtatgaaagtgcccaaacttgtgtcaggaggagatctacttggcaaacattgctggtgtcgagatgacaactggaagaactgagtggtgaaggtagccccagtgtacagtggataggagaattgccatgactgaatggtggtcgtgataacaggagaagaagcaaggccaaataatgaattgtctgggatgcactgagcttgaaaagcctagagcacatctagttatcaggaaatcagaaacgaagatttgcagttccagagaagaagcaagaggtcatgagagattcactgagagaaacccttgaaaccatgaaaggatctctttatggttcattttcattataaaaagaacagaaccggccgggtgtggtggctcatgcctgtgaggaggccaaggtgggcagatcacgagggcaggagwtcgagaccatcctggctaacaaggtgaaacccyatctctactaaaaatacaaaaaattatccgggcgtggyggcgggcgcctgtagtcccagctactcaggaggccgaggcaggagaatggcgtgaacctgagaggaggagtttgcagtgagccgagatcgcacctctgcactccaacctgggcgacagagtgagactccatctcaaaaaaattaaatttaattaaaaaaaagaacagaaccccggtaaattaggtgcccatggarttaactactttaggatttttcttgtagagagagatgtatctcaatagttatattctacaactgagcagtgtgagcccaattttggcttgtttttttttttttaacactggggactctgttctaaagtagcatcttagatcacttctgcacagactcaatgatcttgaagtaacgcatggaatttgaggtgatggcctcatttcatccacttcatagttccaaagtttctgtcttttctttcttagatttgaattttttcatacttgaatattctaattgttgtaattgtaaaaggtgatatattatagaaagcttagaaaacagaaaaacatttaaaaagaaagcaaaaagtactcataatcctaataccaataactaaccactgttgagagttttttatatgtgtgtgcatatatatgcatgtatacatctgtgtgtatacatgtgtcacatgaacacacatatgtaagttatgaaaatgcatagatatgtacaccatctatatattttctcattatggtcaatcatattgtacattctatttcatattcaattatttttagttgacattacatttgagcatttttccatgtcattaaaaatgactcaaaaaccattatgtccatgtgctgcataatgtttcattatataaacttgtcataacactgaatcattctcctgaattgtcaatggacaattcagtaagacatgtattttgagaggatgaggtgggatgccttttctactgatagcacatcactccagaatgatcacttgctcatgctcaccttctcttcttaccaccacaacccctgatgatggggatattasatggagtcatgttactgcccagtgtaagagaaacaatgtaagaactgtgtgcctggtggtcagcataatgaaggcactggagaatgagttttacccccaagccaactgtttcttctatcttttccctttgtgaccatttttaaaaatcatttttgcctccttcaccacaccccacatattcagatgcatgtctgaatgcgtgcatacatgtacacacacccacatcgagacctaaacatggggagaacttcttaaagtcccgaaattacattctttttcattattctttatgattcacactttgcttaagaaaaaaaaaaagtaagcaataggaagttaacttcaggcaagcttgctttctcccagcaacagtgtagtgaaaggctagggccatggcatgaaccccagagagagctgagcctatgtacacgaatatgtattagcaggactggacagagcaccattgttttgatagctttctgttttcacaggtgctacagagtcactttatgagtcttcaccatgacccatgtcatagaaracaaatatagctatagttttgctgaatccaggtttaaagttccttgttcaaacaaaaacataatttctaaatcggtccaaagcaaagttcaacgtcttgaattttgtacactctcccttttattctccttcacttcagcttgtctccttcagtgttactgcctccattttaaatatcatcagctgataaatcaattgacagagatctgcaacagtttattctaatattgaagatgacaaattacagccataaattttttcaggagagaaggcaatggtatgcatttctgcatttagaaattgatgtagcatgaataaagatactagagtaatgtaaaatataatttcaaagtcaacttgatttattccttaattgactactattagataacagtgtatgtacaaacttactagaaggactgtggaagaggattggcattctttaaaatatagtccttttagaaaaaaaaattccctttattactagatgtaagaatgattcttactagatgttagaatgattgtaacatgaggaacgattgagctttcacctgatttcttatcatctgtcagaaggtagaaaaaaatrggatggttcactcaaaaaacagaaaaggttaaaggctgttcatttcattcttgtgtgaagaactgtgggattttgagcatgcccaaaaggcagcatcccttttcttatacattgttactgaaggttaatacacacacaggcacacacacacacacacacacacamacacacacatcatgaaaattttctcacacaaatgaatataaaaaacttatttacacaaataaatacagaaaatttagtcatgtaaaataaataagttagtactccaatgaccttccctcctggaaatagatatccatcttaaatgctttgtttcctattttttaaataacaaaatttgacttctctcatgtatcccctaacctttcagtaatttcttcagaaactatgcaggcccctttatccctctctctctccttcttacctttcatcatctccagccagtgctatttttatctctgtgatccacactcacggctcactgtttctacccaaacacctgggtttgctagccatattttataaacctactatatcatcttatatcagaggaatgggtaaaaatggaagtatttatttattaaaatataaagatcaacatatttatattgaatatatcaatattatatagatatataaatagatgcatccatctatcccagaggcacagatagaatacatgagttccttcaataccccaaagaggggctttctatcatttatcagttgcaaaataagcatcttccacttatgcactaccatgctctacatctgtgcatctccatctcccactcttgatgaaggtgctgttgcactagcggtcttatccaaaacccatgaatcattagtcctccacaaaccagaaaacaaggcctctgcagggacccaccagtcttaccaattggagactttagttgaaatcagtgaagtaggtcagagtagtttattggcatcctaaaggcctccaggaacctccacacagcctatgatatatcttgtggatcctgagcattcactctgtctctaaacctcacaggtttcccagggtcctagaggtactaacaagccatgacaatcacaaccatcactgcaatagcagttaacactgtacaatattttatagaccacaaaaacccacttttcataatatctcattttaactgcctacctttattttggtaggaaatttgcctttgctaatagttgcctactatgttcagtagtttccccctccccttataaaatacccaagtggctactttccargtattagtgaaatccctagatctgcsaagagaagaaacctagctaatgcagttacatagtattgtcaattctgaagtacatattctccagcttgaatagctctctctttcatcagaagtgagacagttactgtaattgcttggcgagcatctggaagtaacatgaataatgatgataataataatgacctcataggatgtataatttggggattaaagaacatttacaatcttatggtgtcatagttaatgatgaagtgccaagttttgttgccaccaccctttgcaatggtatttcctgcttggatcagagaactaattatagtaaatggtgccctttcaaagaacttgccccatcctaaagcatatcctggcataaagawataaaactgttttagtgttgttttatagatacaatttattaatgttattttgcatttgtattaaaaatttgtataatgtaatcatttagtgtttattttattgtgtgtaccttctactcagagggttggcattattgttcctaacagtgacggatacaagcagatcatgccttatgacctctaccatccccttcctcggtacgtaaatcaatcatcctgatgttagaattagcaaattagtcttctgctgcttatctatatatakagagatatacatatacatagagagagagattatatgtttttaagatggtagatggtatattttgcaatccatcctgagttctgcttttgaataatactagcctgctcagactgtaagcttatcattcaaaaaccactttaaggtagaatcatgttacactggagtgaaaacagtaattcactctgattagrtacagtttatgggtttatattatgtctttctttccctccctttgttcyttcctatttttcctctcaataggaccctagtcattaaagcactgttgctaactattaaacaaacaaacactgcctaaagtattattgcactaccactaacatggaattccagatgtgatattattctgcataggggctttaaatgtccactttttatttcagataaattataattaagtataaaaggcaattttttaatattcttattgttcaaaacattttaggagacattttttctaaacaaaattcaatgtgctgcattgcttttttaaagtacagtacttytgaaaactagaaaaaaggtaatgaaagtaactcaggaacttttaaaagaaagtgttccctttataatatattcataagaaaaccggagaagctgaaaaatactctagctactgagtgtgttcactgcattggaaacagctccacagagagcagaaattagaattgggattgaagtagacctatgctctattttctttgcttatttggccctcagggagtcagctgctatttagaaccaagggtttatatcagatcataaatggttggagtaatccacagcagcctgctccatctcaaattamaccaagcccagaaaataattttattttgaactgtaagggtttgatggaaaaatctccaaatacataatgaattagaatccaaatagaggtcccttgacgtcatctagtgcaactccccattgatgcttcattctcccatttcttccygaacaatcacaaccatataccacagatatgttaaatatatatttacgcaaatatgcattcatatattcaatgcatatgtattcacacatgtatatacacatctatcgatgtttatataatacatatatacaagtgaaagttgtcatccagcatctacttaaatatgtctagtgactggcagggaactcatttttcacctaatgatcacatataggaaaggaatttgacttatactagatatacttcttgtttttcttgttatttttaactctttcactacgtggctatgtcattagtcagctcactcctactttcctatgactatattgataaagacaataaatagctttagaatgttcctaatgtatcatttttctggttttatccagaactcttgaccttgaaaaaataatgaaatagcaaaaamttaattttttgaagtaatgaaaatagcaaatgattaatttaactgaactaagatttcatttggtttcaatttctgtatctgtgaaataaatgttcataggatatatgtatctgtttgtatgaaagccatacatttcattatttcaagataaaggtaaagttggacctcaggagtaagcaacgtcaagtttatgtttttcctgtaaaggcaactcctagatttctgttttatctgtgatctctcttgtttatatttctctggcataactaatgcctatattasgttaaaattgatttcttataggttgggatttttctccaaatgcctaaatcccaatggtatattaaaacgatcctcctgggtgtgtgtttgtactatgtccttgtatacactcttggcatgtctatgtatcacaatgggaaagaacaataaattttatttcttacccccttgtatgtctgatactgaactagttataaagatagatattcagctttattggcaaagtcttagtaaatggaaactatttttacaactgtgttttcattcgtaagaagaattaaggctcaaaaatggttctcaaatggcagctacccactgatcaaggccatttaaattatttaaatggggttaagaacacaggtatagatacaaaacacaattaacatatttttaccttgttctttcctgctttcagtccttgactgtaacacatatctggacataatatgagaatgtagtctgaataattgtcttgatttataattaatctatgccactcttgtgcatcctgcttaatttgagaatttcttaaacacactctgtgtttaaaaaaattaaaagccaaaagaggctaaatgtatgatgtataaattcattcaatgttctccaggataagattcttggatatgtcttttttttattccaagcacttacctggttaccatcttcagatctcctgacatgctctctctcagcttttgttacgctttctttaaagtacacaaacatgttttacttcaagattccacataaccctattattatacaagtattcacatgataattttctacgcatagaactgtagttgtatgctgggaccatagtataaatttttgaaataatattgcctcatttgtctttctatgatcactgacattgaaaaagatacttactgctatttgtgaaattacactatggtcaggtccaagtgctgagacagaaataaatcactctccctttagtagggtcaagcttaagaattttagagtaccaattagaaaatgtgctcttttatagcatcttaatattctaagtgattaaatgtacatttaaaaacatattcctacttcactgtcagatcaaatctaatgtgaatacatacttatgtattcaacccaactttaatctgaatcaggcctgatattcatctccagaaggaagccctccagagatttatgtggagacaaaggagaattggtcttacccattgggaagagaaactctctacagagctacttcattctcttgaaagagatcagaaagtctcccaagggccaaacagagggcctcagtttccccacaatgacattttcttatgtgtctcctggggaaatacacataggaaaatattgtatttggcagcatgtcttggcttttggcaggcagataacagttgttgcctaaacttgaacagtgcagagaaaatgtgaaggaaaaccctttgtaactaggaaaaacacatgattcaggctcatgcagaagagaaatcaaactcacaatgtacacaaaaaacccgcctacagaataattaatgtctcaatggtgtgcctgtgcaacattttaaaattttaactattcaaatggatcaacccagtgacattttgtttctctcattaaaattatatctctcataattctaagagaaatcttaaatctccttagcaatcctcatcaataagcagaatatatgtaaaaaagaccagctcaactcagtcccaatgtttctgtttttagaaattctacattctgtaaatctacaggaggagagaagagaatttggcaaagatatctctctgcatctgggacctaatgcttcagagctgtgtaaagctctgaaaaaaaaaatcaatggaagtctcttaaatgttttgacaatattgttattttctaccttacttaactatatgtctactttcagatgccattagccttccaactcaaaccaaacctcttcacagttccaagagttacttactggaggaactctaactaccagtatccctcaacagttagggaatatgtagataatattaacgcttctgctcctcagcttaataatgatagcacagtttgaacatcagaattgtgctgaatctaagtagtcccaaagctgatgattgcagaagcaaaggagagtcttttgtttaccttgatcttttatgagcttcttctattaaaaaaaaatacctagaagttaagtaataaagcattacattgaaaataaaaagtatctgcaggtgcaaaccattagtgttaactgagtataccactttagtcttgagatggatacttaatgagtttaatgaaaataaattttatatatacatatcctgaaactatgggagaaggacagaactacatcctacatcttctgagtaggttacagacggcacacatatctttgtggacagctctcaaaactgtaatggcttacatttgtatagagcttcacggtttgcagagcccttttgccaatgttgaatccttctctcttactcatcaggtttcaggcaatagatggcttttggttttctggaccttagcctctcagaacctgattataccaatagacatggggagtgggttggtggaccagtcactgaggaggcttagcaatgtgcatgtctgccctgatgactccccttgcttctgtaggtgggaggccaccccatggaccgcgtgctcctcctcgtgtggggggggcatccagagccgggcagtttcctgtgtggaggaggacatccaggggcatgtcacttcagtggaagagtggaaatgcatgtacacccctaagatgcccatcgcgcagccctgcaacatttttgactgccctaaatggctggcacaggagtggtctccggtaactgtgccttctttctttgttcattaggagagtaagtccactcttccctctcatcatcatggccccacygggtaccctgagcagctccacactcttcttgaggtgtctagaagcctaccagcttagctcctggagtaggaatgccccaaatccagcatgacsaaaagtaaatgatgtttttttaaagtgtctttcttcaagtttcttcaagaagcctctattgttccccagataatgttccctcaaatagcacrgggaagcaactgcctttcaagggtaattgaggctgaatgaatgatcccgaatctgtaaaagctgctttgatgatagagctcagtagaccagaagtttgatttcattttgtatgtattatgctttgtatccgaaagggtctaagtggattaatattaaaactatgtatattaatcattggagaagggggaagaggaaatgaaaatagcacaaaaattaaaattggaacgaagtaagataattaaaacaaaaaacttatagatgttaggaaacctgctgtaattaaacataaaatgtcattcagggtttcctgactgctaatgcagaaaggaaaatcgtaaaggaaacagaaagatgaaataagccattgtgccctccgcctcagaaatgacaaaagactcttcactgagccctgtggcttcatggcagcagatcagagctgtgacattttctacatctagacatgctaccagacatggggaaccattagaggtgcaatctacattgggcatctggtcattcaatctgtttttttaaatgttatttttgcctttcaatgtaatcaattggattaacaatgctgcaatataatttagctataatcgtagtttaaattttttgatatccatgtaggggtatttcccatatttttggaagtagcggtcattagcaaagtaactaartaaaatacagtgctggtagtcaaaattaagcacactctacagtctcttttctcctttcttctttttggtgcttggtttgagactttgcacacagtgggtacttaaagattgctgactgattaatccaaagctatggaattgaaagtgatttaattttcagcgagcttcacctcaaatagccaaatagaacaaagatcccttgactggtaagaagtggtataaatttaccaggagtcctcgtgwggggggggggggggcggggaaaaagaaaacttagattaaaagttttcgatgggaagtgaagaaaagtaaacaaggctttgcctacgagtctcctctctcttgcaatctctttccagtgcacagtgacrtgtggccagggcctcagataccgtgtggtcctctgcatcgaccatcgaggaatgcacacaggaggctgtagcccaaaaacaaagccccacataaaagaggaatgcatcgtacccactccctgctataaacccaaaggtaacttgacaggtgctctattaccagcctgttaattgttgtgtgtagtcaggtgtgttttaaactccytggaatatttttaagtatcccaagtattcttagtaagaattctttataacttaaactctactaaaggaatttgattatcttaaagaatctttcaagtgattttgattgcaaaatttcattaaccactacatgtagaaatatatttatataattatctcccaagtcataaagttgtttgaggactattgctgaagaatacggatgtacctgcttaaagggagaccagatattctagaaatatatgtttgatttactatccacatttcttgcctttaaaaacaagggagtgaayccaagtatgtctattttgctaaggctgaagtacmttgggaagtctcatacttcaaactgatgaaacagaaaactgtcactttttatattgaaaattaaaacattaatatgagactgaattccagaaccataatttaaaatatatcagaatttaaaagatattgcaataatttataaaaaagaaattttaggaaagtgtagaactaagcatttagtgagccagacttataattacactggatatctcagattagcaagaatatgaatttgatttctgtacaagtattgttacttgtctgtgtcaatggaaaagaaaaattcaaagtcacaaaccattcagaagtaaagaactctttaaaccccctttaatttttaatattaaatatggctcccatttctttattttttaagccattaaatttctctgaaaaatcagtcacagtgtagctctttattatactataggtggccctaattgcaactgaatggcatcataaaatctaaattaatgatataaaaggaaacaaaaaaaaacagaaatcctgattaactttaataaatgcatctctctcgaagccttggtttcctcctctgtaaaatgrgtgtaataatagtatctaaatcagagatcatgygtaggttaaatgagatataacataaacagggtggttaacctagtgcctgcaatatagtaacttctacatacagtaagttacttttaactcctgactatcgtcagtgccctcaactatgggaggaggttgccacaggtgcgtctgacaggatttagttcaaaacagcaataaagtattacaagcttactatgagtgccaaactgaatgcttccttattgaragacagagagctaactatgccaccagagacagcttcatttactgaggttttttttgtttttttttttttgagacrgagtctcactctgttgcccaggctggagttcagtggcgtgatctcggctcactgcaacctctgcctcccaggctgaggcgattctcctacttcagcctccggagtaactgggattacaggcgcatgctgccgtgcccagctaattttttgtattttttttttttggtagagacggggtttcaccttgttgcccaggctggtctcgaactcctgagctcaggtaatcgcctcggcctcccaaagtgctaggattacaggcgtgagcctccacgcccagccgactgagtcatttactgggatagttggagtagttgtaaaatgatgtatgtataggtayggtgttgctgtgtttaaaatgttagcaaatcattttggctttggcagttttatatttctcacttgctttgttttttgactataaataattgctgtgyatagagaacaagaagtgatgcccctaacttaaaatagtcaattgtttattagctttatctttaccaagccacttcagagaaagaaaagcagtttgcagttaactatcaagaatcaagtctggattttcacaaccaaggagtgagcctggctctctaaacatcattaaaataccatataattctatggtgcatatatgtatagacatatttctttcatctttgcaattgtatgttataaaatggtgatagagcatcattggctcatactataaaggcaaatatccccataaatgaccctaataaatatgctagaatgggaatcttggcagttacttctgtaagagccgttagaacatccctcttcatttttctcctccacaatttttttcccaggaagtaactaggaagtttgttttgaattgtttggccaaagctagataaataggtgaaataagtcaaattatgtgttatgaaccctcatttgcacatattccaattgtcagtgagccttggggtagtactgaatgagtcagatatctaaatcaatgttttgtgaatttcagagtgaaagagtttgtttttggcaatgtgacatagatcacacttagctaaaaggcaaaaaaaaaaaagttagaatttatgaaaatatcacaatataattgactgtactttgttttccaaggtaaatgctgctctatcttttcaagagggaatggtaaaaagatacttcgatgattctttatatgcatattgagctagtgctcctacacttacaactttcataataaaatgactttcctttgctattcatcataataaagagaaagcttgcacacaaactagtattattaaacattttaaaattcgactttatttttctagatataaccatcatcagaggcagcaatttacccaaaaacttattcgtgttggtcaacgtagtaacttcttggtgaggagaataaggaattttcctaaaatcccagattggttctaacctcttcttttgtatgtgcatgcactgaattctcagagaaacttccagtcgaggccaagttgccatggttcaaacaagctcaagagctagaagaaggagctgctgtgtcagaggagccctcgtaagttgtaaaagcacagactgttctatattkgaaactgttttgtttaaagaaagcagtgtctcactggttgtagctttcatgggttctgaactaagtgtaatcatctcaccaaagctttttggctctcaaattaaagattgattagtttcaaaaagtgtttgtcaaagctgatgattgcattgtaaatacttctgttttgcctaaagtaagaaaatgaaggtgtagtgcttaccctcttctccaaaatctgacctcctctcttctctgcgcaaggggccaaaggtgagaaggcccaggctgcagctgatgatataacatagatttgatgccaaagtctgagctgcttttcacactctcccagttttgcaatacagtcacaaaaattaaagagcaagtaaagtatacctgagggcaaargaagttcattaacttttcttttccctttcttcctgggattggtatcagggatggacctgcttatttgccccacttgattatgtcccatgtctactcaattttatcaagtccatggaatctgtaaaaccgtgaggcccagatttgccagtgtcttcagaagaggaaacaaataggagagacaaaagtagattaagtggatgattgataagtttatgtattgatttcattagaaaacactgataggcatagctgctacatcacttttacaaacgaggggatacaattgattgaaaaatttcatctatgacccaagaaatttctcaggttgaaaaattttctaaattaattcatttaatgtaagttctaagctctgtgctattcactggcacttaagataactcatccaccctccaagagttaatagtggagcatgtaggatataaaatgatttccaaattttactggagatataaattaacgttgcaacctatttaaatgcaatttagaattttctcagattcattctgtttgaatctaaatctgatgtggtttgccagaacacaactgtgttcctgagtgcacaagaaatccaaaatatagatttgtaccataaccaaaggtcacttgtaaagaaactatattctgtcatttgatttcacatacaccaaaaggatgcacacattagaaaacactttttttccctattttttttttttgagatagggtctcactctgtcacccgggcatggatgtagtggcacggtcataactcactgcagctttcacctgccaggctcaatgaattctctcacctcagcctaccgagtagctgggactacaggtgcaggccaccacaccaggctatgtttttaattttttttgcagagactggggttctccatgtttcccaggctggtctcaaactcctgacctcaagcaatccgcctgcctcagcctcccaaagtactgggattgcaggcgtgagccacagcgcctggcccgggaaaacacatatttttacttagaaggataattaagcaaacataaattatwtctgtactgtaaagttactacagcaaactttttgacttctttgagaaaaagcaactaaccactgcagaactttggaggaaagggagtgattaaagatcacagtgtaaccttggaatgaaaatataaaggcttacaattttttgcttctcctctgccagtacctgatttgacaggccwttttgttgctgaggagtaaataagcagttctttttaggggggcattaataacttcttaatccagtaaggtcctatttaagacacagaaagatgctatgtaattagagctggtgactccttttatatcctattgggttaaatctatttgaaaccagttatgttttattttacctaaataaactcttttccccttgtacactgtattttgtcacttggactaaagcgtaatcctatgtataatcttgcgttctggctgatggtaaataataatacaaaattgaaagtaaatggaaacatcttacatcgataagcatcttcccattattagatgcctttcagatgaaagctatcagtggagtttaatgcatccacagaagcattacatagaccatcgtcaaccatattttgtcatgaatattttctactaaagatccgattaagatgcattacgtttaactttaatcttaataaaatctttaaagtagttaaaaaagttttagccattgaaagtatagccatatattaaactattaaaatttactcttagtgtaatgaaattgccatcttggcatgattaatctgaattggagtagattgtaattggagtgctggtgcagggtaagggaaatgtatactattgtgctcagaataataattacttttataccaaaataaaataaatgacagctgtagaataatgtaatgaaaggtatatggtttctacattttaatacactttatgtgtttagtgcactgcaccctaagaaacgtcctaagtgtcacttttttttatctatattgattttgaatttaaaaaacataatgttgcatggccttaattccatcttttcttaaaccacatagaccgtttctaaatgtatgtaacaacctataattactctctgaagcatattgaaaaaatgatcaactgtcagcaagtcattccttccccccaccaaggagactcacactgcttaaattaaatggtaatgtttagaagctgtggctgtcacttctgaactgctacagtgaggcaagaacagtggtccacaactattatctcttgctttggctccagctaacattggagagttctgtggtaaagcagtaaatatcatttatttccgtatatggaaagtgaaaatattatcaccagcctatctcattatgtaatacagaaaaatcaccagatgaatgtcttcagcttatgaagataaccttgttcgatgttagatacttttagtaaacccaaaatgtaaggacaagattggttagcactcaggccaaacatatgttgggaagtaaccgctttaagatgtttagaagaaaacaatgataaaagactaaaaactgaattgccaagaaataaataacacgttatagaccagaagaatgtaccaacagccaacattgtggttgcagtaaacaccatgcacaagatataaatccagatatcaatttcatagaaccactgaaataaatatggagattggctcacatggtggtaatatgtagatagattcattatataaagctgaatcttcaactcaaaaatacttctacatgttgattttttttccctcaacaacagattggtttgttatgacacatctgattcatgtggtagaaaggtaggaatattgtgatgaatacatatatgtatgtatgtatatatatatatatatatatatagaaacgtagtctcactcttgtcgcccaggctggaatgcaatggcgtgatctcggctcactgcaatctcyacctcctgggttcaagctattctcatgcctcagcctcccgcatagctgggattacaggtgcccaccaccatgcccagctaatttttgtatttttagtaaataagagacagggtttcaccatgttggccaggctgttttgaactcctgacctcaggtgatccacccacctcagcctcccaaagtgctgggattacaggcatgagccaccacacccagccgaatatattttctaggtatgtacaacatgaggaatttaagaccagcctgggcaacatagcaagacctcgtctctactaaaactcagaaaacttagccaggcatggtggtgtgtgcctatattcgcagctactcaggagtctgcggctggagggttgcttgagcctgggaggcggaggctgcagtgagctgagatcwtgccaccaaactccagcctgggtaacagagcatttcaaaaaaaaaaaaaaaaaaaaaaaaaatatatatatatatatatatatatgactgtgactaagaatgcctaatctcctgggaatgcagcccagccagtctcagcctcattttacccagtgcctatttgagatggagttgcctggttcaaatgcctctgactgttgaggtagacttctacaattactaagactctgggagagttccatttttccgagggtaatagcagtgccgtgctagtactagaaaaggggggatgggaaaaatactgataaaattatcttctgttaaagttcaaactatgtcatttcgaatttccctccagctgttgagagtgttgttagatttaggatacatcatttaaatgccagattgagcccatctggttgctttcatggaaaaatatataggaatagctttctaggtctttttggaaactctcaraagtgtacatttatttggtggggaaytggaactacaaagtggtagtacaattatatttgttaatcaggtggaagctaaaaaaatkactgacaggtttcccatctcttatttttataccgtagttttagtcttggttgagatgtrtgcataaacatcactatcacctgacatgtatcacccacgcaagtacatagtgtgacccttctgacagcttaatttcttgaggaaaaatgatacaatgatgatccctaggacatttaaagaaatgttgttggataggaagtcattcagcttaccttaaaaagcctgttctgacttgggacaggaaggaaattgttcatttccttaactccttcaggcaactaacaggccacctaatgccctagaaggtgtaatttgctaagggactcatatttttwaaaaaaaaggaaaaagaaaaaagaaaaaaargtatagtctggatgctttaggtgctcttcctgatctccaaaacaaggcatcccaggtagagaaagtgaggaccagtgcggcacttagggaagccaggttcttccagatatatttcagttgccgtagttcttcaatggctcagaagaagcaatgggatatgccagttgctttggacacagtgtggccaagatagcaattttatccagatattcccttgttaaatagctggcattcgccaggtggaaagccttaatgatgccattttttcaaaggtaggattgggtagtccttgtgccttgatcttgctttttaaaagatcttgagttatcttattagattttcagtcaacggctttgcatggttaggagactatgtttgtgcttcaacaaaatagtcagggcttaaatgtattgccataaataatcttgttgtgagccattacaaaaaagaagacaaagaggaagaaaagtaagtaagcagaaggcagcagtaatatctggatgccagatggcatcagcttagcaatggggtttattcaataagaagcaaagggaaattcctgtcatgcatctgtgaacagaacccagaaggaattagatgcatatagaaaaaccaataagagtcaccatggtgattctgtagtcattaaatgccttgtttatcttgttgaaaatagtacttaaagatataatatttaagcatatgttttcattagtccatatttatacccaataagtagtctaagaatgtagatggcttaactcagtggttaagaatgtgaattcatattttttaagtggctagaaattttaattgtgtgacatgtgtttttatatccctcctcaaaatgtagtgaaccaaacatcatttatgggtccatatagtgttactatttatattctaaatataagktacctgaattatattctcttcatgaatctcaggccacagaaaagtaacaatgaatatcttgtttatgtgtagaaacaggtgagatgattcatgattcttaagaaatctaagatcaggaaatttaaatactgtttgcagatctttcaatcaataaaaagaatgttcaagcagcaaagagttgagcattagaattataagattaaagagcacttaattttgaaaactggcatatggtagaggtaaagcctcacactggccagacagcatcaacccttcccctccaatagtcttgacttctctcacttccaacaccttcctttctggcctcttccctattctctgcagcagcaaagtgcttaatataatttcttgggctaattccatattctagatgactttagagagccactagacttgctaaattgttcacacctcctaatgatggaagctaaacttacctataaatcccttgccctatgccatgctatgtaccaggtgcaggtattgcaaaaataaccagtctttgccctcaagaaactgttagtgcattcttatcacaagagcaataggattgtgaccaaagtgttgagtactggttgtctatccacagactgaagaaatgagctagctgtctttaagaaatgcaatttgatgtttggatatcatatcatgagagagttactgatttaaaaaggagttcaggagacttatttattgaattcccaaattctctactagcatatatcagaattgcatctacctctaagataaaatatcagatagttaagctactacatggtaatgcataaagataagaactaagtgataaaagaatacaatgtatacattgaaagggtttgaggggaatgttgatatgaaccgatgtttgacagattatgatcaaactgatttgagtctggctttgattccagaactagtacttggggaaagagatatgatctttttacatagcaagtgatcagatattttgtatcattatgtgtacctcagttattcctacctatatgttaaaaacaggctatagaaactacagataatttcctaaaattgatttttttcagatgcattaagctgccaactgggtgagttggtgaggggtgagtctctgtatttgtatgccctgacaaagatacaatcctgctggaatcagagtaaaaatcaagttaatttttgatcatacctccatgcaggacagctctgcacagtgactaaaagtgtgggccccagggacagagagcttgtgtttcaatcttgaccttgggaaagtcatttaaccccatatgcctccatttatcacctgtgaagtgaggtaatcactacctcatagggttcttctgaggtttaagttaatctgtgtaaagtacstggtatgcaggaagtgctatgtatataaatttttgttgtgattaggccttttctagcatcattcattttcctagagaatctttaagggagttaagatgtctaataaccacttaatacaaatggagaaattgaggcagctgttgtatctgcctcatacatcttgtatctaatggcatttgagagagaacaacaatatttaactcaaaactcagctagtgggttcccagcttacaccaccttacttcctttcttcgtctacacttctgagggtctttgaagactcacttataagcaccatacttttaatttagcccagagtttatttttaagggacaaatctttatttaaataaaaagagatttatgagtaattacaaaaatgagtaagaaaagttcagaagctgcctgggtgaaaaagcaacctctctctactctgagttaaatatacttgatctccatgcgcagaaacagcagaatcaataataaactcaagagagcagatagagccgtttttttgtagtcattccttgattgcaaaccaagaagttctaaatttatcagtccctccctctgtcaccgcagttgctcgttctgtggctactttcagaaagctaaatctgaactgtcgcttagcagagccctagagagtgacaaagacaaattaatgggatccttgtgtgccaaaataaagtatgcaccctgtcaccaccaatatatgttaagtccattaaggtcatttttaatgaactgaacttttcattggaaagctttgccaaacatgttgaattaagggaaagaaacctcacaaaattacaagataaactaatttcattccatgtaaagaagaaatggtacatgaaaagtattgagtttccaatattttaaatctttatcaaagtcagggaaaatgttatgcatttaaastacattccaatattaagctgagaactacaaatgcagtgatagcattgtaagctgtgatggcatctgagtccctgggatgtggccttttaagtagactatttgcaaggaaaagcaaattttcaaatcattttctgttcatttagatcagaaaagcaaagagaaagaaagatggtctgaaacaagtgtmatatcctcacttttcatttctgaaaggaataatttggctttatttgtatctgctacgtggagtgagtagtctttcttccttttttcccaaaattttatggatgttgagttttaaaaagtagacaaaaaagacaaaagctctcctttgggtttctctaacctaggaacagttccaaaatgctccagcgcttcactgctgagtagctgatggcatgataaggcagtgtttgaccagagtcctgtaaaaattattgaagtcagcatctgtctcaaagctgccccttaatttttttattcttcaaaatgacattttattgatatttcactgaagtgtgatagacacagaatttcaacttacctcaagctacatgactatctaacaacccatcaagatgaaattcggccggcatatactgcataagtataactataagaaatataaatgaataagcccactgtggctgctcagtttgggtatagtaactctaaccttttcctgctgtaggagttttcttatggtttctatagccatatgaaactcctacaataggaagaggtttgtatttcctcatgccaatgcctagaacagaaaaatatgacttagtttcttagagtcttttggctgttgcctctttatctagcctggtttcagtctttggccctaagaataagcacagtaccaagtcaatcataatattaactcttatccttctgtttatcaatccatttatttctttgaaaaattatttattgagctgctattatgtgaagttctaccttcatagagatttggtcaagtgagggggacaattattacataaagatttgcattgtgattatcaaagactggtagctgttctaagaaaatggaaagatgctcaaagatgttaataggggacctattaggtctgagggtcagtgcattagtctcttctcacattgctgtaaagagctgtctgagacttggcaatttataagtaaaagaggtttcattgactcacagttccacaggctgtgcaggaagcagagctggggaggtctcaggaaacttataatcatggcagaaggagaaggggaagcaggcacatcttacatggctagacaaggaggaagagggcaaaggaggaagtgctacacaattttaaacaaccagatctcgtgagaactcaccatcacgagaacagcaagggagaaatctgtccccatgatgtaatcaccttccccagccccctcctccaacactggggattataatttgacaggagatttgggcaaggacacaaatctragccatatcatcctgcccctggcccctcccaaatctcatgcccwtctcatgttgcaaaatacaatcatcccttctcaacaatctcccaattcttaactcacttcggcattaactcaaaagtccacagtccaaaatctcatctgagacaaggcaaatcccttcttcctatgagcctgtaaaataaaaaacaagttagttacttccaggatacaatggaggtacaggcattgggtaaatacacgcattctaaacgggagaaattagcccaaacaaaggggttacagaccccrtgcaagtcagaaacccagcagggyggtcattaaatcttaaagctccaaaatgatctcctttgactccatgtgtcacatccrggccacactgatgcaaggggtgggctccaaaggccttgggcatctccacccctatgaagttgagtgcctgcagcttttctaggttcatggtgcaagctgtcagtggatctaccattctggggtctgcaggatggtgrccttcttctcacagctccactaggcagtgccccagttgagactctgtgtggggcctccaawcccacatttcccatccatactgttctagtagaggttctccatgaggtctctgttcctgcaacagacttctgccttgatttccaagcatttccgtacatcctctgaaatctaggcagagcctcccaagcttcaactcctgccctctgtgcacccagaggcttaacactatgtggaagcctccaaggctcatggcttgcaccttctggagcagatgcctgagacatatctggagcccttttagccatggctggagctggagcagctgggacacaaggagcattgtcccaargttgtgcagggcagtggagccctgggcctggcccataaaaccattcttccctcctaggcctccaggcctgtgataggagggactgccacagctctgaaatgcctttgaggcattttccccattgtcttggctattaacatttgggaagggctgctgtgaaggtctctgaaatgccttcaagggcattttccccattgtgttggctattaagatttggctcttttttacttatgccagtttctgtagctagcttgaattcctctccagaaaatgggtttttcttttctaccacataggctgcaaattttctaaacttttattatctgcttcccttttaaatataagttccagtttcaggttatgtctttgctcatgcatgtsattatatgctgttagaagcatccaggtcacatctggaacactttgctgcttagaaatttcttccaccagttaccctaaattatcactttcaagttcaaggttcaaggttccacagtgcctgaggtgcctgagaccacctccccctggacttcattgtccatatcactagcattttgattacaacaatttaccaagtctttaggaaattccaaagtttccctgatcttcctgccttctcaaactcttccaacctctgccagttacccagttccaaagtcatttccacattttcagctatctttrtagcaatgccccacttcttgatagccattttctgtattagtctgttctcacattgctataaaggactaccagtactgggtaatttctttaaaaagaggtttaattgattcatatttccacaggtggtacaggagccatggctggggaggccacaggaaatttacaatcatgatggaagagaaggggaagcaggcacatcttacatgkccagagaaggaggaagagggcaaagggagaggtgatacacacttttaagcaaccagatctcttgagagytcactatcacaagaacagcaaggggaaaatccactcccatggtccagtcacctcccaccaggtccctcctccaatattggggattacaattcaacaggagatttggacagggacacaaatccaaaccatatcagccagcaaagccctctttgagaagggacatatatactgagacctgaaagatgagtgggagttattccaaacaaagagaagggaagagggtgatccagggtgcaacccgcccatgccagaatcttgagtcaggaaagcattgaccacattgaaggaagtaaaagaagattagtgtggctggagagagtagtaactgggggaaaatggtgggagatgaagatggaaaatgccgtaagataaccaagataaccttgggagaaagtttgtcttttttacctggggacagtaggagacaattaaaagctttacattttaagattcccctagctacatcattaagaacaggtcagtaaggagtgacagaggaagaaaatagaccagtggctattgtggtagtccagcagaaagacgatgttatcttcagtgatcaaggtatgcgtggcagcccatggcaggacagtgaggtgatgaagagcaccaactgtggagccagcctgccagagttcaagtcctgacaataccatttactcagcagtgtggccttagaaatcattgtattccaatattatcatctagaaattgagatgaaagtagtactattaaaatataattttcaaaagggtacaatcataagtctcatgaaaatataaaataatcacatgtcaaaaatattattattattattattattattattattattattattattattttgagatggagtcttgctttgtcgccaggctggagtgcagtggtgtgatctcagctcactgcaaactccacctcccgggttcaagtcattctcctgcctcagcctcccaagtagctgggattacaggtgtgygccgccacacccagctaatttttgtatttttttttagtagagacgaggtttcaccatgttggccaggatggtcttcatctcttgacctcgtgatctgcccacctcagccccsccaagtgctgggattacaggtgtgagccaccgtgcctggccaaaaattttatttaactcacaaattattgaggaagccaatgtgatgttaaaactagttcaaatgagaatttgatttagaataaagtatatattttctaccagacaaaaccatttgcagtgccatgaacagaaaaatacatatattattatggacaagaaacatctgtatcaccaccagacctctacagggaaacttctatctctatggagttgcaaaacagactagcaaagaccatcaaaggctcctaattccatagaacaagaccacccctggaaatttgctagaaaatgccagcagttcgttgaaaagacaaccagtaatctcttttgcctatttcaaaatgtttccaacagtacccatctcccaacaatgtcataatgagttgtatatgtaaaatgcataaagcatgtaagtgtaatgttcacttattattgctatattaaggtggtggtaatggaaatggagagaagtaaatgagtttatatatattttcaagggagaatttagagaattcggcaatcagttgaaagtgagatgtgaaggaaattgaggggtcaagaataactcctgattttttacttgagcaattaggtagccattaaaatcctttgctgtggtggagaagattggaagacgatagggttactgaagggagaaatcaggagttccattatggacattttaagttggagattgaagctgcctttgaaacttaaaagcaaaaatgtcaagaaggaaaaaatagcaatgtgaagtagttaagagcacaaaaccttactagttgtgtaacttatgcttcagtttcctcatcggtctattaaatggtaataataatagttttatctgataatgttcttgttcagatttaataacttttatttataaagcacttagagtagtgcctggcacataagaaacactaaataagtttttgataaatacattaattaaattaatgtttacttttttcagagaagaaagttctagaatagagattaaattcttagaagcttcatgtacactgatggtatttgaaactaggaatcattgatgaacacattggaagayagcacaaagccaagtcctgaggcactgcaatattttaattttttttttgagacagagtcttgctctgtcacctaggctggagtgcagtggcatgatgatctcggctcactgcaacctccacctcctgagttcaagtgattctcctgcctcagtctcccaagtagcttgggcttgcagrtgtatgccaccatgcctggctaattttttgtatttttagtagagatgaggtttcaccatgttggccaggctggtcttgaactcccgacctcaagtgatctgccagcctcggcctcccaaagtactggaattacaaaagtaagccaccatgcctggactgtgccactgcactcagccaatattttgaatttgagaatagaaggacctagaaaaggagactgagaaggaagtaaccagagaagaaaaccaagagagtttggtgtcatgtaattcaagaggaagaagtatttcaagaagaagtacttgcaagcaatggtcaattattttgaatgccattggaaatgagacagaatgaggattagatttgttaagaatagcagacagtaaggcctgtgttcttagaacctgataccaatcttccccctggcctttttcttactgttaaagaaaagcagcctcctgatggtcagtgggaccctccgttagtaagactccttataatgtcttgtctagaaccatatcagagaaaagagaaggcagaacttcaagatgacttcaacaaagtgctcaaacatcaagatcccaggctttgaaagagccagtagtctctggatgaattggaactttcagagaactcagcccctgcaacattttcctctagcataaagtctctttgaaaggaaaatgtgctctttaatgcagtcagcattttgttttttaacccaacttccatcactgagcattttctgcaagaaagacattcaggcattcttgcagagaggccagctgcctctcaacccaaaagagcgtcattgtcatgagaaaaagtctgtttgttacttggaaaatgcctgtaaatatagcttttccatgtgttttgctgggttttttacttttttttttttttttttttgagagactgggtctttctttgtagcccaggctagagtgcrgtggcacaatcagagctcactgtaaccttgaactcctgggtgcaagagatcctcccaccttagccttcctggtcactgggactacaggtgtgtgctaccagactcagctaacttattataattattattggtagacatggggtcttgctatattgcccaggctggtctcaaactcttggcctcaagtgatcttcctgccttggcctccaaaaatgctgggattacaagtgtgagccatagtgcctggccactttaatatgttttttaaattaagttcttctgtcaaattattactggttagcaatattagacagggacactcaatctttttcttttcaagtagttgtattggtggctgcttcaaaattatcatttgttttattttaatttccaggatcattatatttttkattattctcctggggcaccttacagtgctgaagatgcctcatagcctaggcttgacacttgaggatttgagaaatctatgaaamgaagtggtgctgtcagatgttttgaggagtgatgtcctagaacctttgaaaaattttgcttagagacctcaatatgagttgcataactagcatgatttatttgcagttccagagaattgtaaacaacagcagttgagaaatattttcataattccacattcagattaaatatccttgagtaaagatatttcctaataagttagattctcatttatgtggaatgatttaggcgtggttctaagtaaatttagagggatattttggataagtmttatctcaaaactttaatgctccagctatattttaagaatgccttaatattatagattttacaagtaattttaaaattcctaaagtgattcaattgaagagtttcccttccattatagcattccaaatggtgtttgcttacttattttagagggtttatttaaaacttttttttgacatcattgagaggcattaaataactraagagtttttacacgagatcttctsatctcatgtaaaaatgggaagtagataagagtagaaatacaaagaaggtgtttccttttctctcttccaagtttctttctcatccagtagtaattttttccctatttatccaaaagcctcttcagatgccaaaatgtgcagcttaggtttagttaactgcactttatcctaaggtttttactccattaatgtctcraggattgcccagaatcaggggaaggatcaacttttcaaagtttaaaaaatatatataagaatgaagattgggttaaaaaatgatgaggcaatatggaattacatattttaccagtaaagtatgtaaattttttggtcctaaataacatatttatggaaaagacttgattcagagtagaattacttatgacatattttctttttccaatatactattttccagatccctctgtggccacttgttaatgataagatttttaaaagggaaaatccatgattctcatgtaaatataaaatgaacatctgacaaagatttaacctacctcattaaccaatgagggaaccaataagatgttacagccaattcaaaggaagtttaaaaaccctatttatttaggcaaatatgaatgcccaaatgaatttacaaatagatgcaaaattggtctagctacagggcaacaatcaactgcattccactagacacagttaatctgtatttctctgggcaggaatcatttgcactatcaatttcttgccacttagagggtggtaaaatataatagctcaaagtcaatgaaaggctaagacaacctaggaagaatgcacttaacagagttatccagtaatcagtaatcttttgggttctttttttttttttttttttttgagacagagtctcactctgtcacccagcaggctggaatacagtagcaagatctcagctcactgcaacctccacctcccgggttcaagcaattctcctgcctcagcctcctgaatagctgggatcacaggctcacaccaccacacctggccaatttctgtatttttagtagagacagggtttcgccatgttggccaggttggtctcaaactcctgacttcaggcgatccgcccacctcagcctcccaaagtgctgagattacaggcatgagccactgtgcccgattttaaactctratttttctcacatattattcagtttattcccttctcttttctcaccctactgtcatgccaccactcacatacacaaacatacaccaaatcaaacaggtaaagagaaatccacaacctctattggctcatggcttgaaatgtaataagattgaaaacctatacctaaattgagtatttttaatgagacttcctgcatgtttcaatttgcatttttaaattagggcatgaaactagtgatagcatcaaaataagacacctataaagctgtttttatttttaataatcccaatgatttttaaaacaaacatatatgagaaaggaagagagaggaaagtaataggataaaaggaaaagttaattttcacattgtattactccattttcacattgctgaaaagacatctctgagactgggcaatttacaaaagaaagaggtttaattggacttacagttccatgtggctggggaggcctcacaatcatggtggaaggcaaggaggagcaagtcacatcttacatggatagcggcaggcaaaaaagagagctcgtgcagagaaactcccacttttaaaaccatcagatctcatgagacacattcactgtcatgagaacagcacaggaaagacccgcccccatgattcaatcatctcccatcaggtccctcccacaacacatgggaattatgagagctacaagatgagatttgggtaggagcacagaaccaaaccatatcaaatatgttagttacaggccatgtagacatacacctagaggctagtgctagctaatatctgtggtgacacgagactaatcaaccaagagtaagttgtttttgtttatcagtatattaataaagtgattatttttattatttcagtgcatgcttctaactctatactagtcactaatgaacttttaaaccatttagggattttataagtgaattttattgtcactgttttctatttcataaaagagactatggtaattactctaattaaagaatatatttttttcttaatgaaaggaacaattaagcttgcaaatagaaggccagccagaagcattaatcattcatttgccaggtgtggtttgttgttgttttaatttcctgagaaggaaagactaaatacagaattcatatcagttacttgtgaagtttacacccatcttttaaagaaataatttgtcaaaccattcttcattcatccaacagtagtgttgctaacaaaaagartttttttttttttcaagccggagtctcactctgtcacccaggctggagtgcggtggcacgatcttggctcactgcaacctccacctcccgggcccaagcaattctcctgcctcagcctcccgagtagctgggattacaggtgcctgccaccatgcccggctaattkttgtatctttatagagacagggcttcaccatgttggccaggctggtctcagactcctgacctcaggtgatctgcctgcgttggcctcccaaagtgctgggatcccaggcgtgagtgcccggccgacaagaagaatttttaaacttcccaaattttaacctttttattgtccatttttacatgaaagtgattaatgtactgatttaaaaacaaaaaaaaatttccctctattttaaaggtccctctttaaagcttctagctcagcaagtgctgttygagatgagacttctaaacattagaattaaacctcctaactcacttgcctgccctctcactgacctcgcttcctcccacttgtggccagaaaactcaagatagtaaatacagagctgggagatctagggacttggggaaaagcctcctatgaaaaacagttattattcatttgtccatttgcactatcagatatttttcttttgaaacataatctcctgccttcaacaaaagagactatattatattatacactgtatgcactagagaaattaagatgactgccaaaggacagcaccacttaaaaaccaaattgtttttaattggtgtgaactcgatgaagacctaaggatagtggattgggagataagccagtgaggctgttttacatttgataaaactctcatttgggagacataaaacagatgtttattgtttttgctattaaccctagatgtctagatagtaaaaaattacacacgtgcatgcgcacatacatatatatatatatatatatatatatatatatatatatatatatatatatatgttttaattgaagcatgatgccttaaaataactttcaaccattgcaacaagttcatggggcttcagtagaatggcctttctattttatgtgcttttggtatatcttcttggttctggaatgacatcaaatgcaaagtcatttatattatagacaagcagagctaagagtctagtttgtgcatcatttatattctagatcttatctggggctcgctttgaaaacacaaatcaagttggctacttgtsatattccataagcttatatatgtgaaaagagatggaaactaagacctaaaataagtttgaggattatctatagatctcaatgcgtttgtatctctaccaaatgtttttttctatagcaggggttggaaaactacagtccacaggccaaatccagacccttccatcagcatcccatcacaccctttttaaaactaaagttttattggaacacagccacactaatttgtttacatatttcattccacaatggcagagttgagtagctgcaacagagttcacgcagtccgcaaaatctaaaatattttcaatctgtccctttatagaaaaagctggccagcccttgccctgttataatggttcctaaagagggctctttataagcaacagaaccataatccttactgcatagaaaaagctggtagggtgcagttctttttgagatcttgccatctttctgattcgaaaacaaagtttggtaccacactattaaagaagtattattcatcacaccattgtcaaagttagcaggctaatcatttgcttttgtgtcttcttacatacaaaatagttgagcatgcattttcctttgtgtctgcatctgtgtgataaaattaaatgcttgtgtatctgttatgattcttgtcacaggagccaggtaggtggatgtggatgtgtaataaaagggttaaaatgattttgatagcagtttttggttttatgttcctaaaaagctcctgcaggggtcattttttaaagcaagaagactttttaatcttttaggataccatttttttccaagttctctaggtgcaaaaggtggaacaaagaagttaaaagggtgagagggaggtgaaattgtgatgagattttcttgggataattctgggtggccattctaccctcatccaccttcctgacaaggttatatggggacctttgttctctcctagtggatgactcttcaaaggtagctggggtcaggcctttttcaaagggtctcttgccatgcctcagagcactgagtgctgctttgggggaattcttatcttctgagcagaccacccctgttccacatgaagcccaggctcaggcccaggacacatctttgttgtgttccttccagtttggaaatttggattggcttgctattagaatttcaatttccctgaaccagatctgaaccatttgcacttgctagcatttaatgctataaccttcttatcagttctttcattgtctgccaaagtcaaggttaaggagccaggtttgcatgcctctgcagcacgactccctgtgagaaagcaataggatcatggaaaaatgaaaaataaaaaataaaaaaattatcccaaagtttttgtctgaattacactaactttttgaaactattagtggttgcttctgggcttttttttcctaggcccctctcaaggtcattatagttatggccacggttgattaatgaagatgggaggacatttttggagatttgggtatttttctacgttctagagaaaaactcagaagttcttactaatgtagcttgttttaggggactgggtgtgaggatgttgagcacacttgtctgaatgcaaaacctctcatttacagtggtatgtgtggatttacatgtgtagcacggcttttctctatgatataaaaagaattggagctcagactaattcaaagaatgtgtaacgaacaagactttgcaccattcttggaaacttacacacaaaaatacctccttatacatataaataaatctcgrgaagcatattgaacaaagaaagttacagaatatgagagccagactaaaaaagaaacaaacttccttaaatatctccaagggcttattttgttatcagtatcagtctgctataagaatagccagcaacttgcaggaggcacaagtgatggagtcacagggcaaaccccaaaactgaggtccagcctgggtgggacctcatgggttcttggcttcatgcaggaaggaattcaagagctagctgacgagcaaagtgaaagcaagtttattaaagtaaaggaataaaagggtggctactccataggcagggcagccctgagggctgctggttggctatttttatggttatttcttgatcatatgctaaactaggggtagattattcatgagttttccaggaaaggaatggagaattcctggaattgaggatcctccccttttcagaccatatagggtaacttccagacattgctacggcatttgtaaactgtcrtggcactggtgggagtgtcttttagtatgtgaatgtattataattagtgtataatgaacaataaggacaaccagagcttgctttcattgccatcttggtttgacaggatctggccsgcttctttccagcatcctattttattagtggggtcttataaaacaaattcctatctcattggaatttagagtgaggagaagaaaccaccaattccctgcttggaagagctaccactgtgggtgcaaagtagggagcaagcaggtggtctctggaatgtcttgcagctgggagttcatgtgacattcatgaagcaagcaacccagaaacagtggcaaaatcgcttatgaactaaactgaagcgccatcacaggacagggtggaggagccctgagtacccctgggacagctctgrgcactggaggcaggtgggatgcagcccctcacagcccccatggcttcctgcctggggcttctcatcctgtcctcttgtttgcttgccgactgcaggttcatcccagaggcctggtcggcctgcacagtcacctgtggtgtggggacccaggtgcgaatagtcaggtgccaggtgctcctgtctttctctcagtccgtggctgacctgcctattgacgagtgtgaagggcccaagccagcatcccagcgtgcctgttatgcaggcccatgcagcggggaaattcctgagttcaacccagacgagacagatgggctctttggtggcctgcaggatttcgacgagctgtatgactgggagtatgaggggttcaccaagtgctccgagtcctgtggaggaggtaagaaagggggctctggctcagatccccgccatcttcttgctcattttctctctctgcatgcagctggatcatgtgactgcctcaaatccaagaatgataagcaggaggaggaggggaggcagccattctaaatgtaaagcacactgaatcaaacacagatgtatttgtctcttggctccagtggctctcagactgtcagctgtgagtggccagtacaacaaatgctttggctttcagttgtcattctgatgtcttgcaacatatcatcgtgtatctggctgagaaacacagttgacactgacctggccgtgctctcaacattgtttttttgatctctgcccttgcctcagtgcatgcaatgtgaaccaagacccaagaacaagtcggagtccctccgatgtactcagctgatttcccaaagtaatatctgtttacatctcgaggaagggtgtctaaaaggtaattgatacagtggttacctggagctggaaaggagtttaaagttcaaagtctgaccccacccccatcttacagatgagaaaactaagaatcaaagaaacaaagtgatttgttcaagatcatacagctggtgagcgacagagctgggactagaacaaagctttcctttctctgcctggagcctttccatcataccacacttttttaagcagctagagaattcttgaagctttctcattatgaatatcagttaactcacgttaaatgtttccacatatatccatctggttctccttggtgtattccatggtgatagaacagtagattcagtgattctttcagatgttatgaacaggattgtagtggcagaggaaggcattgaaatcaacaactgattcttcaagattacgaactttcttcccacactaaaaatacggtagattcatattgacaccatctcctatatctactcccaagagaaattttaatagatgagggagcgccagctgatttcttgccagatctttccctggctattagtaacccctttgagcatgttgagattctgttttctcagcaaagattcttaataaccggtggaaaaaagcactaaaatgatttcccaaaactgttttctaaaccatgatattttggaaactttgaaaakgcatcttttgtcatgattgagaacgtaagaataaatgcaccacactgttcacatgtagttgaaaaggaatgaatagtggaacaagtactagcaaagaatcaattttctccagcaggtcttttagtaagcatttaatagtgctgaccttgaggttcttgtttgtttccacatcttccagtttcaaaccctggaattctgaagtgttttaatggagagccctggtatgttaaaacctaaattcttccaaatgattccggaagacagtttcctggaactcagtgaatgtaactgtgttcatatgggactcttcactcattttgagaacgtcttttctttcacgcttaatgagagagaagtgttaaataagctttggtgatctctggagcctgggcaggagctgagagatcaggtagaaaggctgttagccagcggctacagttgcttctttccaacatagcagatgactcagcattcagatggttgtgctttcatccccaatttccatgatcacctgaattgaatgatcattatttctagtctaagacaaatgtgctttaaaaaattatttatggtctctcagttatagttctcagttacaagtcaagcctggaaytttatgaacagatgsaaaaaatagatacagtaatggaatatctaaataaccagatacctttttctttaagagtctaaccattctgctgaccaaccaagggtataaaatttgaagtgtcgagtgtatgtggagtgtatttaatttaaaatgtttttagaagatactgatttagaaataagatttggatgtttgagatacaattgatctctacctatagaagctaagtgtttttatataacgtaaattgtacatcctttatatccaaagcagggtaaagttactgaaatctcttaggtctttaaatgtcaacaactgaacctacttaccttcagttatgtcactgtgccaaggtaatatatttaagcctaaaaarttagagtcgaaaattccaaagtgatgaaaatatgcttgggttatatggtccatatgatgcccatatgcactaaaatttattttggtatataggacgtgtatattttcaagtctttgttcgacagtaacattttactgtattatcaactttgatctttcaccaaaatgtmacccacaaggttatatatatttttaattatttcttctgaagccaaccaaaaatctgcaggattaacaaatagattttaaatcaattttgggttgtagagccagtcaggctaattttattgtttttgtaatctcaagagatgaaattggatagacagaaaagtaacctttcacctagcagaggtagcaaccagaaggaactagttagtaatttagtctgtagttggtggctgtgtttccctgagctgtcatcaaatatcatgtaacaattatactattctgggagatataaacactgaaaatcccattttctggaagatcgaacgcaagcctaacctgctcagatctgtatcctgtgtccaactrtcacttccttgttagattttaatttcccacatgtgaactgataggtgttatcaaggaaaacaactctgagccygatcagctttattgtattgaactcctagacagtaaaatccacgttaaaatctagctgggggaatacttgacattgacttcagcaaaaatggaagatgaagccttgtacctgttgttccccttttcttacaagtcctctctactttttgcttctgtcaagaaaggaaaacccagaatcatcaagtactgtgcttaaacatgttctctgtcggtttacagtgtcctcctgagagcatatattagctcttttggaaagagcacaaacttgatgagctaacttctcacatcgtgcctgcctcccatgggccaactctactgtgaactccaaggtgaagcccttagagtttttccctcctccagcttcccacactcccagttccagggcggctctgtcactccaggttcatgctccccaggcaacccattcccacctcccctcagcctcaattgcatgctgtgcttagaatgccctgccctttagccattgcatttgttcatcctacaaaaatgtattgagtgttgaccacagggctggcccaagatactccttaattatgacagaacttctgtccttagtttcacccaccacactgggctccacctaagaaggatgaggcaagtggtccctgtgataacagagatttaacacacagcactggggaggcctagagccttgttttagaatacttcagattagaatgtagtaactctggactgcttcttagtctcagcacttcatcaccccatgggttattttaatctttcagctatgattattggtttggagttatgtaaatttgtgtttgacaaacctaagagaggagattattggtgtctttctagaaatgtagcccttactttccccattccttgcagtcttagaagggcctaagttttkttttktttttttktttttttttttacaaaattgaactattttaattaagggttttagtttacatttggccacctcaaagtagttgtaacattgggttggtcaatttaaatactgkggctccttgttggatggacacaatctttacatccaaacgttaatgcatacaaagcaacatggcattgttaaacaaaacagcaatacttactgaatattgggccttgtgaccaattccatatgattaaaattacttcccacattcacacccacagtactcgtccaccatttaaaatctcaaccaaaacgttacacatatgaaacaatcactaacaggcaaaaatactaaacctgtatatttagtattgcagatacacttatgcatgagcaaggaagcaattcacagtgatgatctacagctgcagaagcctgaaaatgatttacaaaaattgttacatcattaaaaawttgtttgaaaatatacatttcttgttgtaggcacccactgtatacatgactataaacattgttccttatgtaaacagaaaaggaaacatataataagaaatttcaggcaaggagccaagatggccgaataggaacagctccgatctacagctcccagcgtgagctacgcagaagacgggtgatttctgcatttccatctgaggtactgggttcatctcactagggagtgccagacagtgggcgcaggtcagtgggtgagcacaccgtgcgcgagccgaagcagggcgaggcattgcctcactcgggaagcgcaaggggtcagggagttccctttcctagtcaaagaaaggggtgacagacggcacytggaaaatcgggtcactcccacccaaatactgcgcttttccgacgggcttaaaaaacggtgcaacaggagattatatcccgcacctggctcggagggtcctacgcccacggagtctcgctgattgctagcacagcaatctgagatcaaactgcaaggrggcagcgaggctgggggaggggcgcccgccattgcccaggcttgcttaggtaaacaaagcagctgggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcatgcagctggagatctgagaacgggcagactgcctcctcaagtgggtccctgacccctgacccccaagcagcctaactgggaggcaccccccagcaggggcagactgacacctcacacggccgggtactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaaacagaacagaaaaactggaaactctaaaaagcagagcgcctctcctcctccaaaggatcacagttcctcaccagcaacggaacaaagctggacggagaatgactttgatgagctgagagaagaaggcttcagacaatcaaattactccgagctaygggaggacattcaaaccaaaggcaaagaagttgaaaactttgaaaaaagatttagaagaatgtataactagaataaccaatacagagaagtgcttaaaggagctgatggagctgaaaaccaaggctcmagaactacgtgaagaatgcagaagcctcaggagccsatgcgatcaactggaagaaagggtatcagcgatggaagatgaaatgaatgaaatgaagcgagaagggaagtttagagaagaaagaatcaaaagaaatgagcaaagcctccaagaaatatgggactatgtgaaaagaccaaatctatgtctgattggtgtacctgaaagtgaygkggagaatggaaccaagttggaaaacactctgcaggatattatccaggagaacttccccaatttagcaaggcaggccaacattcagattcaggaaatacagagaacgccacaaagatactcctcgagaagaataactccaagacacataattgtcagattcaccaacgttgaaatgaaggaaaaaatgttaagggcagccagagagaaaggtcgggttaccctcaaagggaagcccatcagactaacagcggatctctcggcagaaactctacaagccagaagacagtgggggccaatattcaacattcttaaagaaaagaattttcaacccagaatttcatatccagccaaactaagcttcataaatgaagaagaaataaaatactttacagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactgggaagaaactgcatcaactaatgagcaaaataaccagctaacatcataatgacaggatcatattcacacataacaatattaactttaaatgtcaatggactaaatgctccaattaaaagacacagactggcaaattggataaagagtcaagacccatcagtgtgcagtattcaggaaacccatctcacgtgcagagacacacataggctcaaaataaaaggatggaggaagatctaccaagcaagtggaaaacaaaaaaggcaggggttgcaatcctagtctctgataaaacagactttaaaccaacaaagatcaaaagagacaaagaaggccattacataatagtaaagggatcaattcaacaagaagagctaactatcctaaatatatatgcacccaatacaggagcacccagattcataaagcaagtcctgagtgacctacaaagagacttagactcccacacaataataatgggagactttaacaccccactgtcaacattagacggatcaacaagacagaaagtcaacaaggatacccaggaattgaactcagctctgcaccaagcggacctaatagacatctacagaactctccaccccaaatcaacagaatgtacatttttttcagcaccacaccacacctattccaaaattgaccacatactgggaagtaaagctctcctcagcaaatgtaaaagaacagaaattataacaaactatctctcagaccacagtgcaatcaaactagaactcaggattaagaatctcactcaaaactgctcaactacatggaaactgaacaacctgctcctgaatgactactgggtacataacgaaatgaaggcagaaataaagatgttctttgaaaccaatgagaacaaagacacaacataccagaatctctgggacacattcaaggcagtgtgtagagggaaatttatagcactaaatgcccacaagagaaagcacaaaagatccaaaattgacaccctaacatcacaattaaaagaactagagaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagaagaatcaaatagatgcaataaaaaatgataaaggggatatcaccaccgatcccacagaaatacaaagtaccatcagagaatactacaaacacctctatgcaaataaactagaaaatctagaagaaatggataaattcctcaacacatacactctcccaagactaaaccaggaagttgaatctctgaagatagaccaataacaggatctgaaattgtggcaataatcaatagcttaccaaccaaaaagagtccagaaccagatggattcacagccgaattctaccagaggtacaaggaggaactggtaccattccttctgaaactattccaatcaatagaaaaagagggaatcctccctaactcatttgatgaggccagtatcatactgataccaaagccgggcagagacacaaccaaaagagagaattttagaccaatatccttgatgaacattgatgcaaaaatcctcagtaaaatactggcaaaccaaatccagcagcacatcaaaaagcttatccaccatgatcaagtgggcttcatccctgggatgcaaggctggttcaatatatgcaaatcaataaatgtaatccagcatataaacagaaccaaagacaaaaacaacatgattatctcaatagatgcagaaaaggcctttgacaaaattcaacaacccttcatgctaaaaactctcaataaattaggtattgattggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattatccctgtttgaagatgacatgattgtatatctagaaatccccattgtctcagcccaaaatctccttaagctgataagcaacttcagcagtctcaggatacaaaatcaatgtacaaaaatcgcaagcattcttatacaccaacaacagacaaacagagagccaaatcatgcgtgaactcccattcacaattgcttcaaagaggataaaatacctaggaatccaacttacaagggatgtgaaggacctcttcaaagagaactacaaaccactactcaaggaaataaaagaggatacaaacaaatggaagaacattccatgctcatgggtaggaagaatcaatatcatgaaaatggccatactgcccaaggtaatttatagtttcaatgccatccccatcaagctaccaatgactttcttcacagaattggaaaaaactactttaaagttcatatggaaccaaaaaagagcccacattgccmagtcaatcctaagccaaaagaacaaagctggaggcatcacactacctgacttcaagccatactacaaggctacagtaaccaaaacagcatggtactggtaccaaaactgagatatagatcaatggaacagaacagagccctcagaaataacgccgcatatctacaactatctgatctttgaaaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaascgtaaaaaccctagaggaaaacctaggcattaccattcaggacataggcatgggcaaggacttcatgtctaaaacaccaaaagcaatggcaacaaaagccagaattgacaaatgggatctaattaaactaaagagcttctgcacagcaaaagaaactaccagcagagtgaacaggcaacctacaaaatgggagaaaattttcgcaacctactcatctgacaaagggctaatatccagaatctacaatgaactcaaacaaatttacaagaaaaaaacaaacaaccccatcagaaagtgggcaaaggacatgaacacagacttctcaaaagaagacatttatgcagccaaaaaccacgtgaaaaaatgctcaccatcactggccatcagagaaatgcaaatcaaaaccacaatgagataccatctcacaccagttagaatggcaatcattaaaawgtcaggaaacaayaggkgctggagaggatgtggagaaatagaaacacttttacactgttggtgggactgtaawctagttcaaccattgtggaagtcagtgtggcgattcctcagggatctagaactagaaataccatttgatccagccatcccattactgggtatatacccaaaggactataaatcatgctgctataaagacacatgcacacatatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaaccgcatattctcactcataggtgggaattgaacaatgagaacacatggacacaggaagggaacatcacactctggggactgtggtggggtggggggacgggggagggatagcattgggagatatacctaatgccagatgacaagttagtgggtacagcgcaccagcatggcacatgtatacctatgtaactaacctgcacattgtgcacatgtaccctaaaacttaaagtataataataataataataataataaataaaataaaataaaataaaaattttaaaaaaataaaaaataaagaaatttgaaaagtctgcccatttccttcccaacagatattaaaggcaatctgttgaagacattatactgaaaggactatcatattttaaagacaagatcactgtctccataggtttttgaaacatttttaaaaacyatatagctgtattaattagagcacttattttctacaataatagtgaccttaaatttctttaaaaaaattacaatwagctacaagtatcaaagaagcaaagtcatctagagtagtctacataggagctctttggactttsttttattatggtaaaatagtggtgcttttaggatttacattattgtactctccaatacaaagtatgagtgagggttagagtatacagtacaccattttcatacatgtacaacgtgggtggatgaagaatgtctcttagcagtaatactggatgtagtctctgcttttaccagctgcataatctaggactattatataagtaaaaatctctcttgtgawgcttgaaagtgattagaatgtgcaaastgatatagtagctttcatatgctcttaaagggtaccaccacaggaaagtccatttaagatgctggtaggtttaacaaagttggartgttggcactattgaattggacaacagttcttcagagctgactcagagctgcaatgcacttagtacattaaagcagctgacatgatgactttttgcgagccttcccaggcactggagtttttctgttaatctgccgcactaggtcataaaagatctcattaacatttattttgaattttgtakaagaatctaagaatgcacagttgttccmttgtcttgctagatttttgaccttsttccttccctacagctctttcatcttccaagtcatacttattaccarcaagaatcattggaacatcatcagtgtctttaactcaaagaatctgttctctcaagtcttgcaaatcattaaatgtggactgtgctttgatggrataaactaatgcaaagccttgtccatttctcatgtacaaatccctccttgctatacattgttccrttcctgcagtatccaagattgcaagcatacactgytgtgcatctacttcaacttgctttctataagaatcttctatcataggacatatttttcaacaaaaattccttgaacaaattgtacattcaaagcagactttccaacgcctcctgggccaagaatgactagcttayactcatgcatgatgcaaacttgtcgaaacctagtacctctcacgctgtcaccrggttcccgcagccagtgtcactccctccgggttgctactctcggcaccacagcagtcctgccgctgccgccgccgctccagctggtttacacacctgactctgggcgaggtttggcattgtccagaagggcctaagttctatcaagaaggagttcacaaagtggaaacacaggtcacatcacttacacaccttcacacacacacctgatccagtcactttcaartaaagcatgtgacaagcccacggtcacttcctgcctcaggatcgttgacccaatttcataaggttttcaacagctgaataaaggcaaaatatgttttattttagagtctcatttagaatctcttgaatactaccaaacaggtaaatgagttaaaaatttaatttctaagataaccacagctctagattctgtatgggatagaaagctacatccagtgacttctcatcactaccttaataatactagactattccagtgggaagtatcagtgattatatcaactgtttcttatgaagtgtttggctgtgtcgtcataccatgaatttcaaatggctcatcccatctacaaccaagagaacaccctgcagtcagcattacagaatatgatggaataatttgaatgtctaatagaaatctcaaatgctccaccctgaactggccatgatatatttaaattaaattttgaagctcataaacaatttagaaaaaagaaaatgtaaagataccatcacagccacagggtaaatattgtgattctttttttatttttatttttattaatttacttttgagacggagttttgcttttctcacccaggctggagtacaatggtgtgatctcagctcactgcaaccttcatctccctgcaaccttcacctcccatgtttcagcaattctcctacctcagtttcccaagtagctgggattacaggtgtgcaccaccatagctggctaattttgtacttttagtggagacgggatttcaccattttggccaggctggtctcgaactcctgacttcaggtcatccgtccaccctggcctcccaaagtgttgggattacaggcatgagccactgtgcctggctttgtggttctttttttwwaaaaatgtttaatttctcagacttacaaagaagaaaggtgatttggactccagctgagtcactttttaaatgatggccttcctaagtggactagatcaatgtcacatcaacctaggaagtattagctgatgattgagctgatgacttcttggagaaacacagcatacgtgggaggagagcagcatggtgggtcaactgtactatactaggtagtatctgatgaagcaatgcagaaaataaagcaaggcaatatatgtgtatttatgtatattgctaattacatggatagtcccagactctactataactatatataaatgtccagctatagataggtatctttaaatgtaagtatctttatatacacagctatgtatgtctgaaggcaaattagtgagaatgtcctgtcttgcctcttcactcamactgagctctgctgaaatgattccagacaratgtctaggttattcctaaagatctccagggaagtagatatgacagcctcttaatatttttaaatattaagtctatcagtcagtactaagggcacagccatcctcagctttaccatttacaactgtatgaacttaagcaggtcttttcacccttcccagcctgttttcttatctgttaaatgggaataaaaatagtgcttactttgtgcagttgttgagaggactgaatgatgcatgccaagctcttagcgttggtacctggttaataatgggcatcctgtatatgttagctactgttattatgactgggcatcaaaatgaaatgtctggtcattacattgctcatttaaatgtctccacaaggggaccaggtgcaatggctcacgcctgtaatcccagcacttttrgaagccgaggtgggcagatcacttgaggtcaggagttcgagacagactgaccagcatggtgaaaccccatctctactaagaatacaaaaattagccggccatggtggcacacgcctgtaatcccagctactcgggaggctgaggcaggagaatcgcttgaacccggaaggcagaggttgcagtgagctgagatcgtgccactacactccagcctgggcaagattctgtcttgaaaaaaaattttaaaataaaataaaaataagtgtctccccaagggccctgcaaaccaccttggagaacttcccagtaaccttgtgccagtcactgctcaaactcctgtttcactagctctgagtcagggcctgcgggtgtcagtgggaaggttgttttccacggctgtggttattatgcatcttattctcyttctttgttccarcttccaaggctgccctaggtcacaaaagaaatgaaccagaatcagaaggcaaacagcaaagactggagtcctagattcaagacctcaagagcccagcagtttacagaattctggatataaaacatggccttgggcctcccttccaaatacaacgatttcctttcaattaaaatataagatgtgaaggttttgggccccttttttgccaccctgtgctccttgttcattgaagtatcaygttccagcattggtggcattagcctcgtggcatttttttaagcatttcaagagtctaggtagcagcctctcttctgtgggggagttgccctcctcaaggagcatgctcacagaggcaacaagcttatgaatactttctcccagctcaagtgatgcttgacaagattggcagtcctgggctttaaactgccatctctgacatacagcgagagtcctacagaacacagggacctcccaccagctgccttgtctacacttcatcaccccccacacacacacccactttgcactctggcctgaccrtgtgatttgtacacaggtgtccaggaggctgtggtgagctgcttgaacaaacagactcgggagcctgctgaggagaacctgtgcgtgaccagccgccggcccccacagctcctgaagtcctgcaatttggatccctgcccagcaaggtaagggatgtgtggcctgccctgctgtccaggggcacgtacagaactgggcgcatctttcagtgggcaagactgtaacacttakttgttactcagtgttttgaaaaccaattagcatcagttcaaacttttagtcaaatccacttaagtttaattgaaaccagggctttggaattctagcccagtcaatggtcatgccagaatctggaagataccgtgcattcacttgagcctgtggcatggctggtatgtgtktgtgccacgcagttgctttcccctaaagggaacatgaggtgacmacagacttcatgggctctgccaccttttagcctgtgtcctaagcactcacaccatagtaatgaactggtctgtgaattgcagaatataagggcctgaagcaactgggtggtataattgatccactgtgaaatctatatgcacacagcatgcagattcatcgtagcatgctctgggktgtgtgtgtgtcattccacatgcgtaaaatcaattagagcatttcattgttcagccctgcctgggtctcattattagccaacattgagtcacagccttgattgaattaatcaatccaatcactgcttcagtccctacaattttatggtgtcttgagaaacttgccttctagatacttctttttgagcaaatctcatctatgggtttggaagggagacgtttaagaacyaaatccagactttcaaatctgctgatggaatgaagaaatgttgctgaatagggtcagatcctagataaaagggggaatgctgattttgaatgatagtttttctctttctgcaaagtgtgtcatgtaagaagtagttaatacctgtattgctgtcaggcattaacaatagtttgctggtcacgatgatgcactgcttgtattatttcccagctggctagattcctttctttgggacttggagggtacagatcatagtcctcctccaatcacatggaggcacatcccatggkgacactcctcctgctagtcaccagagttgttctgtatgatgatctgaatggtggaccagggcattcccctcttcaaatacagaagttaagagggcaactcatgctatattctccaaggcaaccataaaatcagtcagccactgctttggagaagcacccaacccatgagaacagcagtcaacaagatagagtcaaagtcaggtcctgtacatgaaatcctgagtaacctcgttttctatccctgccccacctggttccacatttctgtcctaacttcgcagctctctagttgttgagcctaaatgtgtgggcaaagggcaccaacttttctatttgactacagtcctgtcatctaggaagaagcagtatcgactcagcatggaacgcctgcaacgttctttgttaggcaaccaagaggcctggcttctcatcctgctgtcaccaactagctctgtggcctagggcgaggtgtctgccctttatgtttccacatctgcaaagtgaactggttgtacctgatgatctgagatcccatgacttgctyacatgtcccatgattctttattttgtagkcagaagcattaaacagctactcctgctgctgtgtgctaatcattcctgtaatttctgttctgcttatttgccattatttgaaaaacatgcaaaagggtctttctaaccacattcctgtgttgtaacaacacccaaatgctgaggcagtgccgaggagtcagtgcctgggacttgcttaaaactgctgggactcgtggtccctaaacccttctttgagcaccaaaacgaataggacatgagatgttacttctcattctcaaagtactaactatgtttaagttacaaaaggttaggttatcctgtgacccttttgttgactcacagacaagaacagttgttgagcttaatgttgtcgcatttgctccagataaactcaattctctgatttcccmccagccarctgtcaagccaacaggcaagacctctcactgggcacagccaggagtttcttgggtcgaccatacacattkaaacatttgtagaaggttgctaattgcaacaataaaggggaccaaagtataatggcctaatctcatccaagagtcaaaacagattttccccctaaaaatgataattgtatagaggtgcctttcctgtggaatatctcactctgatgtcagagaaaaatctctccttcccttctcctggtgttcaatgtatacagaaaataaaatgtgtttggtaggagcataatagtgtgttgttttcccacacaacccacaacctctgttctgttgggagcaatttaggtctttaattcacaattcttactccacatggttcagcgttccctgtacatttttgtgtgtcttctgatgggatgcaagtttctagaccgtgtcctttggggtcttggtctgtgctgctatgcatgtgtttaaaaaaataccatagcattttcagtgggacataacaaaatgacatttcaagtcttagtcactgggcctttgtctctgagaggtcaccccctgsttaagataaatagctttcccaggcmgttgttagtcccactgaacaccagtkagggagccactttttttcttgtatgtagtcagaattatcagatcacatggagaataccaaaggccctagagggcaagtccaatctgcttagccaggctttctaagattaaacttggcttctcttgactctgtgtgatggcagggattgtttcagaagcacatgtctaactttcaccaggtttaggcaaatacatcctcatacctggttattcacaataggaagatgtcttctcaagctggaggtattctgactgttccaatttgtgtgtttgtgtgcatgtagtgcctacattttttagaacactttttaaaaatagtcrttttctgttagaagagtactagattttagagttcttgctatcagctttgtgtctgaatcctcctttctatatttctgacacctagtataatgtttgacacatagtagatgattattaagtgtttattatataaatgagtatgaaggaccagggccaaatttataggtagcaatgtttggaccatattatcaatgacagctgggaagacctcagtgctttccctcctctgcatcctccttatcccttctctccaaccttccagatgctgttgatcctttccttaagcttaaggatttaaatgccaacttaaaacataaatagcctcaggattgaacctttttttttttcttttgagacagagtctygctctgttgcccaggctgtagtgcagtggtgagatctcagctcactgcaagctccgcctcccgggtttacaccattctcctgcttcagcctcccaagtagctggaactacaggygcccaccaccacgcctggctaatattttgtatttttagtagggacggggtttcaccatgttagctaggatggtctcgatctcctgacctcgtgatctgcccacctcggcctcccaaagtgctgggattacaggcgtgagccamcgtgcccggccaggattgaaccttttatgttatcatgtatgtatggcaaagtatcccccaagtaaggatacaaggacaagctttaatwgaaaagagagggacagatggaggttaagtaagttataggcattacccagggaggartttgattgtcgggaaagatggaaagtagtatatggaagacagatgttaatcccttcacaactttgcctaagattaaccataagmagttaggaccatttttgcttgtgagctgccagtgagaattttccatcaaagttaatgagtaatttgtgtgtctaaaagccatatcatccacccagtccttcagtggtgaaaccagctcgagggagaaatacccaaaaaggacctaagatcagtcattaaaaaagaaatcagcctcctattcctaataaggaggttttctgtgttataattatacaaggaatacatgaatattctcattctttaaaactcaagcacagcagaataaaaaaaaaagaaaggtataccttcccttatcaccaccatcttcttcagttctagttccttcttatacccagagataaccattgttaatgctttgctacatacacttccagatagttttctatgaatttatatacayataagaagawatacaaatagataaagctttttccctttgtaaatgggattttattttgtatattgttgggaaatttgattttgccatttaatattatgcactaaaaatcttttacatccctgagacaccaaaataaaagaaccagcacattgatttagacctactctgtcactttyagctatctgaccttcaagaggccatacaccttttgaatcctcaattttctcatctctgaaataggawcatagtaggcactcaaaaaaattcattatcttctcctttcttttcattttcaaactagtacttctagtttaaaagaaaacgtgatttttaaaaattcaggacttaaattttattagatgtttttatttaactaaagtcttaatacttaagcktcagtctgggcgtggtggctcacacctgtaatcccagtactttgggaggccaaggcagatggattgcttaagatcgggagttcaagaccagcctggacaacatggcaaaaccctatctctataaaaaatacaaaaattagctgggtgtgtgttggttgaggggggtgcctgtagtcatagctacttgggaggctagagtgggaggatcactgaacccagggatgtcaaggctgcagtgagctgtgatcacaccactacactattgcctgggtaacagagtgagaccctgtctccaaaaaaaaaaaaataagctttagcaactatctccctggtttacaatagcaatgacatgagcagcccaaggaaaagcagaaagtactacctttaaaaaaaaaagtgtatgactgttattaattatagcatttgatagcctggccagtgtgtgttgaaaagatttggtaaacgtatgtggaggaggrgaattaagtaagcaatgaaagccagatgctgaaaatgaaggaaattccaagcaatttctgcagctttgttctaacatactttttaaactaaacttttatttctgtgcaacagagaacagctgagtggtacagaatagataaacagggaagggagaaaaagctcataattccaggaacagtacttggtttctgccctccccctgccccagccccagtctcttttctcagacctaggatggttcttagaaccagcaagagctataaacgaagcttgagaatccctgtttgaaaggagagagttaagaaacacgtctgaaaggtcacagagtcttctctttaaaagcatacttcagaatgcctattttattatacactaacaaaatccatrtatactagcagcaaatgatttccaatttccaattttcttttatattagcttacaatggctagagcagaaggtgctgccttttaacacaatcatattttaatttatttgatggagctttcaaagccttgcaggctcttcctctctgacaacttgttttaaaggttactgtttcaacatgctcttgaaatattggtttatcttctgctgtactcctaaatttccatacgctgccttttggctctgtccacactaacttttaagtgcttaaagcaaaagtacaccagagctcactggcatccacagaaattgagtccatatccaggcgcctttgaagagttaatgctgttactactgtcatcccccttggtaaattcagatgtacttacactgtctctctgttttcttccattgatggataggaatctgccatagcctgttccttaatrgytgggcctgactgggccartgggagtctcttttgtttctctagtgggactgtattggcccagtgatcacaaatgtccccagcagcattttgacatcaacaagggtaaaggttatatgtttatttgcctcagggctaaaatgttyatttttcctagatattcttttccatgtgtgagcatgtgtgaccatggaaaggaatatctttacatcacctgttacatcaatcttgaatctgtgagaaatgagctttgatgatatcactttgcggctgggcacagtggctcaygcctrtaatcccagcattttgggaggccgaggtgggtggatcatctgagatcaggagttcragaccagcctggccaacgtggcaaaaacccgtctctactaaaaatgcaaaaattggtcgggtgtggtggcgtgcccctgtaaccccagctactcgggacgctgaggtaggagagccgcttgaacccaggaggaggaagttacggtgagccaagatcatgccattgcactccagcctgggcaacagagtgagactctgtctcaaaaataaataaataaataaataaataaataaataaataaataaataagacaactgccttgcatgcatgtatttagttgctgcatgagtttggggtaaaaatcaaggggttaggtctaccttcccatcatgtcacctgaaagcatatatgatatgactcattctaaagagatagaaacatcagcattaggaaaatccatgcaattacatcctgagagggaagcttttctggtttcttaacatctatgtgatcggacagcactttagaccacataattctgcctagactctgggaaatgtctttatatagaccgttggttaacgttaactttctgcacaaatattaaagcagagagtgtttttgcatcccaattcagagaaaaaaaamacacacacacacacataacaagcatctttgtgtctgcttgtatttggttgtcacggataacgagaagacaaaaccctgtcctaaaggagttaccagttaatagatgaagaagatttaaaaatagtaactttatgaatagggcaagcatggagttcggtggaagcttgaggctgagagaaggcttcctggaggaggcaatgcctatgctgaatggtaaggcmtaagtaggagttatccaaatgaagaaggaagatgttgcaggcagaaggaaaaccatgagcacaaaatgaaggacaaaaagtggaagccagtgttagagagtggacggaggccagatccaggagagtcctgtgtgccaagttaagttgtttagactttatgtcctatgggcactgaagagccattgaaggatattagccaggggtgtggaaccgtcagatttgcttagagaaagatgagtctggctgctcatccaagaaagctaaactctgaaaatggtggttagcttttactgtaggcacgtttcctttttctcatgtagagtcaaaaataaatagtgtgctctgtgtgatctggaccataacattttttcattgaaaaattaatgccctcctatcccaggtatgttcacattgtgattgctcctatgatcaacccagtgcatgttgacttggcctagccacctggcaggaggaggatacagccccaaggaagggtgtcagggcgtcatgagtgttgcagctatctgatccctggcggcctttccagctctaatattctgtgattctttgaaggtaatgataattatccacagaattgaagcttttcaacaaagaaggaacaattctaatcagaaaaataccttgagtcaaatttaagttccaaagacaaagcacctctattagttacaaaacaggaactggctttwactataaagagccacgagaagtctgcagggagcaagacctacctggccataagaaaaatgtaggtgaaagcattcaggcagcaaggatggctcaacattgaaatgctgaatgtttttataatgccttaatggtgtttgtttatgtgtaaagggatacaaatatcctgcatccgtccatttataatgttacgctgccctttaagataactagaatttctcttccttcagtctccactgaacaaatgtctattgaatgcctgcattgtgccaagcattgtgtgggagatacagtaatgaacaagacccactttgttccctgcagcagccaaagccvgagtttgggaatggtcctggaggggtcactctattttctaaatcttggatgccttaagtgctgctcttcttaagacacttattatcttaagcctcctgagttcttcattgcactaagagttgatgtatctgtaccagttatcaacctcattgttcataagcaccatgagaatggaaatatcaccagcagataactttcttctgtggatatggtgatgaaacattggagttttatagttcaaaaccttccagcttacaaatcaatcaacagtagcagagtggagtttcccaaaataaatcttttttttttctaagttttttgctttccttacaatctagkgtttccaaagtcctaaggtaacaatttaagagcaggcaataatttggctgatgctttgaaatgatgattattgcttcctaagtatacaagatgccttctttggaaattttgagcagaagtcctcatgaacaatttgacgagaagagtttttctattgaccttatagttagaaatatgctatattactatgttccttaaacttggaaaacaaagtaggaaaaggacttgagaaagaggtagagaaaaagagatgtttaagtgacataaaaatgagggagtgaaaaagagaatgctctgatttgtatccagtaatctggccgatacagttcaggaacagttcatacttgtgaaaatattattcctgtcatggcgccagccaaggttaggcagttcttaggttatctgctgcaggtgcagaaagatctgtcacaaagcagagcccagccagctaccttctttttcatagtgaattcttccgtcattcatgtcttttccattccctttctcttcttcattttatctagttatctttatccagggctgcagtgcacttaggtgtttatgtcagggacacaaggaaacctaagggaagaatgattgtcactgcattaacacagctcccagacctgtagatgctcattaccttctcatgaggcttcaatttttacatggggagttactgtccttgaggcctagacacgcacagacacaggccgtggkctgcatgctggaacagctgaaagtggtgtcttctctrtaacttactgctattgactctggtcactgagtggatagacacagacaccttttcggctgcctaaaggagctactatgtgattcacagaggtagaaagggccctctgcccgagttgcctggagcttgacacttactccactattagtgaggctgttaaataccaagccgtgacttattttgatcatatatatgcctctagaagagatggctgatggtcatctcagcatggtttttctttttttaccagatatgatttttcccaatgggggaatcttggcaatttttaagaattggggaatttcaggaggacaagaccaagaggagacttggcaakgtcaaagctaaatattccccaccaggagtagagatactgcctggaaaaaaagaaatatcatagggttttaagatcagacagatgttggctttctcacttgctctgtagcatgggctggtgtattaggctgttctcacgttgctataaacaaatacctaaggctaggtaatttataaagagaagaggcactgggtgtagtggctcatgtctataatcccagcactttgggagactgaggtgggaggatcacttgagcccaggggtttgagaccagcctggacaacattgtgaaaccctgtctctacaaaaaatacaaaaattagccggccacagtggcatgcacctgttgtcccagctactcaagagaccgaggtgggaggatcacttgagctcaggaggtcaaggctgcagtgagccgtgagtgcaccatgcagtcatgccactcaaaaagaaaaaaaaggaagaaaaaagaaaagaggtttaattagctcacagttctgcaggctgtacaggaagcatagcagcatctgcttttggggaggcctcaggaagtttccaatcatagtggaaggcagagcaggggtagcatgggctactacttcacatggtgaaagcaggagcaagagggacagtgaggaggtgctacatacttttaaatgaccagatatcacaagaactcactatcttgaggatggtaccaagaggatgatactaaaccattcatgagaagccatgcctatcatccaaccacctcccaccaggccccacctccaacattagggattatatttccatatgatattcgggcaggacaaactacatcagctggccacgttacctctctaagactcagttttccttatctgtaaaacaaagataattatcccaaccacagagcagggttggtaaggatgatcgcatatgtaaaacacttagctagttcctacctcatakagcaggcactgatataaataaggatttgctaacactcttacttttctatgcaggaaaccatatgatatagaccttcataataattttatactcaccgagtttattctgaaattttcttaacccactagtatggggcagggtaaagcgaagctatggatagaacctagcttcaagccagctttctgtacagccctcaccagatctcttaggcagttagacaacaggaagcagggcagcttgtcatcatggggtcctgaaaaaggagtacttgttgggacattccatttaatgttgacacctaatccaataaggtgtgttttgtaagtaccataatgagatgataaaatggtagcaggggagacagagtccaaagggtcattaaaaagttaatatcctgtgtgacatgactgaagggaggaaggtcctttgacaagaggtgtgatcctgaaatgagccgctgtgtcccgatggccagaaaggcctgggataaggcaggaagaaatcaggaagcgtcgatgaattgtgttattcctagcgttgtctcctctaatgtttgtgggagggaagaagaagaaagtgaggaaggaaagaaggaacaaagagagtaaaggaaagaaaagaaggaaaaaaggaaaagccacatcatggtagagttaaggcacagggcatcttgtccccatatccttgctgaccttcacaggtcatctttgagcaaggtatggcttccctaatagcttctatttattaagcacttacaatatgcatggcacagtgcccatcactttatatacattattttgattaatcttacccacaattttatgagaatgattccattcctatcctaactttacagctgaggaaacagtctttagtgagatatcttgtaactagccagtggcaggtccaaacttggaacaaggtatatttaattccaaagcagttactgagaacctgaggctgtctgtccctctgtcactgtgtttacagatccatccatcaccccatctgtctctcacactgtcctgggtactgtgctgtaaccgtgggaatgaccgcagtgtaaagaaccaactctagtctcatagcagcgtacaacctagtaaacttcacaagttaacaaggtctgctttcttcatctctatcagataaccttcatcttatactctcagttaccaaaagtaggactaggctcttggagaaagtgagcatttgaaagacagagtaaaaaattcattagagtacagatttctcagagcagagcccaacacataggaaatgaagcatgctaaaagaggagtctaatagagctaaagtgaatgtcttcaaccccaccactgagttattrggcaaaaagctcatttccttaaaaaaatagaaagaaatactaagacatgcagagaggtgctttgcttatagatctggaagaagctttgtatctttgttctgccactggcttagcttatgctttggtgatgcttgttcatgttgtaaattaccgacaccaccactccccccacacacacactcactcgctcactctctctctctgccccccaccccacttctcttctctttccccagtgcaaacctgggtccttgcctccttttctgtgctactctctttctgactttcctagtgcctgttccctctctcccctgaagacttattctcagtcaccttgccttttgactacccaaattcccagctgacccttctctgtcacttgtacggggtacagtcttctcacttccttcaactctttttttctcactctccaccacccccacccccattcattcaactcaactcagctaagaattaggaaaacaaaactacctaaactaattcacactaaggtgtaaatgactgattcctatccctttattccagctgtgagagcatgggcttataagtcccgtaaatcagggttaaaatccaattcatatagtatgctgcctctttggccttgggcaggttgttgaacttctcagggcttcagtttcttcctctttaaccccagagagtggttgtgaggagaagtgtgttaagcgcttagcacagtgcctcgctcatactaagtactctatgaatggtaatagagattagttttgggttttgtagggtattttacgtatctttgtaagaagcagtccttgattggaggatgtaggtgatctgtgtgtactttagaaaactgtgttctcaccttttttcctgaagaaaagacaggctccattatagaggaaagggactgcccagtctagaccaagaatgcccagccttcattatctcctcctatttgctctaatccttgggagggtgggcattttctactggttaagagaaaatccagcacagytcagcaaacatttataaaattcttactgtgtcataggttctggagaaacaataaagtctaggacatagaccctgggccgcgcactaacagcttattaggaaaccagtatacaaacagttacaaggcagagccataacagtcatgttagagatatcagccagtgtcttatggaaacacagagatgatggattcacctaatccaggttagagaaggtgaccttgagaaggtaaccacgagctgagtctcttgttcttagagctggtaaaatattttttcttaaaaatctaatcacacgtgtgattgatatactaattagatattcccccagagtcccaatccaggctttycaagaaacctcagggcagttttgtgctgtgccttccatcmcctttcagtcttccaggtaagcctaaaattgcttgattccactgtgtaagagtatctctagttactctcagtgaccaggaagctgatagatttttgtcctgtaaccacataatgcaataatcattatgccaactgttaaaaatggatcaaattaacttttattaaacctctgtccctatggacaacactggaacttgaagcctcacaatttatctatagctttcrtgtgttctccaaggtaccatgctgcctcagacacctctcatggctcaggacatgcaagagagagaccaagaagacagggaaatgtatttatgttgcatttcaggcaatggtgaaaaactatggaagacagaaggaccacatggttcatgcaatcccaatgacttgccgtctccctcagcagtaaactcaagaactcttgggttagaatgttttgcgaagttttctgagttccgtgaaactaggtgttatagaagtataagatactgaattattgctctctccttatttcttgttttaaggcatcccttcatcccttgccacatgagatatttcaaagggttggttttcagagccccactatctgatcagtcttcaaaatgcttgcttattgtgcagatgtcattggaagatttgcttaacacagagaaacagcaatgctacagagacctctcagatgtggaatggacattcaagttgttttgaagtttaaagagtaaaagtgtcaggaaatgtatactctggcattagtaaaaccccacatgtcaaacatgggttacccctttatcagagtcaaaagtgtaaatgggaggacaccgtagatcattactgaatgtgctcaggatgctctttgagaagtcagacggcattcttttttcytttttttttttttttttttgagacaaggtcttgctctgtygtccaggctggaatgcagtggtgtaatcatggctgactacagcctcaacctcctgggctcataaagcttatgtaactgatgcacttactggggaaattctctcaaattaaaaaaaaaaaaaatgtgtaggtgggcaacagaccccccacctccttctaccatacttttcctgcctcaacttccaccctagactagtatgccaacaaaaatcagagaatgtgatgaacagagtttgcacagttttaaatatcatcatgctgtagaaaaccacagaaggaaactgatataaacaagacatttattgatgtaaagccaccaaaactagactatttatcaatgttgctttcatgagaaaatgatgccaaaattctaatatgaastagaggctgctttggagccagatctccctcacaagatgcgccccactgtccagtttgactctgtggctttcgggggttagggagcataaacggtaggccatttgttcgcaagtgaggggagacaagtgagtaagatgacagtttgggggacaggaatgcttccatttctctcttcttttttctgtgttacctgctaggtactaccataggccttgggaaggcacatcccaggcacacctagaaacaccttatgtgaaaatggatagtgtcaggcactttatctttaacttaatagaagttgacaatrtaactgacccatggtggagtgaagtgaaaccacatgtgggctggattgaccctcccttgatctagaaaagaaaaagtgctgttttccagctcacccttgcatacctaactcctycagcagggtagctctgcatgacaaggttggcaagaggtagactactttttaccacacatggtcttactgcagttgtgtgtttgtatgtgtgtagaaagtggtcccatggattatattcctttctcttaacatatacaaaaataatgttgaagtctgatatatttgaaaatatcttgctacattgtttcatcctcaaatgtgtaaaattatctttccattgtctctctgtgcagaggtaaactttaaatggaagcctaccccaacatttatgccatttccataactgtgtaattatttgctacttaccacattttgggagccccaaaaccctcctctgtaagcagactagtatctgaaatagatgcattttctgaatatcaaatgtgcccacttgtccacatagaactctctctgcctgaaaggccaattaaaaaggtgaagtacaggccaggcgtggtggctcacgcctgtaatcccaacactttggaaggccgaggcaggtggrtcacctgaggtcagaggtttgagaccagcctgaccaacatggagaaaccttgtctctactaaaaatacaaaaattagccgggcgtgatggcacatgcctgtaatcccagctactcgggaggctgaggcaggagaaccacttgaacccgggaggtggaggttgcagtgaactgagatcacaccattgcactccagcctgcccaacaagagtgaaactctgtctcaaaaaaaaaaaaaaaaaaaaaaaagtgaagtacaaggaagacttccactccagagccccatgcccatgccagataatatggatggatcatatcacttcaccagtgagtccatgatcttcaagaggccttgggattccttcacttctagtgattgagggatgattgtcacatgaagaacttggtgcatgtcaaactctcatcacttcccaataggstttattggcactattagtcctatcgataccaaaagatcatatggcttcattctttatattccaaaaagccagagtggtaagaagtttagctgaaagatgtgtctagaatctaaaaatttgacaaatgagtctcccttagtgactagggttgtagaatcccagaatgtaattcagttaaattctcccattttatctgtgagaaaagagaggcaaatgtattaagcaacttgtccaaatagacactggctggcaaagctcaaagcctgaaaagtaatgttttccaattttgagctcagtgtttatcataaactggaagaaccaagagctcctttagtgattcggaatgtagtatctagagccagacttcctgagttcaaatcctggctccaccacttactgtgtccttgagcaagtcatttaacccctctctgtcctcatttgcttatctataagataaagatttttaaaagtacctacctcataggggttttgtgcagataaatgaattaatatatgttaagcattcatgtgagttcctggttaattaagaatagattctatatttgagtgtttcagttgctaaaaatgcactaagagctggaatcaggtgatagaataggggacccagatggtcactagacatcatatatttttcactaggataagaaaggattttcttacagccgtgctgtgagaagttttgcrttttctctatatcttagtctttaaaactatggaaargaattgagtatgataatgcarttaccccaggtaaaaatcttctatgctttcaaacatgtgcgtagccatcaataagaaaaggattccttgctatctgagagtgaaaagtagagggtaaggggtcaactagacaatgagagtgggaaagaaagaagatggttgcattcatagagtttgaggatttttctagtaatttagtataaaggaatgaaagtcaagaaataggaattcagctgacctccgtgtggctggcttggggtagaaacactctccatgtttttttgcaacttctgtgtaatccartgttcttattcagaatctaattgctgagttgcccccactgtttctgttttcctagctggaaaaatagataatctgctctgaggatcagagggcaactagaaaattctctgtggcctacagaatgtgaggctgcatgaagcaaaacaatgaaatattgtaaatgtgggaggcaagcaaaattaaatagaaaaatagttactctaacttgggtatagcaatagcagtaattccaagcataagcaaaaaggaactccaaagaccaattctttctatttttctctcttgtgtatgagaaatattataacaatgatagcaataataatgatggcagstaccgcatggtattttgtttccaacacctgtacaagctagaggctagcagggaaaaacacarttaagaactctggagtgagactacttagggtcaaatcctagatctcttacaactagctatgtgaactcggccaagttacttcaattgccctatatataaaatggtataataatagtacctatatcttagggttgccatgaggattaaaggaattagtacatgtgaagttcttacagcagtacccagcacatagcaagcacccaataactactggaagctattattgtaattattgttatcatccttattttatagataaatgagttggcattcaaaaagggtaactttcccaaggtcataaaacacagatggaagtggatggtatgttgaaattcaaagttctggggcagtctggttcttgacattatgctcacatgtctcctacttagtaaatacaactyagggatttaggccaattcatcagttctatcagatccaagtgtgttkaaaaatagtgtcccagggataaaagtcctagcaataaatgagaatcatggataatcaaaaacaaatgagggatttaataagccaatataaatcctaatatgagggtttcaatttattcaggcttcattctgataataatcccttaactcgccctgaggtaacaaaacatcaaagagtaaaacatgcattctacatgaagagatctttgaacctaacttgaaaaatcagtttaggtcacttttgtgtggtcatatataaaaacatttgtggaaagcytcattctcactccccacgtcaacaccctttagggctagaaagtgcaggggctgctgttccccatatcctgtgaatagaacatctgtgtgaataggaagcctgtgcaaacagcaggcactgcccacaggggtgtgtatgtgtatgtatcaygcatatgcatgtgtatcaatgcctgtgtgtatatgtgtgtacatgtctactatctgtgtgtgtgtgtgtgtgtgtgtgtgtgtgtgtctccccagccctgagggaattaatcacccctgcatcaatagctagctgcttcgtctcctgtcttctcacatatcaaactcctgagacagagacagggagatctctgcatgggaaatggcttcatcttttgcattcctctgccaagccaggcttgaattggtttcatggtctgcttaagcagggttgagggcctacttgaagcaacatgtcacccagtgctgtgtcctgccaaacttctcactaaggctggcaaatctcgggacagacaggaaaagagcctgctggccattccagcactcagcggattaggggaggtcaagaagcctaatctatgaggctgtgagcttgaactgtagtgagctgaagtcacctttgtcattaagggtttggctgcccaaagcaccactgcttcccagtctcccccacccgcacccacccctacataattatatcaaggagagaagagaggagcaagaactagagttttccaaggatttactaggctttctactcaatgttcccttcttttttttttttcttttwtctttttttttttttktttgagaggagtctccctctgtcacccaggctacagtgcaatggcgcaatctcagctcattgcagcctccacctccccggttccagcgattctcctgcctcgscctcccaggtagctgggattacaggcacacaacaccaagcccagatcatttttgtatttttaatagagacagggtttcaccatgttggccaggctggtctcgaactcctgacctcagatgatctgcccaccttggcctcccaaattgctagtattacaggtgtgagtcaccacgctcggcctcaatgttctttctagtcctgagcatgggaatttcaaagtcccagttccctgaaggcttcatggaagcattcttatacctcattctgcctggaataccttctttttacttctgcctttgcctggctaccacttattcacctgtcaagactcagtctggatatcaccaattttaggaagccattgatgatactacctcattcctctcaactcccaatctatgattctgtcttagattgtacttatctgcttcatagactagactctgtgccccaaggaaatagggtagaggtctgactcatttactactctgtctccttacataaagcctggcacacaaaaagtgttcaataaatactaatyaaatggataaataaatgaatagcatttgttacagtatcttatggttgtctctaaaaacccgtaaaatcaagaatattttgaaaatctctatgtcccaatcattcagcataattctcagtacatactagattttcagcaagtaaatgcatgaatacgagtacacatacacatgtgagtggctgaatagatgggtagaattaaaaataaagtctgtaagactgcaaagacaattatcatgaaaggaaagaggaggcagaatcttatagaagctaatagaatcaaaactgtggatcctgacatgaagactggccttcccaggcatttcacttgtagagaaaactcatgaatataaatgtccagaaagatttctatttgcaatgtaaatagatggattaaaaactactcaaaagaactaactcaagggagtgtattaatctgctggggcttccataacaaacaaactgggtgggttagaataatagaaatgtattccaagactagtgtctgaaatcaaagtacggacagggccatgctccttctaaaacttgtaggagtaggggccttccttgcctcttcctatcttctgatggtctgccagcaatctttagcatctgtcagcctgtgaatgtgtccctctaatcctcctttgcatggctatcttcccytctgtgaatctatgaatttgcttccagcttttcttgtgtagggtgttcttcaggttgctacttcaaggtcaaggtctgattcaagcccttcctcttccagcagtgttgcccycaccatctcaactcattcaactcaaccctccttgcaatttgattggatttactgccatttacattctacaatacttactatgtggctgttctaagtagagtgctacagcatcttatctgacgcatagccatcttcccctctgtgcatgtctgtcatggtgtcaaatttcccctttcataaggataccattcctattggattaggatccaccctagtgacctcattttaacttaattatctccataaaggccctatttctaaataaggtcacattctgaggtactaggaattaagactaatatatcttttgcaggaacacaatccaacccataataaggagaaatacttaggtttgtagggttttagtgagtaatgccacctacaaatcagtaaatagagacatttatagcctgattggatgaatgtcaaattatttccttaatcccaaggcacttgatcctaaatcttaaatgccttgtggtctacttgggatgataactagggggaaaaaaacatttaagyaaagagaattgtgtcagattaaatgctatagcagtttacttagaatagctgtgtagtaagtattgcagaatgtaaatggaagtaaatccaatrgaatctcaaggacggtacagttgatgtgagctgggatggtgagggaaaccttgctggaagaggaagggcttgaatcagtccttgatcttgaggtaggaacatgaagtcaggaaaagctggaagcaaattcacagatgtgaaagagaaacatggtgtattgggaagccaacaagtggctgtgcctggcagaaactcactctgtataaaggaggtaattctagaaaagaaaaagggttcatttartggaaggtttttaatgtgaagatgctaatcagttaatatwaaatagagacaaactgcaataaaacccaaaatatggtattagrgaagaaacacaacaatagaggacaccattcatgatgcgagtaatttcttctatgatcttgaccaccacaaggagaacaaccctggaactatttttaacaagaaatttatacctagaaatctagacaaaccacctaayatatcaaactccttggagtaaaaataactttgcagatcatctaccctactaatttgtttctcaagaggctcatatctgaattataacagccagcaggaattctagctcattttaatgtgctatcactcagaagacagggtgatcagaaaatgggaaccagaacttagaagttttaattaaatcaagctctgtgtaggtgaacaggcacattagtatttttggacagtgggatgtcatagaaaagtgtgytagagtgagggaaggctgaagacactttatataattggacctagttttggtgttattctgctatttgccatgttctgtaaaggaagtaggtttagatgcaaatggcatgctagtaatgagatggtaaatgtatatcttgctgcaagtgccatttttttcaagagctatttattaatttacaaaatagcaaagacggtttgacaagagtcatatgtaatgttggtaacattgattttattttttttaagttattttagagatgacttagaaggtgtggcaaattggcgtggccaaactgttttcaagcagaaataagtgctttgccacttcaggtgtttgataatcttggctctcactatttttacggagccaaaacctcacagcgtgcaggcagacttccaggagaagtgtggctgtatctactatttcctgagccrtgcaagttactgtttgatagacagcccccgattctcatggtgtgatttatcatacatgtttctggttaatttttggctttcaaacatatttttgctctttaatgtctaatatctcctttgatcttttactttatcttttctaggcctcttttaagggttttctagaatacagtggttttaagggaggagtagcaaatccatctgygatcgctgggtataactgcttttctgactttgtctatttccctctctctgtaacccttcgtgattcactcctccagtccttagagactgagcagggtagaggagtaacccaagtgcccatcccaactttgggaaaatcacttgtttctctgagccttggcttgcttgtcctaaaatggagatgataatgcctgcttgcttacttcagagttaggaggatgaagtgagataacataaacagtctttgggaagtgcaattcatcaggtcaatgcaagtagttatgagcaccacaatgcacgttttctgaactcttgcagtcctcatggtttagccaaatagtttagcagttcgctcataactgttacctaacattctttgctatgtctcctgggcttttgtctgctttctccatctttgctgaaagcaccttaaagatggtaagcatggtttccacttctggatctgtcacaatgcttagcaatgaawgcttaaatgagaaactaagttgaacatgtcacaaatgyccttctcctcagtctccaaaacctatggctactttctctgactgactttaggaagctgcctcactctacttacttgtttcccatcctcacaataatcatctctgcattcaacaaacatttactgagcatgcagtaataaaagttcatattggctaatacttacagagcccttcatctgtaccaggccctgggtttcaccctttacatggaggttctcacttgaacctcataacagccctgggaagtaggtattgccattattcccattttaaatatgagtgaattgttaagtaacttccccgagattattcaactgcagggtggcagagcacaattcattcgcaaacaatccgatcttagagcccaaggtcctgtattatgcctcaatatctgggggatttcttcagtcttctatctttcatatagttgacatttttgaagagtacaggtcagttactttgtaaaacgtctctccatgtgtgtttgcttgatgttttcttgtgatttttgaatttttgacagaaataacacagaagtgtgctatgttcttcttagtacctyatatcaggagacagatgatgatgatgtgtctcattactggtgatgttcactcttatcacttggttaagatgatggccagccaggtgtttccactgtaaaattaataaatatgtagcacttaataagtaacaaagaagtattttatgggggacaatatgagctaagtaratatcctgttcatcattaacctttgacccactagatttaatattgattgatgattactgcctgagtcaattattattatgatgattgccaaatggtaactttataaattctgtcattccttctagattattaataagcattctactctaaggtagttttctcttctctctggtttatttatttatgaatttccactttgctcaaaggattaaaatatattactatcaaattgtcccmgacaggaccagcaaaagccctttcaagctggcccctatgcccttttgacatataccccatcattctttgagcacttctcaattttctggtacaacatactatttcaggctcattttttattctcccaattcctgcccagacgtcagctatttctacagaaattgattccttttaatggagaatggtatttagaacccaagatctgggcactcgatttgcttgatactactgggatgtcattgcttctaggcctttcagagagaactaggaaatactgtacacatatatgtatagttgtatatactcatttatatctgttgatatatctgtgtctatccatctattaaaaaccatgagttcatactgtttgcaacagcaattcaattttactagatttatcttagtctttccacttcacatatttgtaactctctcctctgacagtaagaaatctggctcccattattttttatgtatttatgtgtttgttcactcctccctgaatatttgactcccagccatcctggcccagcgctgacccctgtcccaggccagaggaccactccccaccaaacctcacactaaagttcagtccctacaaagtggaagaggaaaggaaggaagaagaagaaggaaaggccagtttgaaagttcaactccagacatgcagtgccccgttgcccccagggagcaaggctgagccctggacatactagctccccacctccactgaaagctcagcttgacaccagtggaggtttttaatcagacaaagtaaggtgaccagattcacatttttgagtgacattttggtggctgtggccttagggagaaattggaaactgagagatttagagataaattgggagccactaatgacagtccaagaacctgaaagggagatgcatcctgaagggagatgcatcctagaccctgtacgtgcccctccttaggctttctagagttggcacacttagtggtgtctagtttattattgtcagattgctgtccacctcccgacctcagaggcattctaagggaaacaaatatctttggaagacaagaaaatcacaggacagaagtgttgggcagaaatgtcacacaagtttaaagaatacttctaaaaaataacttcagtttacaataacttcagtttgctcctaaccaaaacttcattttacatttctgamtaaagaaaaactttgctgcaaaagtcgaggtaaaagaaggttcttagggcataatagctcagggtgggaagggtctgccattagaaattatgaacatttataccagcaataaacaatgagtttctggaggcaacagtcatcaccctctctgaaagagcagaggagcaaaaccttggcaactcacataatgagcccttgtccaaaggaaggcaaaaaaaaaaaaaaaaaaattcctccttttgtatagctaatacaaacacaagctgccaagaagggtcaaccatcatgggtcgttgattacccatattaaccctgatggctgcctttacaaaaaactaacacttggggaagaccacactctgcctttgcccatttggctgccaagtacactgctgctttactgaaataacaactgcaagtggattcatggccctgggtggtatcagtgtgtttgtttctattatttagaaatagatctgtcattttgtcacttgtgattttctgaaactataagcacaggaagcccagcatttgccactcaggtctattaatactttgttctattgaccttaagagagagtataatataataattaggcatgcaggagccaggccgcctaagtttgaatgctgattctcttgtttackagctgtgtgactttggacaggttacctaacctctcagagtctctgttagctgatcctgtaaaatggggaaacttacagtacctttatcactagtaaataagtcaatatatgttcccacatcttaggtaagctaagttctgggctctgctgagacctcagtgaatgaggctcggatcatgcagaactgaggttcataaatccacagagctggtcccatgataagaagcagccccattctcggtgcctttatgtccatgtcatggtggacttgggtgtgactctggtggcatggcattgaggaatacccagcagcaggcattctgggccatgatttgaattctccaggcctcagctcctgcttgttaaaatagagaggataatagtacctatctcaggaagctgtggacaggaataatgcatttaaagcaactagcacagaatctggctcatttaagtacgatataaatgttartattactattgttattggtgaccatgtgtgatgtcagctggattgtggtcacgtcacagtttttagctcatgcatggctragggtgctctgcccagcccaagttcaagggctagccagatccaggcagagagacaggaccacagtctagtaggctggactttaggcagaactccagcactgtccgggaaacaaagtggcaattaggaagccaagctgaaagcttaaaatccagttaaagtgacaggccaatccaggcacacttgaggctgggcaaagggcaggaagactaattccagccattaaggtggagggagaccctmtgtctcctgcctgcccctggtcagaagtcagttgttcaggtactgggcagggtcaagccaggagggcttcagcttgatctgtcaactcatggaggctttcctgcaatcaggttttgacaaaggggacagaaacagggagaagaagggctcagaggaaagaaagcagtatagtaaaagaatgctggggaaaccagcctcccaaatattttggccaagagcccaaccatgaagctaaacacctgaakcctaggagctgaaagaaaccatagcagtcatgyttaccaccctccttatctagggacacaatcctttagccaaaaccactggggcagatgtctttcagattccaaatttttttgtactttagaaagatgttaggattactaagacataaattgtataacacccctagcaatttctgggggaaaaacaccataatccaacaagctaatcttgctgtggtaaaatgtataaatatttacacaaagtgggatgcagcctgtcaaaagcatgtcaattcagatccagtttgtcacgaaaagagtttacaccacactgaaggaaaatgtgtggtgttcagagctcctgggaccttgaagttgggagtaaacagttgtgtagaggacataactaagatgtccaccagccatgtgactaatccagaagtgcacacacagttcactgcaaattcaactcagtttttcactgcatactactgaacatctgccaggtcccaggcaccatgctcaacactgaggttctggtcgtgtattcatattcagagctgctatatcaaagtaccacaaaccaggtggcttaaaacaacagaaatttattgtctcacagtcatagaagccaaaatcaagttcaaaatcaaggtgtcagcaggactgtactccctctgaaacctataaggagagtccttccttgcttcctctactttctggtggctccyggcactcttcggcattccttggcttgtagatgcatcgctccagtctctggctctgtcgtcgcatggcattttgcctgtgtgtctccctcttttcttataaaaaacacagtcgcattgaatcaagggctcaccctactctagtttgacctcatcttaagcgattacatctacagtgactctatttccaygtaaggtcacattctgaggtactaagggttaggactccaacatacctttttttggagacacaggtcaacacataacaagtggtaaaccaaaatagacatagccccatgctttcatcaagctagcagtcgagtggggaagtcacattacaagtatgttgagaatttccaaagggggaagtattaatgggaccatacagtaagagaattttacccagttgagggtttcctctctgaagaagtagcattttaaatggaaaggaaaagatgaataaaagccaagcaaagasgggaaaaaggcactaatgccctcactctctgatgcctagaccagaycccctgtcctccttgcaccaggcttctgcagaagccaggccccagaacctcagagaaagactctaagtgtatcccaggccaccactcatagccaaccttgcccccaggccggctctgcctggcctgcatttcctctctcagaaacagccaaaggcacagaacgcacggaatagggcatcagcccccagcaagacccaggcccacacttgcaggctctctgcaaaagagaagtagggaagagtctctgctttcccttcattggcctaagttgattacaatattttttacccagaatcagcaaagtccttaatatacagacagcttctgctgacctccgtccttgagaatgcagtgcacttttatcagggcaggcagrtatgtctgttttgtgagtttttctgagcagtgctcaagtggcctcatggctgccaaaaggcctctgcttcaaggtcccaggggctaaatttctgccagaaatggtggcagagtttggggaagtgaggatgtaaagcctctactttgatgagcttaaccttgggacagaattagctgtgtaggcagctattttataagacatacaaagagggttcaccagcaytggccatggatgttagattttgttttacacccacaacattttagtatttcccttgagtggaaagaaaaccttttttkaagcataatacctgtaaggaaagtacacacaaatcctatgtgtacacttggtgacttttcataaaatggacccagatccagcccctagatctagcaaacaccccagaagcccaccccactctactcctcttctagtttttacccaccgagggtaaccaatgttctggctcctaacmcagtggattagttttggcttttgagcttatgatataaatcacacagtatcaatttttgtgtttctggctttgttcattcaattttatgttkgtgagattcatttatgttgttgcttattgttgcagtttattctcattgctttatataatcttgtgtgaatatatcataattttttattcattcatgtgctgatgaacatttgggtttttccaggtttgggctattatgaacagtgctgccatggatattcttgcatatgtcttttgatgaatatatgcaaattggggagaggtatatacttgtatttggttgtctattgctgcataacaaatttccctccaaacctagtagctaacagtgacaataaacattgatcacctctcacagttcatgtgagtgaggaatttggaggcagcttggacaggcagttctggcttgaggtctttcctgaggttgcagttatctaaaggcaagcttggggctggagggtctgcattcaaggtagctcgctcacatggctggcaagttgatgctgattattggtggggaggctgcagtttcacacaygaactttccttaagactctctgggtattctcatgacatcgtggctggcttcsccaccaccgtgagtgggcaaagagagagcatcaaattggaagcattatcctttttgtgacctagccttggaagtcacatagcatcacttctgcctcattctattcattagaagtgagccactaagtctagcccatactcaagacttcacctttggaaggaaggcatggcaaagaatrtatggatgtatcttaaaaccaataacaccacaatgttttaaagcttataattaactcaatctaagggtttaaaaataagagaagtttatagaaatttacacaaggatctaaaagaaataaattcaagccagcttctcttcttctattcatttaaaactttgcaaatgtccatagagttttcaaggtattttttggagacagcatggtacaatagaaagtgcagaggctctagagccagaaacaaccaagtctgaatcctggattcactacttactaattaggggtacttggacaagtcagcctcttggatttccaggttccctcaactgtaaaatgaaggtaatcaatagagcttatctcatattgttctggaggcaattaaatgagataatgtgttaaggtgccctctatgatgggaggtctcatcgatttgctcatttaaccaataacattaactatctaaaaggtgttctgatggaccctgcaagtaatacaaaactgactcagatgcrggccctacatcaggaggtatacactctagcagtgcccttgacaggtagaataactgtaatacaactgagaaaatggtcagtgtctggagcaagtatggatacagtgttttaaatatggattatatttggatatatagaaatgaaagacattttgaagggcaaggaaagggcaaaagatattccaaattagaaatacaacttgcataaagacacaactagaaaaccatggggcataactggagaataacaaacagattattacagatatggctaagcttagtgtagatgaaaggaggtagtggaaacmggttggaaagttagttacatgtcagagcagtaggaaaagattgagtgcatacacttaatattacagtctgatgaaaaacattaaggccaaaaaattttcaaccaactttcaggacaaaagctaggtgggactagctactagaggatctacttaccatgttttcttggccaattcctgtttgtaaaatctttgtgcctcagactgtaaacagaactttctaaaactgatctttagaagatgcttctgacgtacagcctgagccactgagctttgtccttatcattcccagtttgtaggctgcatcagcagggaaatgcagtgggattgttttcataggcccttagctcactataaacgtacttctcaagtcttggccctttggaaatggccagttcgtgcactcaactcatctgcgtatttgagtgctacatccagataatgagccactctcttcactttacttcccttcaaaaagactgatcgatggagcagccttcatttctgttacattatccagtcccaggcagtgatgatgtttaaacgtaagacagagacgtttctatgcagcaatggaactttaaaggaagctggagccaatgacctttcactttgaagccaaagaatyacaagcataaaattttcagtcttgctaagaattggggctggagaaattagcagaaagtcctctttaagccccacaattcagtatgtggtgcccaaagcctttatgtactcaatctatgtctcatttagcacttccctcttattttgatgaagtttatatgtgccatcagaataaacatggttgtaaccattattggtgattttgtgggtaaaaattggatattccattttatctccctctttgctttaatgtaaatgaattctagagcattaagggagaggatagattctaggcttaagatagagctgccagccaatcttgggctggcacttcccactttcccagttaggggttttaactccatttgagttcatgggaaacattctctgcacaggtactaagggtgtgtcctcttcctctctgatttcttctcaggtgggaaattggcaagtggagtccatgtagtctcacatgtggggtcggcctacagaccagagacgtcttctgcagccacctgctttccagagagatgaatgaaacagtcatcctggctgatgagctgtgtcgccagcccaagcccagcacggtgcaagcttgtaaccgctttaattgccccccagcctggtaccctgcacagtggcagccggtgagttctgaagttactcaatattggagcttttgtttgcaacagtgactcaaaaaagggatgctctctcagagtggttttgtccagggatgttaaagggatgttcaagatctgctcatttctcccttcttagtactcccctaacctgatttacatccagatcttttaattacaaatatcatgctttttctactgtatcacaccccagtgacctccaaaagcaatgcagatgacccatctgttaacctgagcatatttatgacaaagctgtcacaaagctaaggaaaattttttaaaatcaagacaatgtggtgggtttgccataaagctaaatttgttcttaatttacaccctttctagtttttttgctgtttaaaattctaagaaataagggtagtaggcaatgattttttttaacatcattacttagcaatataagaagttagaaatgctgagccaattccaagtatttttattttcctggtcctgtgaattccaaaagtctgggaaccactgtttcaaaacaggggttgacaaactgcagccctcaagctaaatctagcctgtagcctttcttgcgtgtgtaaataaagttttattggaacacacccattattttacgtaccgtctatggctgcttttgcactacaaggcagaattgcgtggttgtgatagtgaacatatggctcataaaatctaaaatacgtgctatccctttacaaacaaaatttctgatcctgcaccaggcatatataataataacacaactattttatcataatttcctatctaaaaataatatgcatttatcaaacgttaatrtttttgcatgccttttaaaaacacaggattttaggttgattgcatacaatcttattttgcagtttgctccctattaggacataagacactgctttaaagggacaacaaaggccacaaaagtaagcatgaaaggtggaggagacatacatctctgtttcactgagacagtttcttcactctcaaaagtgtcccaatttgggtgataaaggatatagtcatcagtggaaaaggagagaggacgacagctcacataccattgccttgtgcagaagggtctcccatttccaggcagccacgtgtcctctgtgctttctcctaatcatttggcagagcccctccctyctccttgctccttgcccatcttggagctgtggtttagtaaaacactcaaagaatcaaatactgatgaataagcaaaacactaagtatgaagcctctggcaacagacattaaatatatattttcttttagagcttaaatgtatatggctaagttcattaattccatgatactatggatggtttgtggaagaggatgtcatatattttgaacaccaatgtaccagcgcttaagaaatgtatattatcgctcaccaagctgaagtaaatcctcacaacaattcagttaaaataaggttttattagccttactttaggtttgaggaaactgaggcaaacacagctagcaaatttagggttggctatcaactccgtcttatgtgaccctttccactataccaaacctattgtgtatggctaaaaggcctttcagggattaaacatgagcacttttgttttacagatgatgtaactgtggcctagatgtaggcttccttaagatcataaaacctggaccagaacccaggtcacctgattgctagtgcatttatactaagttacctctaattggagtgaatctatgaccttaaacggcaccactaacccatgccaatcctaataaaaggtgagaaaccatctcaaatcaacctccactgttgaaattgttaagtccccatattattagtagcttgttgctattaggtacataagttatggataaaatgtttactgaatgatgaaatgaatgaatagatgaagaatgctccttataggccctgaaaatgctgacttkacatcttcctgatatgttttttatggttataggtcttaatatcgtcctagtcttgaaatgcagtgaaacatcaatgtctttttgatagccacacgtgctgctgaataatgacattgactcatgatgctttttcagtttttagggcacagccatatatatgacctttttttggtcaattgccatcaccaccacctgtatgcccagcatccctatttgaaacagtggacttccaaagaatcacttattcttaaattttcatctactttgggcctgcgaagatatgaatttactttgaaagcttttctatttccttctttttgggagaagcatttgaggatgagtcaggtttaagttcattcttcaggttgggaaacttaatagtaaacaactgtttgaagttcatccaatgcatcagtgactacagtttaataggacctttaaaaagtctcttctttcacacctgagacacaataattgtgaaaaatagtcaaacataacaagaaataaagaacatagaaggtcagcagtgtttctaccctccagagacagccctgttaatggtttggtgcatagggtctgtttgtctagcatggtgaaaccctgtctctactgaaaatatatatatatatatatatatatatatatatatatatatatatatacaaaaattagcctggtgtggtggcgggcacctgtaatcccagctactgtggaggctgaagcaggagaatcactcatactcaggaggcagaggttgcagtgagccgagattgcaccactacactccagcctgggtgacagagcaagactctgtctcgacaaaaaaaaaaaaaaaaaaaaaaaatctttgatcacttttagaaatctctaaacctggagtaaacaataaactatttgtcttacattatttactggaatccaacttctttggctaagttttgttgggaaaaattagctattgctgactgcttgtgagaagaaaccattgtttatattgtatggtgcaataagtccagagtaacttcagggatccctaggctagttggctgtggttttagaactcagcttagttacgacaccagctgttgaaaatccattgcctggttagccctgattcctcagcaattcttactgggaaaagggaacttggtgtacactcacctggtcttttccatttagcaaggatctgccagaggatactgctgaggtctccaatccttcaacacccaacctacagcctctttcttacagaagaaaaggagatgggggatcacatgtttcgtttaaaggaatacagataacaacctgatagacattgcccgtttgaggggagaaactctctctcctctctgtgtgaacacagtgttaccactgacctcatgtgtatgtttctctttctggggggaagaaaacataaattatgtaaattgtcatctgccagataggaatgcaaccttctttgttctttgtagagtatttgtctgacaaatggcaaatagccaatatttacacattctgcaggtccggagaggacctagcatggagttcaagtattgatgttaagatcttgttttagaamttaagcagaaatgaaacagaaatctaattctagctttggttgttaggggaccatttttatttcagttcttcctcttaatactctgccctttgcttttcctctctggtctgtgggaaggattcatttcatatttatccttaccaatttattaatagctttaatatcttgttagtttatatttagacagcttttgaacacttattttatgtgcatgtagtcctctgcatcttctgcaatttattaaatacactcatcatcatcctcctcctcctcctcctcctcctctttggtgttggttataagtgacttattgcacacctcatragggatcatatcccacrggtgagttacaacactgtgattgagaatcactgttacctataccacaatttagtctgaaacactttgatcatgacagtctactgctaggatttttctcagtgactctaaagccagtacatgtcttgttcaggccttcatccctctgcgcatctgtccctgccctgtctccaggcatggctctcccatccctgcttgtatactcccctgcccgcctaccatttcccactcccctgtgctggtcaaggcccagcagagagcctccctcttctgcagtgactcttctattatccttctacactgaagccacatggtgttcaggggcagacagctaacttaacaaccacgttacccactcaggtgctttctcatgacttctgaattagaccacaaggtcaatgaaggcagagaccaagtctcagaccccataactcccaggacacatctgcagagcgttgactttggtgttagaaaggtacatgcccattctgctggtgtcatttattgaatacttgctacatttcaggagctgctgcttttgataatgagagcatcactttctctgtgttcagcacagctctagacactttacatatttaacttacttaatcctcactatcctatgtgatagttactaatattatccccattttgcatgtgaggaacctgaagtattgtgagcttaataggaatttgaacattctcttttaacactcattcgctgcacttggcctctcttgagcctcacagcaacctagtgaggaaaccaagtcacaaggctggtaaatgtgaaagggkccctgtgtgcttcaaactcattttcttttycactatgcagtatggctttcccaagacttctttactatctgctcttaactgttaaactgtgaagacatctggtaacagtcctaaaatcagcagtttacagaacactcggtatttgttgcctctatccaggacagttcatctgtacgttggcttcctattgctgctgtaaaaaattaccacaaacttggtggcttaaaacaacacaaacttactctcttatagttctggagatcrgaagtcccaactcaatctcacctagctaaattcaggggaaccgcaggcctgcgtgccctctggagatcaaggggagggtctctttgtcttttctggcttctacaggccatatgcttccttggctcatggccccttcctccatcttcctcccactgctaattctgtcccttcatcctctctctctgactcagaccctcctgcctccctcttctaaggaccactgtgactacctcaagcctacctggataatccaggatcatttccccctctcagaagccctcatcacatcagtaaagacccttttatgcacagggtaatgtgttcacaagtaccggggattgagatgaagatatcttcgggggccattgttcagcccatcaccacctgctatattgtsagtgaagcacttagtccccactagcacaagctccttgagattgggaacctgtcttccactacccttttgcctctctatatctaatatatcaatgtatatatcatatgcatcaatattccttcatttgtttttgttctaaaaattaaattgaaacaaggaattaaagaaaaaaggtgctgaagggttaaactgaaaagaattggtccactttgaaacacaatttatatwtctctatattgcatatgttttatgttcaagattgcgtccacccaactgtacacacatgttgcacacatctgtgcagagacagaaacaattgccacaatctctggatccctgccttgcttaaaactgtgacagtgttgccatttccctctaaacctttcttaatcagggtcacaattgaaaatgcctgcagttcaactatgtaaaaaagcataagggagaggagtccctgctagtgatacaaagaaaaagagaattttaatgataactataaatgcctgagaattaaagttttcattttctagatttaaacatacatacataccttcaagcaaagacaaaaatacctttggtttggattagagaactgaaytctggcagagtcacatagtaatcagttttgttatattccagtgactaaaatgtaaatccacataagttagaggctatatttatttaaaattttctgtcccagggaggaaaaaactcttaggatgtttatctcattttcaatagtgtatttcataaggaaatggacacttgatcctatctttwgaggcagcaataaacatagcaaaacaaattgaaagtccagcttcacatgtggttgtttttgtttgtatttattagcaggaagttctttggcataattgccctgattttgatggatgtgcagctgcttgcttcacaccataacaagaatgtaaaaccttgaaggtacagtgtacaccccttgtacttccagagtcaagaaagcttgmgactagatgaacaagggaattctaatccccaaaatggctgaagtaagacttctgttctcattttaataattatgtttagtaagtgagattccagttctcatttttctttgtttctctaggccctaattcagtttggctcagctatgacctcgactgtgtgcatagcaccgtgtctaactgcctttgggctccctcagtctcacatgttkctaagttacctcaaactccaaaggtctaacaccaagcttaatacatacctgcctgccaccccttcccccattaacctggtctttcatcattgatcattatcaagtaggtgacaccaccatctgtcctgctttctacctggaaacttgagccattatgagcctcacgcatccttcacgctttgtcaacatctataccctattttattccatcttctatatctcccccaccactctcttcctttctaatccctctccttacaatcaactcatcaaacccttacaaacagtcttttacttgatctccttgtctcatcttgcctaactctcatccagtgtttcccaacttggtattgatgattctttaccacaggttctctcttcaagcctttaaaatataaatatgcatataaatatgcactgagaacccctgcatagggttatgatatgcagtgttacatagacttattttaccaggaagccctttctccatggcacacctattaatacctcacaaagcagtattgtttggaacttactggcctatgctgcctgagtcattttctacaaattggatcatgttaccccctactttgaaacccctattgatacctcatggttttaagattatgtccaraggcacttcaccatgtgcycctaatctaatgtctcagaataattttccacctactcttcttcatggacccaaatggtgcaccgtctaaggactgctctgagtcatcagaacatgccatgtccctttgcaccttcagtgcgtacacacaatcttgctatgccagcatcctcatctccctggaaactgctcatgtgtcactgctgtctagagcttccctaattttcccagakagatttaattgcactctttgttgtattccctttttgtaaaactgatcacattgtatagtaagtttttctccctcactggactgcaaatatctgaggcttagtaaccattttttataaatccccagcatccaatacagtgcctagcactcagtgggtactcaataaatgtttggtgaaagaatgaatgagtgaatgaagaaacamgtgaagtgagttggaagttgtaagcagagtgcagagtccattatgttaaatgaaaagttggccttacaaacaaaacataaacatcactttgtgttgggttcaataatgttagtaaaaatatcaaggaaatcaactcagctctcagtaaattaaactaccaagaagaaaccagaaatttcaatacaggcagaatttattaatgtgcttatcatgggaaaatctttaaaagtacaggacacttgggccattgtattttttgtgtagagacrtaattgttttccttattgtgtattttttacttttcttataaaacgaacccatgacctcatatcatgaaacgtgtatggcagctggtataagcaatatagatactatttttcttatgtattttgcttattacatatatttaaaaataatgccccttactggagatttatctcttcatactagaatattattttaaatgatgactcataaaggcaaacattttttatttaatttcattaattttctcttgccattgctcctttggaaacatttttttctttgcatcctgcctcttgcataagaactgttggcctcaccgggtcatcttagcacattcacaaagtcatcacagactttggagccttgactcctttcaaatttcatcttctacaattttttaaaatttctaaaaatgcctttcatcaatgcaaacacactgaagaaaatttgagaacacagacaagataagcatttaggagcaaaatccctgacatttactcagctagatggctgcctcccatacctggagcgtcagactctccagcagagcccacaccttcactgggtgaaacccactgctgccttactgcaaagcagcttctggctaatgataaaacagcctgataaaaggtagatgatcagcccatcagctggatgcctgttttacatctttttaacatctggatttggagctcttttgctcatccaatcatcaattcaacaaacatttatgaagtgcatgctctttgccagatactctactaggctctggggaatataaagatgaatgaattccctttcctcaaaagactcataatcctgtgtgcatgcagggagggagaggaaaatagcgggcacataaacaatgagcccttatagaagagataagatacccttctaggtcagggtgggttggaggtgatttgtttgccaaaatgcagaggggttggaggaggctttaatgaagaagtggcctttaaaaaaaatacctattttaaattaattcttgtgggtaatagtatatgtatttatggggtacatgagatgttttgatacaggcatgcaatgtgaaataagtacatcttgaagaatggggcatccatcccttcaaacacttatccattgagttacaaacaacccaattacactctttttaagttttttttaatctacagttattattgactatagtcaccctattgtgctatcaaatagtaggtcttattctattacatattttcatacctattatccatcccaccctccccctcagcccctcactacccttcctagtctttggtaaccatccttcttccgctctctatgtccatgagttcaattgttttgatttttaggtcctgcaaataagtgagaacatgtgatgtttgtctttctgtggctggcttatttcagttaacataataacctccagttccatccatgttgttgcacatgactggatctcattctttttatgtttgaatagtactccattgtgtatgtgtaccacattttctttatcagttaatctgttgatagacacttaggttgcttccagatcttagctattgtaaagaatatatacactgcaacaaacacagtagagcagatatctccctgatacactgatttcctttcttttgggtatatacccagcagtatgattgctagatcatacggtagctcaatttttacttttttaaggaaactccaagctgttctccatagtggttgtactaatttacattcccacccacagtgtataagggttccctttggtccacatcctctccagcatttattattgcctgtctttttgataaaagccattttaactggggtgaggtgatatctcattgtagttttgatttgcatttctttgatgatcagtgatgctgagcaccttttcatatacctgtttgccattgtgtcttcttttgagagatgtctagtcagatcttttgcccatcttttgattattagatttttttcctacagagttgtttgagctccttatatattctggttattactcccttgtcagggtagtttgcaaatatttactcccattctgtgggttgtcgcttcactttgttgattgtttcctgtgctgtgcagaagctttttaacttgtgattccatttgttcatatttgcctgtgcttgaggggtattgctcaagaaatttttgtccagaccaatgtcctggagattcccccaatttttttttgtagtagcctctttgtttgaggtcttagatttaagtctttaattcattttatttaatttttgtatatggcaagagataggggtctattttcattactctgcatagagatatccagttttccaagcaccattcattgaagaaactgtcttttccccagtktatgttcttggcacctttgttgaaaatgagttcactgtagctctgtagttttgtttctgggttctctattctattccattggtctatatgtctgttttcatgccagtactatgctatagctggtactattgctctgtattataatttgaagtcagataatgtgattcctccaattttgttttgttttgttttgttttgcttaggatagctttggttattctgggtcttttgtggttccatatgaattttaagattgtttttctatttctgtgaagaatgcttttgacattttgacagggattgcactgaatctgtagattgctttgggtagtaagggtattttaccatattgatccttccaatccatgaacatggaatatttttccattttttgatgttctcttcaatttatttcatcagtgtcttaaacttttcattatagggatatttcactgctttggttaattcctagtatttaaattttgtgtgtagatattataagtggaattactttttaaatttctttttcatgttgttcactgttgaacatagagaaatactgattttggtatgttgattttgtaccctacaaatttactgaatttaaatttctttaccagttctaatagttttsttgtggagtctttaggtttttccaaatataagatcatatcatctgcaaacaaggataatttgacttctttctttccaatttggatgccatttatatccttctcttgtcttactgctctagccaggacaagaagtggcttttgagctggaccttcaagcacatcttggaagtctctgggtgaacaaagagctggcaggcattgctcatggactgaatgacatgatcaaaggcagagcagagaaggtgtctgtgtgcccaggaaagggcaaattgtccactgtagctaaagcatgggcacatgacagtatgtcaaggaatgggctggaaagctccatgcagatcaaagtgaagggcattgtcaggagtctagactttatcttcttaccattgataatatcctaaaagctttatgtatacatcaaaattgtaaatgacaattttttaaaacttttcttgcagctgttttatcaacatgttgttacatacctatatactgttggaggtctgtgccttaaatcaagtcctatctgcaaactgataacccagttgtgttattttcaatgagtaatcactctatagtacaattttattacatctatacccttgaaataagacaacttatgttcattatctacttcctcaatttgaaagagagagaaaattaacctacatttttctttattgccaaattcactaagaaactctaactgaacagcttgaatctgagaactgttcttatttaactacttgtttattgtggagcatttatcaaattgaacagaagctatgtgcttcataaaaatatttagaaaaaagaaaacttcagccactacccattgaagagatccatactcctacaaattcagcatcactagtgaagtatctaaaatgtcaatcactgggtaacagaaactttgggagcatgttctttatgtctgaaggactcaataggacccatgaggaatctgagtgtgaattataatcaaaggattaaatgaaaagtggcttgatgtcgttttgaggtttaggagataataattttatgaaccagctattatttctctcagagaaaaaaaatacactgcattttcaacagtgtaaatatttatgaatcattatcaaaacaccatatactcccagaacttattgtaaaatgtcactccactgttcagctcataccctgaccacttccttactgggaaacaaacaaataattaattttaaaagaaggaaaaggagagagcatgtgtaagaaagaaaactagaggtggattcattcaatcctaatgtttattattaaagatgtaatgatatactggggaaaagttttaagtgaaattctcaaacacttaatatgagcaacaacagaagcaaaatctcttccttcatagagctaatggtctaaatgggtgataatttctgaaaatatgagagctattataaaaaataaaatgaggtaatggtgatagagactgctttgactactctaggtaggaaggttagggatggcctctccacacagctgagaatggaattgaacctggattattcaagagactcagccacatgaagatctaagagaagaatggtgcaggtagagagaacagcaaatgcgaaggcsctgtgggagaaacaagcttgacatgtttgaggaacaaaacaacaaaaaaaaagtctggctggagtacacagggaaagggggggtgtcgtaaaakataagattacagaggtgtacaacgcttctcttgctctgctatacattcacctagctagaaccatgcttggttcatgattggcatttaataaatttatgtggaatgaattaataaagttggaaggatttaagctagacaatgtctaagttccaccagggcaggaaccagaatctgtagcggtttgcagggcagggttagaggagtatagattatattctcattgcaagggaacgtcattggagggttttaagcatggaaattgtgtgatcacatttatgctttgaaaacgtcactcttgctatggtgtggagaatagagtgtagagaagacaatatggggtttccaacaggaggaaggaactctytttcaaatgatcacatttgagtgtatcatctatatcctgctagaaacgctatttcttagtccattccggctgctaaaacaaaataccgtagactgagtagcttatcaatgacagaaatttatttctcacagttctggagggtagaaagtccaaggtcagggtgctggcagattcggtgtctagtgagaaccctctttctggttcatagatggtgctctgtagctgtgtcctccacatgatggaaggggcaaggcagctctctggaacctcttttagaggatacttatcccattcttgagggttccaccgtcatgacctaatcatctcccaaaagtcctcacccctaatactatcaccttgggagttaggatttcagcgtgtgaatttaggggagtggcagggaggacacagacattcagaccaaagcaccaataaaaggcaagagatgatggattatggtatgctgatttcttatttattttagaagtatagcttatatgttttgtaagtaaacctgaccttatttggccatgacttggatgtcaggggaagggtggtaaaaaaaaggaaaaactcaggggccaaagtttttgtcctggatgtggcacaattaaatgaatggggaagactgagagagaagtaggtttgggatgaggttggaagggcagtattaagagttccattttaggcatgtttaattcaagatgcctatttgcatttaagtggacatgttgagtaggcataggggagaggtcagagcttaaaattaaaatttttgatttatcagcacaaacttgtttctttccaacaattgtggtttcagaaaaattacartaagttcatggaagaatcttagtaattcacagaatggaaagtattgtggagaatatagtccccaaatttggcaaatccttaggagtcagtaatccacgtggttagttggctacttataaaaagaaagaatgaacaagaaaagtttagaactgatctgattatagtataacttgttggttcgatgtaagaatttgacagcagtaagagaaggtcgaacctaaaaaatcatgcaaaacactgtaaaactaaatttaaaaccttagttatccatagcaacaggattattctagataaatggaattcttagccactaatttaaatttctcctaagtaccaacttcaattcaatgccacagacatttattgagaacattcacaggaggcattattctaggcagtgcgggtacaaaattagttaaagaagtgaaatcctttaatgtcttattgaattgctaccaaatgagggctaaaattaaaatttgcttcttcaatacagaagagcccacagagtcactgaaatgagccacaaagaagacaaaggcttaggccagttacttgaatcattagctctgagaccatagattttgttcttaatcaagcccaaacgacacactagaaaagcccttagaaggagctggtaggacttgtaatgagtaacaggtggtctagcttcatggcattgtctaagagctatgtttaaatgttgcctctcagaaatcagagtttagggagaactccttaaattttccagggtcactagaatatagatgaactactttaaattctactctccaacctgaatcatgggctggctcctgccagtcagggatggtcacaagagtggaagctaagaattgaatggcaaagcccagttgggtgaaagastaagaccaggctctyggcaggcttggtgctgatcaggctgggagccctcctcatgaagcaacggtcacactaccctccattgggtctgcaagcacgcaggagttgctacaaccacggaggagagaagctgagtttggactttttctccagctgcgtccagagcatggtgtccagtaggagcttagcaaatgttgcaatgaatggcaataaacaaattctagcccctgtgtggccttcattggattgtttacctctctgagcctcagctttttttttttttttttttctgtaaagtggaaataagacctagcttgtagggtcatttcacattttttgttagccttcaatgcttcaatgggtaggtagttgatcccagcactaagaaaatacatcctttttcctaggggactcaattatttttttaaatttgaaatgaaaaaaataaaggtttctcaccattgattttaataatttaaaagactctaagactaaaaggcttaactagacaaagttgattgcttttctaacatcattatccactagctctgtgacctcaagccattcacaactgcaaacaaaaggcatgtttgctccggtggggtccaaacaaccactggtcgtaacagagacctctctgggtcccggattttcctttccatgtttattaccattgggtatggtgagagaacattcatttgtagaagtggttctaagccctggagacacaatagaattatctggggaaaaattacttggaagaagattataccgatatctttcttaaaaacaaaacaaaaactggtacctgggasccacatcccagaatatctgatttgatgggtctgaagtgaggcccaggcatcggtactttttaaaagctccccaggagaccttgaggtgcatgcaaggttgagaccactgagtaagaaggtgaaagctgggctgcagctawgttctgactgtacccaaggacactggtatcaccatcataaccttgactgccggcaaaaaaccccatagccattctgagtacaacttactaaacaaagaccaacgtgagttctgagaggggcactcctccagcaaagcaggtacttcagcacaaactctcacgctttttaaaaccaggcttgatctctcagcaagcccaaaggcagcaagctaatgacaagaaactattctggaagaaatcagcaggctccctaaaattttacaataaaatatccccaccacagagtagtcgtgggttgaactcttagctagggttatgtcagactgaaagtgatagaaaacccaaaataacattggctttaaaaagatagaaaagtcttcctctctcacataaacacagacagtccagagcagatatggtggtttcacagtcaggaagccaggcttctaactttttgtttgtgacagcccaagatggaagcttacatttcagacatcacgttcacattccagccagcagcgaggagaaagagaagggaagagatgccacaccatctttttgggcacttccctgaaagcacacacaacccttccgtttatatcccatcggccagcatcaagtcaaatggctgtgtctgtcttcaagggagattgacaaatatagtctttatgccgaaatgtggtatgcccagtgaaaagctggggactcctttgctctgaaaaggaagggacatatatttgaaaatagccaacagtctgtgcttcagggggcctccctcccacttcatgcccctggatcataactattcagttacatgtaaacaatgttttattggggttcctctgaaaaccactgacatgaggccatttttcttgcatcccaaatttcagtggctctggctcccactgccctaagaaatcatcagtcctgcaagaagagtattccaggggggtccttaagaaaaccagaccctaaatctaatgcccattccgtgtggtagagtgccttcacttagagaaagggctgtcttttctgcaaattaattcctccagatttatactgatggcgggagctctctcctgttcattctggaagcagcacagattattttccctggatcgtaaatatgctgaacactctattatactaaccttttaaaccagttgtcttggatgggactgcaaatcatagttcaggagcaactttctaagatttaaaggccccagaaattcctggatgctctagttaaatacctgggattaagagtggagagggtagatcttgctacaaaattcatctsaaagagaagaaacaaaatcctttgggccgattcctggtttttcttcttcttctggatttttttttcttcctttactctgccaaattaagataagaattagcagtcagactgccttcccatattgggtctactttttcttctttccttctttctttccccagtgttccagaacgtgtggcgggggtgttcagaaacgtgaggttctttgcaagcagcgcatggctgatggcagcttcctggagcttcctgagaccttctgttcagcttcaaaacctgcctgccagcaagcatgcaagaaagatgactgtcccagcgagtggcttctctcagactggacagaggtatgtatgttcctccgaagagaatgaaagagatccaagtaggaaaagaaggcaccccagacatatacatagaaaaggcaagaagagaacaaaacaatcttcctaatattatggaatagtatttttgtaaccatatataccgtagtgtgtaactagcttttaacgaggctgcagggacctgagttacgcagccagcccttacccaacaatcggaagcttggaattgtaaatgggctcctcgtggaacaaaaccagasctcattggtgctgttttggccccaggattcttttccacacactgggttcttctccttctatctccacaccaccccctcctcctgacctccctgtacctcttactcccagatgtttctgtctctattcaggaagggcaaagcctctctagcaagtctcttccaagttactggacaataaaggacatgatttattaggaaaagaaggccaaggaaatcctgcctgtttactgttagtttcctggctctaaaatacttcaactgcttcctatcaagagaatttgatttcccttgttgtcctgcactttgggaagtgattgcttcagcattcaccattcccgactttatctgctaagttagagacatacctctgactaacctatctttctaaataatgcctctcctaattctagcgtacgccaattcatttacacctagcttcaagtcctttgttttcagccactaccacttcgagttgccttcgacttctccacctccatagacctgtgtgtcttccatggagaagtcccccaaaattgttgcctcacaagaagatttagccaagaacagaatcactagacctgaagtgaaaatgtctgtaaagccagattcaagaccttcctttttctagcatataagcatttgaatttgccttcctaaccccagtgccttttttttttttttttttttttttttttgkatagtatacaactcacaggagggagctgctgctgcttgaaatacctcacagagatacttgcttacagagggcaaagcggcctgtgaaaattaagatccagctctctcaacataggttcttagaattcttgcccatatcttatcaacccacatagaattccatgagatggtgcctgctaagtgcattgcaattaagagttaacttacattacgacaggttttataacttggcagtaaaactgcttcttgtggtatctcatgccaaatgtctcagaacgtttggggaattattttctcatgctttctaaatttgatttcaagatataaagtgtgtaaaatgagcatgtgtacatttgtgtgtgtgtgcatgtgcatgttagtgacaatttttccgtgggaatgttgatttggggtatggcatttgaagaacagaggtaggtgtatttgccaagtggctctaggtgaaaacattctctcagtggagtattataaaaggaattgctcccctaaatctatcaggtaatagtctgtcatgagtggactgctgaggaagggacttgtgtgtgttataattgtcttcctgtgttcctggagtttgtggcctttgaagcatatgagacagagaagattcagaaaaygttcttttgtgcctgcagatttgagggggacctttgagattttgggactaagaaaaaggtcccattggtcccattaagtacagtaggccttcagaacagtatcatgtgttgttaagagttcagactcaaagacaggcaaacctaggttcaaatcctgactctgccacttactggctgtataaccttgggctaattatttaacctttttggctttaggttgcttatctgtataatggaaatataatagtatccatcatgtaggtgggaggatgaaattaaatataatttaatatatattgcatgtaaaatactttgtgcctactaaaagtgaacccttatgattgtcttccatttgggctcacttgtcatgagaaggaaaggaaatgaaaggaagcactcaccatggctggctgggcctgaggccacagcttaggtctcctacaggctctcctggtcttcctcaagaggaagttctattttgggaactgggaggaggtagcccttatccaacgaatgttactagcttctgagctatctgggttaatgaatggarattccaaacattgaggaggggctgggaatggtgggaagtaatcactgaattgttgggattaaactcaaactggtgccatattgaagtgctcctggaggtgttcacaaaggctccacattgaccctgtcatccttatgaccattcccctggccgtctggctgagatgagatgtgcatgccacacctcccatgagactgcccttggagaagggaagacctaaatgatctatgggtgtttttcatcctccactatctgggctcaatctcatggttactgcacagaatcccatagagacagaattaagccaaagttttagacatttcaaataaaattacttacagattctattctggaagtaagacctctcaaaaggccayacttcttttctctgaaagaaaccctcaatctcctgaaagagtttgatattaaatatttttaaatcctattttatggaagttgctcctttccccccaaaaaaaattctaaaagaaagaataattttagagctagaaggagcttgaaagatcctatagcctaattactttgttaaaaaattaagaccacagaatgctttatcaaatcaaatgttactatgaagccaataatcttaaacagataaaattagagctgttttggtttaagtttgagtaggggtctcagatctccaacggctgggtctcctcatcacctgagaagcccccgaatcacttcctcaacatagttatggaacacagttttaaaatccctgctctagcttagcttccttattccagagatatggaaattgaagctagagaaagagctagacttgaccaaagtcataacccagtcttctgacctgaaactctgtttttatgtttctacttagyagccttaaaacgaccatgctcttttaaattttcaggcttcttacttccatcccacctgatccttggatttagcgctgtcatttacaataaaataaggaatgggtggaatctggaacccataattttcagactataaaagcaatgggtttgattctcaccactatcctttgcatcttaaatttctttcagggtagcatatatcacagcacatcacacagaatagtgtcacttcaatatgttagcatataacacttgaaaatataagatcattttttgtttgttttttaaccatcatttttcaagttaacgtggcacactcccacagccctcattcaggcaagcctggagatgacagcctccttccccgatgccctgcctcccatccatctcctgcttgcatcccttccatacaatgttgccagattaaccttctcaaaacacctctttcatcatgtcacccccctcttcagtggcttcccactgccttatggaccaattamaaacctcttgtctgaaaattaaaggtctccaaactaascctcaagctcctgacacttagaacttgagccctctgttctgtcaaactgttctgtcccatgcctgccttgggactcctacactgaaattattatcttttttctggaaatttccctgtctcycatctgatccctgtttctctgcacccacccagactccaatcatcttcaagaccttggtgaggaaatccctagtgtactataagcattacattattgttaccattaattttatactactttacttgtcttctaattgtatgtttttaccaaattctgtaattacaattctataaacagctttattgaggtataatttatatattataaaatttgacttagtatgtttttaaggtttatctgtgttgtagcacatataagaactatactccttttaatggctgaataatattccactgtatagatatggcatattttgtttattcattcaccagctgataggtattgggtgattttcacttttggcaattatgaatcatactgctatgaatgtttgcacacaagtctttgtgtggatgtatgtttttgtctctcttgggtagatacccagtagtaaaattgctaggtctcatggtaaatttacgtttaactttgtaagaaactaccaatctgttttctaaagaggctgtatcattttactttcccaccagtaatgagtgaaactgctaattttccatatcctcaccaacacttgttgtctttttttwttattattattatggccattctagtggatatgaagttgtatctcatggtggttttgacttatatttcccaaatggactatttcattttaacaatgcatttgggattttcccctcatttgaatgacagctctttgagattaggaactattcttgcacatcttttcttcttaacatctagcaccctaccttagacaaagtagattcataactacctaatgcttgacactaaaatattgtcacttacttgtgaaggaaggaaaaaggaattagcaataattgtcatttctatgtatggcatttaaaatatattatctcacttaattcccaggcttgcaaactaagcataagtggaaacagacgagagaatttaagtaacttgccaactagtgaaatactgagctgggatttaaacactccataactctctaactctgaagcccagactatatatgtaaaatagataaaaggtcttcaggaaacctcagagtagaaaatcttagagtgcaaaatgtctacaagatgggcaggtcttccacattgtgacctcataattagtatttctatcacagtggttattgcttttccaagcaaatttctcatattttgatgagtttgacagtctattaaaaaattagcttctagttcccagaatttatgtgcatttggcctttctttctccaccagtgttccacaagctgcggggaaggcacccagactcgaagcgccatttgccgaaagatgctgaaaaccggcmtctcaacggttgtcaattccaccctgtgcccgcccctgcctttctcttcctccatcaggccctgtatgctggcaacctgtgcaagtaagtatgtcagggctctgggaatggggagatgaaacccacacagcagcagctatagccaccacgccgtggccttccctaaactcaagacctgtgggaaatagtgggacagtagaaccccatggagggctgcaggcaggagagctcagctggagacggaaaaggaatcttaattacacgtggccaggctaaattctcctctccactggaaaaacagtttgmaggggggtagagcaaagttcacttgctggcatacagagatctggaagctggaggcagtgtattactaatgatgtctaatgttatccactctggggttttaaacgactctaaacagatttgttctgtttaatattaatccctagagccgcaacacttctaggctgtccttaccatgtcctttagggctctggtgccttgcaggacccagaaggcaaacatttagcggaagacattctcctctctgtcctctgcctctttttatgacgttgatttcttgtttaaaaattattttaatgagaggaaatgctttcccccgggatccccctccatctagaactctgcatctcagcttctaggagcaacaaggcccagcagggagacattgggttgcccactgcatctcattagttctgattgtggtggcagcttgatgktccacagccgggaatgaggtcctcccgaaaaacacaggcagtaaaggatggccccggccaaaataaacccygaagaatactttctctcccgtcctccggcaccttcgtctctccttctcttctccactctggctctttcctttgcccctctctcctggctgcatctcactctgggttttctctctccccwcctctttctctgtcccttcgggttcgctctccttccagggcccrggcggccatccacgaagcacagcccgcacatcgcrgccgccaggaaggtctacatmcagactcgcaggcagaggaagctgcacttcgtggtggggggcttcgcctacctgctccccaagacggcggtggtgctgcgctgcccggcgcgcagggtccgcaagcccctcatcacctgggagaaggacggccagcacctcatcagctcgacgcacgtcacggtggcccccttcggctatctcaagatccaccgcctcaagccctcggatgcaggcgtctacacctgctcagcgggcccggcccgggagcactttgtgattaagctcatcggaggcaaccgcaagctcgtggcccggcccttgagcccgagaagtgaggaagaggtgcttgcggggaggaagggcggcccgaaggaggccctgcagacccacaaacaccagaacgggatcttctccaacggcagcaaggcggagaagcggggcctggccgccaacccggggagccgctacgacgacctcgtctcccggctgctggagcagggcggctggcccggagagctgctggcctcgtgggaggcgcaggactcygcggaaaggaacacgacctcggaggaggacccgggtgcagagcaagtgctcctgcacctgcccttcaccatggtgaccgagcagcggcgcctggacgacatcctggggaacctctcccagcagcccgaggagctgcgcracctctacagcaagcacctggtggcccagctggcccaggagatcttccgcagccacctggagcaccaggacacgctcctgaagccctcggagcgcaggacttccccagtgactctctcgcctcataaacacgtgtctggcttcagcagctccctgcggacctcctccaccggggacgccgggggaggctctcgaaggccacaccgcaagcccaccatcctgcgcaagatctcrgcggcccagcagctctcagcctcggaggtggtcacccacctggggcagacggtggccctggccagcgggacactgagtgttcttctgcactgtgaggccatcggccacccaaggcctaccatcagctgggccaggaatggagaagaagttcagttcagtgacaggtgagccttgtagctaacctggtcttgggagggaggcaaggggccacatctggcccaagtcacactacttacacattcttcaaggtgtttccaggggtagggcttagagctggcctcggggaccccatcatggggtgcaggccctctcttagcactgatagactactggagcaaagacaagctatttcatttttctaaactgtctgttctcatctttataaggaaatagcaacattgcctacccactcctatccctgtaggatcccaaagataaatgagatactstctggatagctttgaacttttggcagaaagacatcattccaggccaaggcattattatgttactactctgtaagatgaaccatggaaaagctttgacactggaacactgactccgtgtgtgtggtccccmagggctgggcagagaatgcagccagcacctgctgtttcccatgggtgagcccatcgtgtatctgtgctggacaaggctgtttgttccagaaagcttttattcccagtgggacctgtgattgattatcctaatatctcctgttgtctctgttttgatgtatcattatcaggatgacagcatgtatcacttccttgtctctctgggtcatagccattcataatgtagaatcaatagtggtagtagaattaataataytttttaccgctacctgtgccttactttgtacatattttgtctcttttaatctttacaggggccctggcaatgaagatggttgtcattaattgattagtgactatctgccaggcaaatgtaaactctttatgtgttttatctcactgaawagaagtggatacaatttttatccacaccttatagaacaggaaatacataaagttaagtaatttactaaaggttgtatttattatgtggcagagctacgatatgcaacaaaaagaacttccttatgggtagtcactttaaagaatcacggaatcatagtcctytagtctagattcctcattttaaccttctatcttctcagaatccaagcataatgctcttttcattaagtctatatctaaatgctattgtttgactaatagtcttctctggcttgctagcttttggtaaggaaggaaagaagccagcatttattgttccaggcactatgccaagtttatttataagtaactgcattttttattctaacattcaatccacatgattgacattatcctccagttttacgtagaaaaccaaggttcagcagctcacccaagatcacattttagtaagagctgaaacaagcattcaatatcaagtttatttgattccaaggaagagttctgtctactcttctgagactcggtgaatagatatataataacttttgtccatcctgcacacatcattttttgcctttgtaatgtcaataatactgcctctcagccttagtacttatagaccaaatacctttgataacaatactaagtattatttctttgtgctccaactgtatgccagacatagtgctcagtgctttaaaggcattatcttgtttaattttccctcaagatcgtaggaactagtaggtactaytgtagttaccacatcttagatagaaagctgagggacagakgttggacccacayagaaacactggaaatggtctgaacacaggcagcatgccccagagcttgtgcttttaacctgcccctctgtccacgccctccagcccccacaactcatactttccttaatcagcttaactgctcttatccctgtcattttctccaaaaaatccttataacatggttggaaagatttcagtcgagccctttgaggtcactgagtggcagctccagtgtgtggacccagggtgatgaggggtggcctgatactcagtcctatcggtgcacctgctgtacctattacaccactatgatgccctctcctctaccagccagtcagtttatcaagtgtaggtacaacgttttatttctatcccctgggcctattgcctgggattggtactattgggattgaagggaatcacgactggctgcatgagggaaaagatggaaattaacatcttcctacttcctcctaaaaagctgtggaacgagacagggcaatgggaaggggtcatcaggactctgctcagcctttkcctgcagggagaacattgagcccctggattagaggtcctgacaatttctttgagtgttggagactttttatgaaatccaaggcccatggcccatctaggtcacctggtgactgcaggaatgatgtggaaggaggtagacaagcattgaggggtccaatctgatcttgccaaggccctgcacttttcacggtcttagtctcttcatttcataaatgaggagactgtaccatatcatctgtgacatccctcctacctccttccctcatttacggaaggccacggaaggttaaaacycatatgctgatgggagaaccttgaccacagtaacttcagaagttgtggcacaagttgtttctaaatgctccacaaacaggctcagtgatcacaagagtttgagaagggcaaacttaaggctaaacagatgtatgtactgctggattttatgtctatttttttaatatcacacttgattttttattataaaagtaataaaagggctataaaacaattcaaatatctaaatctataaaaagtacaagcctccctcttccccccaatgctccyagaggctatcattcttaataatttggtatacatccttttagaatgtttatatattttactgtattacataaaaagcatatatgcacacataggatttgggttttttaataggatattagtcatgttcagaaatgtgactggtttttacttaacagcatgtctatgagatgttttcataatagtaggtagaggtctatattaccttttttaacagctgattactgttcctraatgcatttaactatcccccaactgaaaattatttgggatttttctttttattttactcttttaagcattccaatgtgtgttgtgactttccaagtggacaatatagtatgctgtggtttcaaagttctcctttaatcactgaacaatttttcggcttagtaatctcaggaacaccaataattcttgaaatagcacttaggaaacacactttggcccttttaatttttaccttaatgggcattgagagtctaactccaatggctttaagatggagaaggttcrgtggaatcttgatagaaacagagacktggcagccaggtgcaaagaacactaaagcactgggcctaggcaagcagagggaaagtcctggattctccatcatccaggacatcgttgtgggggagggtagcactaagagggtaagagggaagatacctgagaggcaggaacaaacagtttttgctgccatcacattttttatttttctggatctaggcttgactaagcttttcaatgcacgttaatggcatgtggtaaggaaaaataagacatttccctttctgacctttgacatcacaatttttccatttttgytggctgttcaataagaaatacggctggagcttagttttctctatctttcaagttctgtttaagaaaagagtgaatgtatctgcacagatcatgcaggaggcacagagctgccattaggactgctttgctgtgggctgttggtgacctttcctgtgttgggtttcattgcttgtcatcattactatgtctggtagtggttcagaaatgctcatttattttcaaacagaagtgctgaaatgtccagtgttatagttcagttagtctgtttttgctaaaggcccaaatctaccttctgagcatctgcaagattcagctgtgtgttggtctgtgggactttgcaatttgttaaagtatcctccaaatagcatgagccagcaagataggtccaggtcagaaaaaagtgagagaagtctgttatttctttgcttttaaatattccaaagtttgatttgaaagaatttagttttagaaaagaatcactaataattctgatactactgtgtctcatcatttatataacttactagttgaaattcacatagttctcagaaatgcatgtctgtcaacttctcaagcagtcgtttacagggtgtccttagtgtgttatgactggctggttcatcataatccctacttcctttttcctttattctgcaaacaatctcatgcctactctaagccagactctgtgttagatactagggatggaggaaaagaagattcatttcctgttgatgaaattcaaagtccagtttgggagccagaggagtaaatgcagtattataagtgctaagaaagaggtatgcatatttattcattgcttaagtatttactaacctaactataatatgccaggtatacatcgacttgctggaaatattgtgataaatgaaactatgttcccttggagtttacatgcatttggagttctgctcaaatggcacatattggagagaacttccttgtccctgtatctaaaagagcaccgctcatcattgtctatccttttaactctatttagataattttattctctgatatgttacataaatatttgttgattgcctttccrcaaggctaaagactttctttacggctgtatgcccagtaaccggcaccaaacgtactaaataatagtgaatgaattaacaaatgaatggagcaaggcaacaaacacataaaagtaagcaagaaaaagatcaggtggtgataagtgtcaggcagaaaattaaaacgggtataataagagaatgatttggtgaccgctttagatggatgtgctaaggagatcacacataagccaagatctatctgaatgatgaccagtgcccagcactgtgatgtgaggaggaagaacactcctggacaagggaaaggcagtgcgaaaaccctaaagcgacaatgactttgtgttgaaagaactcaaaagaagtccatttggctgtagtaagggaggcaaaaggtagaggtggtatgggatgaggttgtgagggtaactggagaccaagggaaggggttcgggttttacactgagtactacaggaagaatttggaggatgttaaacaggaaagtgacatgatctgatttgcattttgcagattcacatgggctaacttgtggcatgtggattgtagaggcacatgattggaagtcgggggctagtaaggggccattgcagtagcccctacaacactattgatctttactgggcattagatacattgagatgataaataaggcaagaacacttctctccagcaactaagaaaccttcaagtgctggtgtaggatgaaataatgtaggaccccagtttgtattgaactccaactggtagaatacttctcttttaaacttttaaaagtagattgaagagggattcaaaaatccaacgtgcataataattaacaggagcttgttagaatgtagactcccacatcctcccctaccattagaaactctttctacggtagggacccataatttggagttaaacaagcaccacaggtgactctgaagccagattcaaggatcactttgaagaagcacaggtttgctttgtcagctctagattatcacaacagcttcctaattcatatttgtattctttagaccaggggttggcaaattacagccagtggctttaacatcttttaaaggattattaagaatggcttttaaagagttattaaaagagccaatgaaattgagcacagagctgttaggttaacttgctcaagttctcacacttaataagtggtagagctgggatttgaaaccaggcatgtaaagggttattaaaagaatgacttttacatttttaaaaggttattaaaaacaaacaaaaaattataatatacaacaaagactacaggtggccctcaaagcctaaaatatttactatctgtccctttacagagaagtttactgcctcctgctctagaccattcaccatgctactgccagagcatctttctagcaaacctgtccatgctgctttcatgcttaaaaattcgtttcatggcttgtcatcacttgaggataaagtccggatgccttggcttttatcatttgacatccagttatctctccagcttcatctcttaccatatccttgacctcatagaactgagctctgctcttcagcagtacacaaatacttgctgttcacaaatgtgcctggggccttctgacccactttgtctggctaactcctgcccttccttacaggaagcctatccccaaagccaggtcagatgaccccctccatcatccacatagtaccctatgcataatactctctcggccttaccattgtgtattaaaattagctgttagtttttctggagtttattaatcattctcaagggcctatatttaagaatgtgtcttattttctccgtaattctaagaacatgatagacactcaacaaataaaaaactgaatgaataaataaaggaatgaatagttggatgcccacgattaggagggaggttttcttattgtgaggaggctgcggtctgcaaggttttttatagtctggatttcctatgccattgtggaagagttccagagtgatacctgttcctaaccaaacatttctgacttgcccatatgttctccactaaagaagtttcaggaaaccctgagattctgtgacacaactgtgcaatttgaaaagcactgctgtagtgtgtataagtacagagtaaatctcctatcacatcccgtctcccaccacatccaggccagtggagaaatcatcaggctcatcatcacaggtaacatttatagagcacttacaatgggcttcaggtgttcatttatcctcacaataaccctttgaagttactatcccaattttaccgatattggagttgaagcacggagatgttagattaactcgctcaaagtctctcacttaaaaagtaatcgagctggggtgaggcgcggtggctcacgcctgtaatcccatcactttgggaggccgaggtgggcagatcacgaggtcaagagatcgagaccatcctggcctacattgtgaaaccctgtctctactaaaaatacaaaaattagctgggcatggtggtgcatgcctatagtcccagctacttgggaggctgagacaggagaatcgcttgaacgcaggaggtggaggttgcagtgagctggtatcgtgccactgcattctggcctgggtgacacagtgagactccgtctaaaaaaaaaaaaaacttaatggagctgggatttgaatccaaggcagtctggcttttggaactatttctttttattgattataaccttagttgaatacagggacttgccactgttttataagaaggccactggggtcaactagacccagcataaattaacattcaatattctagccaactggcttccagctgatgaggcttttgtttttattttggcataactgctttaaagatagccttttcttctactgatagcgctacctttatatatacacatgtgtatgcaaatatgcactaaattaggcactcaataaacattacaattgctacatttgtgtgtgtctgtgactgcacatgtttacagtgttgatggctcaggcacatgtgtggttagagacctagaccacaggcaatatgaagctaaactgttcctcgctttcagtcattctatataaacactgagcacacatttggagatgagactcaggcaaaagctaactccagtctgcttttggatagagtataacacccctagccaaagaacctggtaaattttccttctctacatctaataccaggaggcttacgtaatatggacaaatatatgttcagtattcytacgtctaaatccagttctagaaacaatacctggaagggcagtgctgacttccttgtagaagagccagattctccaaaattggcactgcacattggattaccaaattaggaaaaattactggatgaggattgatcattcccccaagaaacacctacatactgctgatagcaccacactgtcagggaaggccttgcttaccacttaacactattgaaccaggagtaacccaaaatcacagattcctcatagctcagctgatttaagtctgtaagcttttaagtaagactttcttttcttttcaaaaggaatgcaagtgaacttaaagaataatatgaaactagatgcttgaagaaaatacttatttcttcctgtgggtgggaggtcactcccaggtgatactcctmctaacatggaatcctagggaaatggctaagtctaaggaatttcagccttttaatccctaagcctgttccctgttttccttctcttctgggcctaggtgttcccagcttatcctccccaaccccttcagccagaggagcaacctgatggcacatcagttaacacaaagggcagcccacggtggtaggagacagtaaggctggaatcagagcaactttggcacaaatcccagttctgccacttagtattgtgagtctacttttatctctctgaaccttggttttcttattagttaaactaaaatgatactagtacaattaggcactttgattctgcccttcggactagcagaagtgcaaagaacagaaataatgtctgtaacgtgcctgacacacagtggatactcatttgccagtatccaaaatcattgtcatttagacatggggccattgtatcacactgtcttccaggacatctcaaactaagaagcttcactcttatttgaggaacatctaggtagttgttcaaagagttgggttagcaaggtttctaggaaaacagcgtgatggagaattatcagcctaaatccaggcatcaygaggggatgttgatattctactgacattctttgctatcatctctgagctgataggaaagtgaaatctgtagcctctaaatgattatatttcccagaaagttttgtacagtgttccaaagtggtgctgaataggagatgaattaaggcatatttggaagtctttaacttgggcaacwcagagtatcagcagatggaaacttctcagaatggaagtgaagatcagatgggaaattcctccagggtcaatttcagaaccatagttgtgaataattctctatgtacaagtcataagcacatgaaatgcagtttccaagtttgcagataatataaaaactagaggcagggaagatagggaaggaaaaacaagcccatttcagtttggtttggcttgtttcccttatagagctaaaggaaatggagatgacaaatgtttttcccagttgaaaagtgtaagaatagcaagccagagaaaaagaaccgtcccagtaaatacataagcctcacaaaagaaaagtattgagtgtcaacacagtggtcgcagaaatgaccatcatgaatcatgcaggtgaagagcactggaggatagtagacaaccagtggcaamcagacagtactagtgaggcttagagtcaggcactrtctattccctgaaatgctaggggatctccagagatccccctagcagttagtttactcttcctggaagagtggtcctagcacatggcagagttccagaaaagtggttaactgttttagtataaataaggatgtcactgagataaaccagaaatgaaaatttttccatgttatatgccagaagtcagcaaacttttctagtaaagggccaaatagtaaacattttaggatttgcaggcatcaggagtaaggaatgacctttgactgttcttaaactgactatactcaactctgtcattatagtgtgagagcagccatagataatactttaatctatatgctagttttccaataaaactttatttataaaagcaagtggtaattggctgcagtttgaggacccctatccctagtggataggaaatccagtcagtcatttcatgcagaggtttgtaatttgaaatgagttacccagcaagcagataaaatacacatattagcaaattcaagactctatgaacttctgaaagagaaggaagttaaagggtctggcaaaaagaagaagaccagggttaagaatgtgtggtcaggtggcctttcccattcctaaaatattttctatacttccatctgagcaatcatgaagcttctggcattaaataacttttagttggcaattacattaaaaacagcaaaggttaaaaaaagttgccctagccaaatggtgatatgaaactcttcatgaacctcaaatctgttgcccaaaatttttgtacaaaataaaattctcccttgcaagcctctgggctactgtaatttttggtttcagaaaaataatcctgctcacggaggagatctcagagcattccttttgcctcccgtttgaaagtatctaaaatccagaatattttttagtgattgtctatttccctaagtaactacaaaccttgacgttaattacccccccgccccgcccccgcaaccaccgaaaatgaggccaaaccatatgcctgccaactaggccccggtagattcctggatgctgtcagtttaagaacagtcaaaggttattccttactcctgatgccaccatgtactagctgagcaaattgcttctgtgaacttttgcctgctctctaaaatgggaaaataacatcaatctagtaacatggtagtaaggattcaataataaaaagcatatacatttgcctataaatactagcacccgctcccgctttgtggtagattccattatcctaatctaaggaatccctaagcagaaaaatacccattttaggataaggaaaagacttcaccatctggtcctataaataggaatttggggctaatgttatttgcacaaactttgcttacttgctcctgagttcactgttttccagctctaactcatttgctcttgtttgtattcctttctgaaattgcagaattctggcttttttttttttagtgttctaaaatttcagtatttggttattggtgttaatacagttatggaaataactagttgtccttattcagagattcctgagtcaagaatagaattaaggtagttgccaacccaacgtgctacgtggcctcacttcttgctcctcttttctcctccctggtcccatgcacagcaaaccctttgttccctttctatacacccaatttatgttttttcattgaaatctctacatttctcatttccccaygtcttcacgacatctagaatttataagccctggcatgaagagtgaatggtaatgatcatggcgatgttaacaactgtaacaaaatcataatcacctacatttctgtagttttttactacatgccaggcacttttctgtgtcctttaaatacattagcttatacagaactctcacaacaaccctaggtaggtactatcattctcattttataaatgaggaaactrtcactgagaagttaagtaaattacttgcccaaggctacagagctgctaagtggcaaagcggggatttgatcccatcattaatggctccggagtctgtcctctgaaccactgtccgctatgctatattgtggatatgatcattttcagccccgttgctttgaaggtaaccaaatgagtatttattatgtatttatttagtgtgccagcactatgctgaatactgaagagagaactatgaatgagataataattkataatctcactgaagaaatgagacactgttgattgaaaaaggcttcgtagtggagttttaacaactagatcaggaaacagacagattcttgtgtagtatagcagcacaaggaaatagaactagaacttgttcttaagggagggggaggaggaggagcctgtctttagccccaagctaatgacaaggagagtcaaagaggccatcttgactagagtgacaagtttgtattgggatgtggggcagataagtttggaaagaagaggaagctactgttctacaaagaaaggatacacccacaatttctagcttccagtcctgtgttgaggcctacaataggtttaggaaagcgtaccagtcagaatgagaggcctgaggtggcacaataacatatcccaggtagtagatgggcatttctctacccagaacctgaatattttgtctgacaactagaaattccaagaaggttacttaggttatgtgtaccatcaaaaaaaaatcatttattagctttatctggtgtttaaactgagacctttttacttggaaaacagtaagaatgagtctatatactcttctatgagatcttcgcaagaacactgtgaggtcagtattagcctcaatttatagaagaaacttaaaggctcacacagttgaatgacttgcctaaggcccaccacacgactctagactggagtccgagtctcttggttccaatttgggaagtcttcccctccacaaggcagctcctcatagctgggcatggagatcaatttgagaagtaggttcacacaagacagtggtgtcacagttgagccaaagatccagaggaccccatgatgccaacctactcacagaacttccagagactttcctttatacacccggagctgcctttgtttcaaataagagcccttaagcactacacattccaaatgcagaggagatgatttatcctgaaagagattatacttggtagaaatggcctgtgagcatttggtccatatcttattctcatgcatgacaaggatttttacttctgtactaaaacaatttcttgcaccctctcggctggtccttaatttgtagcatgcttgtgaaggcatattgtcacatagaagcttacaaataaaggcccccagaaaaacaaaaccgctccttcattttctggctagaagtagggtcaaagaagtaaagtaataaattttaggctagaaaaataaaaagtgtggtacaggtctgggaggaagtcaaggagtattgatatacctagcatgaccacagtaccacttgctatgtaggtcttaattgtacccattctatgtccccacatcctctggttccataaattccaaaacagctccaaaggaatcctataggttttgtttggaaagcagccctatgtttctctgcctgctcattctaaagcaagcctatcaaatttggaaactaaatataaactgacagaaatcagcaactagcgaattaagctaaattaatagagtagactactgaaatacaaagaaaatgtttttttccaggaatctctctctctagtcgccaggctaggtaaactgaagcaagcctccgtctctgcagcaagcctttcctttgcctggcggtgcttcccagagagccctgcatgggacccccctccagaactactgctccgcctagtggcagccttcaagccttcatctaccaattttatgggcatattgtatgtataataacaggagtcaaatcctccccyatccctgaaaggacttatgtcttagtggattttaagagagagggaaataacatscaaatgggccaaatgtacaaagaacacactgtgggcagctttctaattacaagaagaaagcacgactaaacagttgagtcttatggtggtcccaaagggattatagggtggaaaaaaaaaagtgctggaccaaaaacawgagattctacttcaaatcctgactctgcccccaaataactatgtacccttgagctagacagttccattttataaatataagtgacttttataagtatacacaataagtgagaaattcaggctttctcccatgtagattctgtcttaagacaatatttaagactgtttttatgaaaataaatactacagtttctctatctatgtatatagtgtttatggaataatagactatacaaacgctaaatctcatgatctacatgtcaccgtttccattgccgctactcctattctagttcaaatccttaccactctgtgccctctgtgatggatcacctcccttcctttcatcagccttgtaggaattcttttccaggcttcagacatgggcagaaagcatggtggcttacttagtgcctggagaaaccagtgtaactataaaaactaacccccacctaaaaataaatgggccagggtaggagagggttacatcctctgcctgaaatcagacaggtgcagtagttgtatgcaaaaaaaaaatgattctaatatggagatctaataagttgcctaggggaaactggccaatatcatgtgcccctctcactccttcctcacaatttcctcatcctccctcctccctcatggttaatttgccattcagagtgtgcagcattaccaagaaaagagtcattggaaataccaaaagaggatctagaaattccttatataccccagtttaacaattccctctgatgagcaggaaaacagacttcaactggattttagaagttggtaaactgaaatagaggaagataatgagatttgccaatggccattacttaaatcatagtaggaccaaaacaaagttcagaagaactatcttctagcctcctgctgcgagtgtccaagaaccgttttctgtagggacaagggagatgtttccagtgccagggagccagctaccctaatgggtttgggaacttagcatattttaatttctacctttgccatgtggtgaaattgaatagtgatcttctgagttccatcattctcagttctattgaaacttgactaagcctgctttcattattatttagaatttttgtgaaagcataaatattcctgggacatcctaaagctttaaatcataaagttgatttttaattttctaatctaaaacagcttgaacacctgaagagacttagcaatgatattacattatgttgcatctgataagattccttcaggaaacagtcatactatgatctaaaatattgtatggtttaccaaagataagtaaattgtatagtcatctttctcttattagcttcttcgaaataaactaacatgtaattgtttgactttgagaaaaaagcaactaatgtttgatggatgagtgaatgaatggttggatgagccataacacaatctctcagtgaatgtatgggtggatgagctatatcacaagctctcagaggcttcctttcatccctcacaatgtttcagctctagttgaatgccacaaaacttgagggtctccagtaatagtggtgatgatctggaatagcactaaatcaagcacaaatcattcaaaaacttcctttaactaaggtgtctatttccttccccattttactagagctgcccatatataactcgattgattgatggaagccttacttctacttcctgcctttcctctgacaggaggtaagaataagcaatgtagtaggcccaaggccaaaagctgagctgaggagatctcattcactgccagactggtcacccacctcagaataattgacagctgattagaagtggtgctgaaatgcaaatgtcatacagcctggagagacccggcaagggaaatagtgaggaaagaattgtatagtgggagagtgttgctggggcagacctgacttccaggcttaatcttaccacagagtcttaatgagttctccccacatttctgttgtttccccaccctctcactttcttgaaaaacaacccctattaactgcttacctcctagggaaggatgctagcataatattgggtgaacagttttttgaagcttttgaaactagggaggttaaaaaatcacaaagctagaaatgactagcttcaggatccccaaaactggctactgagccatttctgtgctatcaaataaactgtcaacctaaagtacctgtcaggtctaggcaccggatctctgagcttctgagcttctccattgtccctccaacccttctagattccctcctccacatacacattccagttatcagccagcctcactaagtcaccaagacatcaggttcaagtgatcgttagtcattaattaagctgccataatgtcacaggtactttctagaaatggcataaatctagaaaagaaaaaacagacttgggtggagtgggtttgaagctcactgtaggcactcacagtttgattcttttaagtcttttcagattaaaaaaaaaaaagtctgaagtagactgtgattattctggaattttctctccatgaccttgaagggcaagttttgactttattctactgggaacctactctacagagagtcccctgtagtagtggggaaaataaaagcaataaataagacctgaagaggatcacatgagcccaggagttcaagaccagcctgggcaacttggcaagaccctatctttacgcaaaatttaaaaattagctgggaatggtagtgcacccctgtggtctcagctacacaggaggcagaggtgggaggactgcttaagcccaggagttcaagactgcagtgagctgtgtttgtgcctccacactcgtgggtgacagagcaagaccctgtctcaaaaaaaaaaaacaaaaacaaaaacaaaaaaaaacaaacctgagttttgtgccccataagatttacagctaaataaagacaatagatgtatatatgactacacagcggctgtgacacagaatttccttcaaatatgtgtaagatcctctcaatatgcaattcttggctttttctcttctacctgcaaacctgaacagatgtctgtctggttgttttttgttgtttttttttgttgttgttgttttttgagacagagtcatgctctgtgtcccaagctggagtacagtggggcaatctcagctcactacaacctctgccccccacgttcaagtgattctctcacctcagcctcccaagtagctgggattataggcatacacccccatgcccagataattttattatttttgtagttttagtagagacggagctttgccatgttggccaggctgttcttgaactcctggtctcaggtgatttgcccgcctcagcctcccaaagtgctgggattataggcatgagccatggtgtctggccaagatgtctgtcttgatctctggaagccctacgttctttcaaccatccaaccaagctccacttctcttttgtaactttgctttttccttaataagccttccccaaatctatctgtaccgtttgttctagcatccccccttcccccggatatctgtgtgtgttatatgtatttggtgcacatatgttgtctggtccagctggtagcatttagatcaagtaatccacaggctgcaaaggcaatgggaaacctccttatttgagatcactaccacagtcacattaatcaaagaggcaagagagcacaggttcttgattgtccttgtagctggtttgtctctgttgttaaaacagggttctgcatacaycctgaggttccttcctgccttaccaatattgaatgccaaaaaggagtcaactgacttgaccaggtctatatttcttttctgtcgctccaggattcttctacagccagatgattccttacagatcttggcaccagtggaagcagatgtgggtttctacacttgcaatgccaccaatgccttgggatacgactctgtctccattgccgtcacattagcaggtaacccaaaaatccctgttctgttcatttcataaacctttattgaatgagtgcctatagtgtgtcaaacaggcccagagatgcatagataaaggagacccagatcccatcttcagggagtttgtaatctataattacaacagcagtgtagtatgargtagaatgaagtgctataactgataaccaaatagtatgcaaggacagtacattcctgccaggaggtcttagggttgcaatgagtggaattttgataagagacagggatatttcatgcagaaagaataatgtgagcaaaggtgatgtgtgcaaatcagtagcatgttggaacatgaattgtgaattataatcattgaagactcttttggatcctgtcatctccttgttccacctgttgcaagaaagaytacgacccataaataattggaattctgtggtcatggcttgaagcaggagtgttccccagtacttctctctsagtctgctttatttcatcctcttgctctaatgcactgccaacattcccctttatccattgaggttagacaatacattctgcacatggtgacttaagaacattgcaactcagagtaccatgtctcccatagttgtggtcttgtagtaaaagacatgtagagcttttataaaacctctttgcataggacaaacccatgcctttgaaacggaaagagaacttagataccagctggaccaaggcccttgtttctcagaggccaggcaacccgaggtcacacagctgctctgctagtggcgggggaagaagggaactggagtctcctaactcccagctcattgttctccctacttccccactgatctgagaaaataggatccatcctctcagatctgggccatccagtctttgtggctgtgttgcatgtgtttgtatttattcttttcaattgctgctctcatcagatgattcagtagatgstagaaaagccaacatcaccccacactgacttcatctgtccctgccaggattatgttgtcatactgtactccagtcacacatgctacccccttgcatatctgtttagcaacagtattcctgcccccatgacttcaggctgatctgggaagggacccttagcaggcggctttgcggggaagatcaaagtcaacaatgaagaaggcaatttaaggagccctgggccggattaaagactgatattattaatgcctattttttgtgaataaaacatttgcttttcttctaatgtattccagttgcaatctttattcccctctttatacagagtccagatgctcagcaccaatcttgttaaatctctcctgccatccaccctccaacctgctttagcaagggcactgctgacatcttkccacttgctggcagatagtggctcttgcaggattaattctcttgtttatattaatccagatatggttcagctctatcacagactaaatgccctttgttcacccgaatttaatacgattaatagaaacctgtctggaattaagcaaggcaattgtaacatcaggcttgccttcagctctttgaagaggggttattggaggctgccaacaagttcaaagccagggaagagagacagagcagccaaagaggcaccagggaaggggaggagaggggctgcctggtgaagtatgactayagacaccacacccagggcatagggagctgcatccttgcaccttagctgctagggtttgtataggtctgctggaaartctatcaagcagtccctctaaaaacaaaggctcaaatgtacattgccttaagactgtatttgtacccttacctgagtttatcatccacacctgtgccaatgtctacactcacagtgttaggtggttcaccagctcctgttgtgagcacaccctctgccacatrttgtggaacctacagcaataaataaaacctgtgttttgtggtccctgatgcttacagaggagtgaaggcaagcgatsgatacccggctacctagaattgggagaaagttgcaatttacttcaaatgtatgcatggagaccctgcttagtaggttataagatataatctgaacataaattaaattggaggggtgggggtgaatgagtatcaggcatttctaagttttattgccagttatactccttattagctgtgtgatcttggacaaagtatataacctcattgagtctctgttctcatctgtaaaaatttaactaacattattttacagggttgttgtgaggttaagtaagattgcacgtgtgaaaaagcacttaacccaatgccaggcacattgttcatactcaataaatgtaagcctcctttctttctctagctcttctagagtgaaacaacctgaaaacaattctaaaatgtgcaaaccattatcccaactctgcttccatgtatctttcagtatgtgtcttaacactgagatttttcaagtatgaacttagaaactgattcagttcacttgcagtcaaatcctcttgatgaatctcagcactactatgtttttatggaaactgcaggggttttttcctggactttagtattaatgtaggccaaagaggaaaaaaaaaaaaaactttgagcctcaagataatcaagtgtccccatgattttataaggaaagtatggacttgtgtgttgccagtgtgcctgcatttaccagatgcagggaaatttgttcataatgattcacaaaagcaggcatagcatggcagttaaaatcatgggctctggagccttagggtctaggtctgtatcctggctctgtcacttcctaagtgtaaccttgagcaacgtctttatactcactgactcaatttcttcatctggaaagtggtgctaataacagcacctgactcagaaagttctcatggagattaaatgcaatcattcataaaaaatgtttataattgtggctggcatgtagcaggcactcaatatttgttagctatyattattgagagaataatacatacaacaaaagccaacttatgtttacagtgggagagactccttttcagggaccaggatgctcacaaaccctttgtagagcagctctctgaatgtctcartgtcaaatagggaagctagattagccatctggaaagtacttggggtgcctggattcagagcaagggagatggcttgtgatgaatatttcacgtgggcaacagagagagaygcctgatgggctctccctggcccacagcaagatgcctgccattgagtttgccccgtcccgtagatctggtgtcttgccaattctgcctctcagattcatttcagttctacttcttattctgtacacaagttttctttgaacatgtaaacaccatttagttttagacatagaatacagccaaaccttccttgctctgccctgtttggcctataaaatactgtcttttgtgccttttgctcctctctaaactcttccattacgtgctgattttatctttaagtctcagggatttgggagtaccttgcaagtgtctctcagcatggagatggccagtgtttccctccctacctccctggaacagcccatggaactcacagccatttagaccaaatggcacaaaattcctccctctaaattmacttagctggatgcctgtttcactgctccaagtgtagatgaaagtagcttaggaggggaggattgcagggaggagattataggaatgtcaccaaaatgtcacatacctaacactttgaagtattaattactttgtgttcaggaataaacagggctaggtaaaggagagtctctgatgtgtgcagacataagcacagagattggagaatcatcttggctgttaaattcagcactcagccatcttgctcagaaatcttccaaatccgaatggcctaggcaaasttttgaaggaaaggaagtagtttccaggtaaattgcttcagtctggatccgtggagtttagctgtacttaccaatgcagataagggcctctccaggtatggagcattggtgaggtcatcgacaaaagggaaacatttttggttgttattgattttataagatcacaaaagagatactgtaaggcctgcctgacatcatcaatgggaaatgagaataagatgagggctgagggatgagtgtatctttcattgaaaggagagaacacagatgagctcatctgacattttcacaggaagggagagacagaaaatatttctcctttcctagcatgtttttttgctctttatgagttgaataactgatacacattgtgtctaataaagagatcacagaaacctcactgggaaaataaaaataaaaggcaatcattttttaaaattcttcttcctctgtccctccccatcatgatttagtagctacaataaaagacaagtgattgtgtaagcttatcataatgtaagtcacttcaaattagcatttctgaatttttcacccagcagttctgttaacaaaggagagttttgcttcataaagagttaggctcacagaggacctagtcaacaatacaaaggctaacaaaggaagatttgctcccatgcactagatcaaaaggaaaagtggcccaggcacggtggctcatgcctgtaatcccagcactttgggaggctgaggcgggcagatggcctgaagtcaggagtttgagaccagcctggccaacatggcaaaaccccatctctactaaaaatataaatattagccatgtgtggtggcaagcgcctgtaatcccagctactcagaaggctgaggcaggagaatcgcttgaacccgggaggtagaggttgcagtgagccaagaccatgccactgtactccagcctgggcaacaagaggaaaactccatctcaaaaaaaaaaaaaaaaaaaaaaaaaaggaaaaatggacaggtttgactgttctctgggccacatggtaatagcgactgactgatctaagctgccatcaaggagatttcaatatctgatagaatactgaatagctaagacccttaagtttttctcagtaagtacagatgtagagaatgcccaccaaagaccccaagctttcatagaacttacttaaaactgatgagagtatagcaggagaatctcactgagctccccagttgactagaggaaataaaaaagaaagtataagtggtccaagttggcacatctcagtctcaaaaaagcaattccaacatctattcaatggaatgcaggaaggatggtggttggacaggtggtgggatataccacatccttggttagtggtttctagagaggccgcagcatcacgtggctgtactaagtatggggtcccttggctaggactctgtagtggaacatgcgaagaatttgtggcagaaccacttctggccttattctacttagacgccatcaacatcaattaaataattagaagaggtaatggtagtaatctgagcaacctgacccactgacattggcaaaaaaatatctgaatattgaaagagaatggtaatggaaasaaggatatgagaaggaaggcatgcagcctgggaatgtctgggaaaaggcagtctaagccctacctacttcctcaagtgctaagggccctgtaatatttatgctgaaggcgtgccaactaaacagaatttcaagggcacaaaaattctaattccttctcatcttttatgcaaggcaattaattagtagtcacaatgttgaccctaaaaaacaaagacaggcaaaatcaggttaaaactattttttcagctttattgagatataatgtacatatcacaaaattctttgtgaatgtgcaatttagagatttatttagcaaacttatatagttatgtaaccattactataaagttctttaccttttttgaacttttaggttcaggggttgaatctccaggttttttatacaggtaaactcatgtcacagggatttgttgtacagattatttcatcacccaggtactcagcctagtacccaatagctattttttcagctccgctctctcctcccactctccaccctcaagtaagccccagggtctgttgttcccccttcttygtgttcatgaattctcatcatttagttcccacttataagtgagcacatgcagtacttggttttctgttcctgtattagtttgcctccagctccatccatgttcctgcaaaagacatgatcttgttcctttttatggctgcatagtattccatgatgtatatataccatgttttctttagccagtctgtcatkgattggcatttaggttggctccatgtctttgctattgtgaagagtgctgcagtgaacatttgtgtgtgtgtgcctttatgatagaatgattttatattcctctgggtatatacctaataatgggttctttacttttaacagctttatcaaggcataattaacataccataaaactcacccacttaaagtatacaattcaacagcttttcatatattcagagttgtggccgggcacagtgactcatgcctgtaatcccagcactttgggagcctgaggtggaagaatcgcttgatccccaggaattcaagaccagcctgggcaacagagagaaatcccatctctacaaaaataaaaatcaacacaggtgtggtggcacatacctgtggtcccagctacatgggaggctgaggcaggaggatagcttgagcctaggaggttgaggctgcagtgagccaataccactgcactccagcctgagtgccagagtaagaccctgtctccaaaaacaaaaaaaacaggagttgtgcatccaccaccacactcaattttagaacatttttattatccctaaaataaactccacactcttagctactactccctaatcctcccatttctttcagctctatgcaaccactaatatactttaaatctccataaatctacctaatcttgatattttatataattagaatcatacagtatatggttctttatttcttctttcacttagcataaagttttcaagatttatccatgtcgtagcattattcttgtttatggtagaataatattccattgtatagaatagaccacattttatttctccattcatcaggtgatgggcatttgggatgtttctactttttggctattatgaataaagctgctatgaagattcacgtacatgtttttatgtggacatattttttatttctcttggttatacacacstaggagtgaaatttctgggttgtttggcgcatttatgtttactattgaagaaagtgccaactatgtttcaaagagactgcaccaytttacatttccaccagcaatgtaggatagttcagtttctccatattctcaccaacagttgttttcatctatcattttaattacagccagcctcatgagcgtgaagtagtactttattgtgatttaaattacattttaatattgactaatgatgtcaggcatcttatgtgtttatgagtcatttacgtgtcttctttgttgtggtgacaactttggtgatgtagaaggtgtatatggcctgcgtatttgcttttgctgccataacaaataaccacatacttagagacttaaagcaatacaaataccttacagttctgtaggtcagaagtctaatacagtctcatcaagatgtcaacaggctttatccctttccgaaggctctaaaagagaatccttttcctctccatttgagttgttggcagaatttagttctgtgaaacttaggtctatggtctgtgttttcttgctggctataatctgagtgccatttccagcttctagaagccactgaattccttggctcatggtttccttcctccatcttcacaaccagcaatggagggctgagttttcatgttgcccaactctgatattaagagctcacatgattagactgggcctaccttgataacttagaataatctccccattttaggttcagctgattagcaatgttaattcttccttagccatgtcacaggttccagggattatgacataaacatcttggaaggtcattattccgcccacctgtctgaagggcacagctcattttcatctgactgctatcccccaaaaataaaaatttaatgttgctagactttctcacgattttagagacaccaaaccaaaaaatgtttaaaaacaacacttttttttaactcaccatttttaactgaactaattcaaatttttaaaaatccttttttgggtaaacatgtctgtgctctgaatatagccttgaggctaccaataccccctggtttgtatttcattttctatattatctgctcatatattacacctcactttccagatagagtcagagtgttattcaaagggtaatcacaatttatttgattagattattccaacaaaaacaatgtaataatttggatggaaggggaacaattattttttactattactaagaagcctactgtaataatagaataagtaagattctagggaaagtttttgcttcattgccaaatttagaagcagaataggactatgaacctctttcccgttataaacagagggatttaaatagctgctctcttgggtctcttttagacccaagagttctatgaatctcttgcayatataataatgaatgatagcattctctaccatgactatcaactattaactccctttacctgaaattctgacgttgaaaattgactctgttgtattttggggaatggaagactagatggcaaagaagtagtacagcttttgtgatgaagtcttgcaagaataacaaatgaaaggaaaatgtctcagagaactggtgaagacaaagggtacaggrtaaatagagctsactattggtcaaatgctgmctcaggaggctggaaatagatgtaaaggaggccttgcaagaagktcagcagggagttaaaaactcctgcactataaaatgcaaaagacattgggaaggaaaactagactaagaaaagatcttgcatgttaatataactattatttgtaacaaagcaactcttatgggaattgtcaggtagtgagatccagaaaagcttctggccagcaaggaatagtaatggaacattaatattcagaatccattattactaatatcagatggataagatattgttggtatttataagggttttcctagctcatgctgattttagtccctcaaagtttatttgactcatgagtcttaaattcttcaactggaaattttcatttcagagaaaatttgaagatttaattccagtgatccttgtgagaaacctgtgacaattctagtataagcagagtctagcatttcttaagacgtttctttgatatactcactctttgtaaggtattgttcattgattaaatctggattaaatacaatttgctcagtttagggtgttaaaaatgtgttaaatttataatacttcattgctttaaactaaaatattaccttatactgtactcaaatattgctgtatactcaaatattttaattagtagacatcactgtcttttttgtgttttaaactgatatttggatcttccatggatatcacaactgttttcttgaactctaatgggggtcacccagggagtcaatctggcatatgttgtttcctagcatttctagaagtgggtactttttggaatcttcaacaaggccagccatggtgtgacttttaagctctccgcatctgtccagatattgttaccagtttacaaagaatctgttgtatttaaattatttcttctaattacactggaattctcagagttgttcaaaatagaagcagtttagttctttctaacaaatgtattacctctcctcttacctgtcttcctctttcttttctttaacgttttgctttctgtgttttctgtattcatcagaaggtcccagcactgctcctcacagagttttgccattgtgttatagcagagatagtgctggtgatagctagcrtttattcaaacttcctgctgtgctaagccgttgttcttacagctttgcatgcatccatttacttactcctctcagccactgtagaagtagaaaactgaggcacagaatttaaataacttgcctaagggtacttagctatactatgcagagatgagctcgggacacctaacctgtagacagccctttctcctgcccctgcccctgcccmctgcaggcatcactagctcatcgtgtgtttttgctcttcagcccttatgaatgtaactcggaatccgtatctgcacagtactccaggaaaactctgtcagtcattagatttggcttcaggayctcaaacctgtttgctgttcgtgggccctttctgaagctctcatgaaatctccaaacctgccaaatctgcccagcctgcggtccttgtgtctgttgttgccccgtttccatttatcttccacaagtctctcttcaccctgagaatgaatacacatgcacacctcctagcctaaactgccttagccaaacagagaatctaagtccttgaagtacaactcatttttgatggcaaagactaggggaaattattttgaagtatattcgtgacttacaatgttaraggaatggaaggaagacccattggwtccatccattcagggtcaacaaacgttcattaagcctgggttaaatggcacttactaactgttacagaaaaacaaacctataaatatatgatgggtaaaatatgatagtttatttcttgctcacataaagtctaaaagaattgcacaacagagtttttgtactttgggccaagaagtggcacacttcacgtctgttcatgttccatctgctagaactcagttccatgctcatagcyaactgcaaaaaggctggaaaattatctagctgtgtgcacaggaagaagaggaaaagggtttggctgatagcaagtcactctctgccatggcttctaaaatggaaggcggcatggcagtttaaacaaagtttctattagcagaggcmtgggattcagccctgagtaaacagtgcttacaatgctctctactcttggcttcattcaaaaaacaaactttccatctcctctggcttctctctcaatcacctttatattaggccaaagatatttttcaaacacatatgttcagattttttcccactgaattttgattttaccccaaatcacataggagagagacctgagccagagcccagactatgtgcaagaatggatttctgagcattgctccaggggttactcatctgtccctgcctgtctctccagaggtcctcatccttcaggatcaaaatggtgcctggttggctgaacacttctgttttaaaggcatcacaaggccatgctccttccttaatggccttcacatccttggatgctgacgtacragttttagccatatgtcaggctctcctkttgtgtaagagctgccctcgtttactgtgaggctctatttcccctgttacattacttctaacaggaactatratccaaaagctgtactgtgggtacaatgaggtctgaaggaaccgtgcaaaaatgattcttgtaatgcttctktttctgtgtctgactatcttggaggggcttcacttctcatattgggcctgataaattgaaacgcttgcctttatttcggtttccttattttttcttcaatttatacagatacaaaacttggcatattctccttctgtttgtatggctctcattcagctataacacaaacaaatttacagattaaatgaaagaatgtaaaccctatcaatttctataaattaacactattctgtgagctgatgctgacttgctaaaactaaatggctgttcacaaagcatacatagtacaggccgggcgcggtagctcacgcctgaaatcccagcactctgggaggccgaggcgggcggatcacgaggtcaggagatcgagaccatcctggctaacacggtgaaaccccgtctctactaaaaaatacaaaaaattagccgggcgcagtggcaggcgcctgtagtcccagctagtcgggagcctgaggcgggagaaccggcgtgaacccgggaggcggagcttgcagtgagccgagatcgcaccactgcactccagccagggcgacagagcgagactctgtctcaaaaaaaaaaaaacaaaaaaaaaacaaagcatacatagtactgactgctgaggcgcggcgcattcagtggagggctcagtaatgctgacttagctctcagcacctttttctgtttttcctattctgaaagcccttttggtacagcgtgccatggcttttgttatcttaacacaaatgtataatttatcatttcactccttctctgcatctatgtttttttctccttagttaacttctatggttaaactagtactagttaatatcaatgtgattgtaatcgtgtccacaaacataggtactggcaatcacgtggcagtcatcacacagcagtaatctattagtaggtgatcaaccaggtgatctaaagtaggcttatgttgattttttttaagttggccactaaaataacagctccagcttgaaaaattgtaatagagatctagtggtgtctcaaaagataatctctcaccaggaagaagaggaaccagttaaagaaaaactaaaagagtacaatgtattgaatatcaaacctgcctccataacagaatcacctaggaacttgtttaaaatagagattacagcttgtaccctgtcacctgagattcagatttagtagttctgaagtgggactcaaaatatatgctaacgtttttctaataggtgtaagagggtcaattgattaagcaacattattttcattaaaatctctattgattataaatacttggataactttgtgctttgtcttaacaatggatcatgaaagtaataagaatgtataagaagtagcctgtgctaacaacagtgatcctcctgacaagaaaaaaaggccattactttccagcaaaaactcaatataattaattaagggctggatttcattcagtgacatttgaattttatagctatacacttgcagctataaaaaaccacctttattattaaaattcctgtaggaaaaataacttggtaattgtgactctaaagctctctggtccctaacctcattttccccactggcacagttgtttttataacacagtagagcaactcttgtattatagcaggacagattatattttaaacaagtgccctgggaattctgaggcagccagtccacagacaaagatttgggactacctatcacaagcaccagactttaggtcaaagatctgggctccagttcagccctataacttgctagttctgttgccttggacaaaccatggggcctttctgagtctgagttctttgtgtatgtaaaagatagtactgttgtttctgcctctcagggttgttatccaaaaaatccagataatgcacatagcacaccatataaacacwttttcacttaacagatacttattgagaatctactaggcgccaggcctaggtgatagaaataaagaagacaagagagatgtgatctctgatgttatcaaaattacataatgaagtagcaggggctggggggagatacacaaatatagaagataaattctgttagttctagkgcttatgaaaaaagtaaagttgtccccatctaaagtatacatctcttcacctccataccacacacagggatgcatgctttatatggagtggttagaaaaggcctcactaggaggtgttatttgcacagagacctgaacgaccggaagagagccgtgcagaagtctgtaggtggaagatgtcagggacagggaatggccagggctgatgtgctgctgtgttggaggaaaggaaggccagtgtgctggagcactgtgattgatggggagtgtgggctaagtgaggtaggtgatatagaccactgggtcttaatgtacaagggacagttggtcatgaaaaggagcttgaggccgggcatggtggctcactcctgtaatcccagcactttgggaggccaaagcaggtggatcacctgaggtcaggagttcgagaccagcctgaccaatatggtgaaactccgtttctattaaaaatacaaaattagctgcatgtggtggtgcatgcctgtaatctcagctactcgggagactgaggcaggagaattacttgaacccaggaggcagaggttgcagtgagctgagatccccccattgcactccagcctgggcaacaagagcgaaactccatctcaaaaacaaaaaaaagaaaagaaaaagagcttgaagttttgttttaattgtactgaaaagggactggaaagtttaagcagaaaagttgtatggtttgattcatgttttagcaagatcacgctggctgccataaaactgtagtgagggaagagtgaaagtcagaagaccagttagtctgtatagtagtccagccagagattatggtagcattagatcatagcaacagagatgctggtgagatgyaggggtagatttggagtcagagctgggtagctctaactctgagtagggaggtgaggtcatgtataccagtgctaattcagtatcattccaactgcttcctcccattgtggccatacatttactatgctcaacaatcattatagtactaaatcactcatcagatgatacataatctcaaatgtatggaatataagttgtataaggaaaaaggcccctgaacagtcaaaatagagcctatgcatgcattccaaggtgagcttctcagaacattattcaagtttctgcccttgaacacagttctgatgagcttaattacctatgcctagaaggcaaataaaatggcaaagaagaaagagggatagcttctattatgaggctgtgggacggtacaaacaggaatacaggataaatagatgtgggagaaaacaaaaaatataaaaagcaagtataagactccaaagggcatttctgaattaaggttttcttcacatttaatgaaagcagagaagagtgaatatcactgtagaatatcctgcctgtaacatggttaaaacaaaattaaatccacttaacttacagaaggttaagcttgggttatatgaatatgatctcatggggacccwacttccccaaggtgttcaatgaatgagtcttttcattgtattttgtagtcatgtgcatgaagttctgtattttattcccagctgataaaggcctattaaaacacaatgtacacaggacttcgacttctggaaagatggcatagttacacttttccctattcttactgctaagtaccactaaaggccctgtacattatawataaaacacacataaggagaataaaaagtaaagggaagaaagccaactgaccaaagaccttggaaatcaaactgtaaatttgttgggttttctttttgcctcataaatcacaracttggagttcaagaagctggctactggtaaacaccaatgagtaccaaaaaaaaaaaaaaaaaaaaaaamaaacaccmgctaraaaccttctctctctaacaaaaggactaggaaaggggaagcatagcaagacagaaaacctttagaaaattctactctatgctagccaaatgccaccgaaaacagtgtgtccaccactacctrcaccagcaaaggctgagcagggagcctagattccccaccagccagcctcaaatgaggtgccccccaaccctcatggaggggagtatcagagattttcagtcctcgttcattacacctaccagagtgtaatgtggagaccacatggggagcctggagttccaccttcaccctgccgtgcccacctttccctccccactggggtggtgtagaggaggtctcctggagagtgaggacttgtaccacctgcccaaggtgaggaggctcctcccacagctgtgtagtggggactatgtggggatccagaactcccactcctgcccagcagtaatgaggagtcccacacttgggtaacaaaagaggccaagtggagaacttggacttaacctgcactgggtagtaacaaggaggcatctccctgctcccaagcctgagtggttttatagaaagcagctaaaacagaaggtttacataagatccagagtctcataactaaaaaaatatacaggcttcaattgaaacctagacatcatgaaaaaacccaccttcatcacccttattcattgtagtgctagaacttctacccagtgcagtaatggaagaaaaggaaataaaaggcatagagactggaaacaaagaaatacaacttgtccctatttgcagatgaaatgattgtctttatagacaatcaaaagaaaaccaaaataattaggttaatgtaacaaaatataacaggacttgtatctcagaaacaacaaaactctgatgaaagaaattaaagaagatctaaattaaagaagataaatagacatatttatcatggattggaaaacacaacaaagtcaagatgtcatttctttcctaatatacatgtttaatctaattcctgtcataatcttactaatattttatacatgtagagaagattattctaaaatgtatatgaaaaagcaaaggaactagaatagcaaagaggcaggagwaatcagccaacctaatttcagaattagttatatagctacaataaataatattgtgtgatattggtagagggacagacacatagatcagtggaacagaatagagaactcagaaacagatctacacaactgtgcccagctaattttgacaaaagtgcaaaagcaattcaatgtaggaaatataaccaataagtggtgagagagcaattagacatccatagtcaaaaaataaatgggctttgacctcttatctaaatgtgacctctcacatcttacataaaaattaactcaaaatatatcacagacttaaaggtaaaatgtaaaactataaaacatttagaaaaaaataggaaaaatcatcaggacctagatctaagtaaatagttcttaaacttgctatcaaaagcataatcctgtttttgcttttgttgcctatgtttttgggatcttatctaaaaaattgctgcccagactaatgtcatgaagtgtttcckctatgttttttcctagtagttttatcattttgggtcttacatttaaatctttgatccatttttaatttttatgtagtaagaactaggggtctagcttcagttttcccagcaccatttattgaggagactgtcctttctctgttctgtgttcttggcacttttgttgaaaatgagttggctgtaagtacgtggattcatttctgagttctctattctgttccatgggtttatgtgtctatttttatggcaataccatgctgtttgggttactgtagctttatagtatattttaaaattaggtggtgtgatgcttccagctatgtactttttttttttttttttttgagatggagtctcactctgtcaccaggctggagtgcagtggcacaatctcagcttactgcaaactctgcctctttggttcaagtgattctcctgcctcagcttcccaagtagctgggagtacaggctgtgccaccacgcccagctaatttttgtatttttagtagagatggggtttcaccatgttggccacaatggtctcagtctcttgaccacatgatccgccgcctcagcctcccaaagtgctgggattacaggcatgagccaccacacccggcccccaactttgtacttttcgctcaaggtttctttggctatttggggtattttatggttacagacaaattttgagattgttctttctatttttgtaaagagtgtcatttgtattttcacagggattgcactgaatctgtaaattgctttgtacagtatggacatttgaacaatattaatccttccaatccatgagcatgggatatctttacatttatttgtgtccttttcaatttctttcatcaatgttttatacttttcagtgtagacatatttcacctccttggttaaatttgttcctaaggggttttttgtagctattgtaaatgggattgtttccttgattattttcaggtagtttactattagtatataaaaacactacagatttttgtttgttgattttaaatcctgcaactttactgaatttgtttgttctaacaattttttagtaaagttgtagggttttctatatatgagatcatgccatctgcaaacaaggacagtataactttttcctttccaatttgaatgccctttatatggttctcttaactaattggtttggctaagacttgcagtactatgttgaagaaaagtggtgaacatgsatattcttgtctggttccagatctaagaggaaaaaatttcagttattccccattcagtattatattagctgtggatttgtcatatatggcctttatattcctgaagccttctcaacctaatttgttatgagtttttatcatgaatggatgttgaattttgtcaacagctttttctacatctattgtctttcttataatagccattctaactggggtgagatgatacctcactgtggttttggtttggatttccctgaagattagtgatgttgagcatatagtttttgtccttcattctgttcatgtgatatatcacatttgttgatctgcgtatgttgaaccatccttgtgtctgtaggatgaaacttcttcatggtgaacaatctttttaatgtgctgttgaatttggtttgctagtatattgttaaggatttttatatacatgttcttcagggatcttagcctgtagcttcctttttgttattgtgtccttgttggttacatccaactgaaaagcttctgcacagcaaaggaaacaatcaacagaataaaaagacaatctacagaatgagataaaatatttgcaaactctttatctggcaagggattaatattcagaatacgtaaggaactccgacaactcaacaacaacaaaaaataattttcaaaaatggacaaaagataaaaaagaacaggatcaaattctttgtaggaacatggatggagctggaggccattacccttagcaaactaacgcaagaacagaaaaccaaatactgcatgttctcacctataactgggagctaaatgatgagaacacgtggacacagagggaaacaacagatgctagggcctggtggagggcaggaggagggagaggatcaggaaaaataactatcgagtactaggtttaatacctggctgatgaaataatctgtacaacaaacccccatgacacaaggttacctatgtaacaaccctgcatatgtgcccctaacttaattagttaattaataagggcaaaagacctgaatagacgtttctcaaaagaatacatacaaatggccaacaggcatatgaaaaaatgctcaacatcactaatcttcagagaaatgtaaaccaaaaccaaaatgtgatatcaccttacctctattagaatgggtactatcaaaaagacaaaaaatagcaaatactggcgcagatgtggagaagagagaattcttatacattgttaatgggaatgtaaattagtatagccattatggaaaacagcttagatgttcctcaaaaaattaaaactagaactaccatatgatccagcaatcctactcctgggtatatatgcaaaggaaatgaaaacagtaatcaaagtgatatctgcactccaatatttactgcagcactattcacaatatccaagatatagaatcaatccaagtgtccatcaacagatgaatggataaagaaaatatggtatatatgtacagtggaatacttttccaccattaaaaaaaaaaaagaaaaagaatgaggrcaggcgtggtggctcatgcctgtaatcccagccctttgagaggctgaggtgggtggatcgcttgagcccagccaggagtttgaaactagcctgggcaacactgggaaaccctgtatctacaaaaaaatacaaaaaatacaaaaaaaaaaaattctatccaggtgtgatggtatacacctgtagtttcagctacccaggaggcttaggtggaaggatcacttgagcttgggaggcagaggctgcagtgagccaacatcacaccactgccctccagcctggatgccaaagcaagaccaaccctgtctcaaaaaaaaaaaaaaaaaaaaaaagagaaaaaaaaaagaaatcctgttatttgcagcaacatggataaacccggaggttattatgttaagtgaaataagccaggcacagaaagacaaacttttctttttatggatcatgcttttcaaaattttttcattgacacataataattgtacatatttatggggaacagtgtgatttttttggatacatgtatacattgtataaaaatcaaattagggtatttggcgtatccaacacttcttatatttatcatttctttgtggtcaggacattcaaaatcctttcccctagatattttgaaatatacacatagtcaccctactgtgcaatataataccagaacttattcctcctatgtaactataactttgtgcctcttgaccaatctctcgctatcttcctctccccgctcccttccccagtctctgttaaccactatgctactctctacttctataagatcaacttctttagattctacatataagtgagataatgcagtatttctctttctgtatcatttcttttttgagacagagtctcaccctggagtgcagtggtgtgacctcggctcattgcaccttccacctcccaggttcaagtgattctcatccctcagcctcctaagtagctgggattacaggtgcatgccaccacacccggttaatttttgtatttttagtagagacgggatttcaccatgttggccaggctagtctcaaactcytggcctcaagtgatcgacccacctcagcctcccaaagtgctgggactacaggcatgagccactgcacccagcactctctattatttcttataactgcaagtgagtctacaattaccttaaagtgaaaaaatttaattttaaaaaagggccctgtaaaacatgatgtcgaggattatttgttaatttaatgattagaatgcataaatcatctcaatttgtataacatgctctgtcttcaaactcttcaacccttggtcttttttttttttttttttttttttttttgcaagttgtaaacattttttaaatttaatttaattttaaaaaatttacaaataatagttgtgcatattcatggagtacatagtgatgttttgatataattaatatatggtgatcagatctgggcaattagcatatccatcattgcaaacatttatcatttcttttactgacaacactgcggtaggtaggtaggtagatgcttttatactgtgcgcttgcaatttttcaagagaaaacatagttagtggcaaaagtctgggtagaccagccatgcattggtggttagcccatatttcaaaggagtgccccaatttccacagtcaccaccaagtaacatctcatattctttcttatcttcaggaaagccactagtgaaaacgtcacgaatgacagtgatcaacacggagaagcctgcagtcacagtcgatataggaagcaccatcaaaacagtgcagggagtgaatgtgacaatcaactgccaggttgcaggtgagaaattmatgttcatttgttcacacgttaatggagccctgtgctaggttggggatacaaagacaaattagacacaaattctactctcagggatatagtgctagtaggaaagccaaagcatgaacctcagtcgytctgaaagtagaaagtgctacagaaatttagaggaagaaagattaattctgactgggacagataggtaaaattgatctttttatgtgtatgtttttctttaatcttagccttccatacagatagaatgtgaacctgcaaagatgggggcaaggagttccaagtggacacaggagagtgataaattcatggaagtagaaaatcctctaggctgtagagagaaytgggtgagctttggtctgggtggagcccagagtgcagaaatgcaggtgggaagtgacattaaagagccatgcttccaaaagacaaagccaccagcattgaagaaaatggattgagaagggaaatactaggacagaaaggccaagtaagacccatcactgtagtttagaggagaagtcatggaggcctgaactcagggcagtgaggatgggaaggtaacgactggatggacatgagaaagatggcaagaggtaagaccaacagcagcgtggagcttgctcgaatcagaagtgggcaggagttattagagaagatagccagtggagttctgatacaggcattgctctcaggtgggccttgcaaactcagaggtcaacagggaccaggaaggcacagtgaagcaaggagtagtagacaagagggggtggtaatatgctctgtataaaaatatttacyttcaattaaaagacagaaaacacctacatatagcagaatgaggcccagctactatttttcccttcatgtagaccactcatttgtcatgtgtgccctaggggtttcactgccacaatgggatgaagaaatgaatggttcttgtgccattgggcaactagtcttctgattgctgtcctcatcagatataccccacagtggcatggccacaccaaacccaggttccccgatcataccctgtctgcagagtagataggcagtggcaccccatgctttggtggttkcttcatcttagatcttcatcatatgaaggtttacctcaatttgttacttataagacatgaaaacccattttagagtaagtaggaggaatatcttaacctagggcttactgtttccgaataacagccaagtctgattttctctgaaatattctgatagctttaggctatctgaaatatggccagacctggtggctcacgcctgtaatctcagcactttggkaagctgaggtgggcagattacttgagccctggagttgaagaccagcctaggcaacatggcaaaaccttgtctctacaaaaaaatacaaaaattagccatgtgtggtgacgcatgcctatagtctcagctgagggaggctgagatgggaggatcgtttgagcccagaggtcaaggctgcagtgagccatgggcatgccacagcactccagcctgggtgacagagcgagaccctatctcaaaaaaaaaaattaggatatctgaaatataaatatatctttgtaagtgtgcattagctttgcctttgtaaagcttctcatggcctttgtgatgtttcccttccagcctcatcagtgaaatctagaaccaagtcccttcagcccctgtactcctagatagggagtaagacaaaacccctgacagggrttggcatgaatgagctacccctctgtgcagggattaatggtggtgccagtagagccctttctgcagaaccatcacccctcaacacacacctgatcactatggacacatgctttggcgatgaaacactggtgatatgatggaccatgttgtgtatcttcttgagaggtggaactggtagragtaaaagaataggggaggggccaggcatggggactcacacctgtaatcacagcactttggggggccaaggtgggtggatcacctgaggtcaggagtttgagaccagcctggccaacatggtgaaaccctatctctactaaaattacaaaaattagccaggcatggtggcaagtgcctgtaatcacagctactcaggaggctgaggcatgagagtcacttgaacctaggaagcagagattgcagtgagccgagatcgaaccactgcactccagcctgggcaatagagcaagactctgtctcaaaaaaaaaaaaaaataggggaggaaagtgcagcaaaacaaggaaatgggcatttaaaggagattgagagraccagaatctggttgaggaagtatttacgttggggagcctaakatattaaaacgagctttggccactctattgtgccgcctagggccctctctctgggacttcatccagaggctcacttgataaccttatagtgagaacctgatatacctagttttccctggctatgacattgcagtctttatttttgtttttatccataaaaccatctgtattaatgctgattaactaaaataattatttgtatatttgtccttattcctcttgttaaacaagatactcattcaaagtaggtgggaaagagcctgcttataattacacagtgaatttgctggacaaggaaatcatctgtgagcttagtctccagttaaaacactgacagctataatgctaaatgccaaatggcagaggattacttttactttgctgctataagcagctcttaaggctctttccttactcttggtcacctctatcccattcccagtcaggcagcttagtgacctcctgattggttaggtgggattctctaagcaccaataacactgccagtaggtaatactctagcttgagaatttgcaacccagattctcgtaatagacagggaagagggactccataagggcctgcttaaagcagtattttatgtcatattcattcatgttattcatttagcagttttttatggagtatttaatccaggttagatcaaatttctcctaatccaaggagccacagataaacaagatacaattttcaggaagctcacagtctgggaaggagaaaagttatgaaatatgtaatgataatacaatgtgatatgtagatacggttgttgttttcttattataaaatattagagtattaaagaaattttagaaaacacagaaaaatttaagagtccaaaaaggaaagaaaacagcttgttcaaagtcgttctctccaaactcaacmacagctgacattttattaatttccttaatgattcccttttatcctgctttatttcctctcagtaataaacatttgtctgtgtcataagcataattttaatggctatataatagcctatattaagaatattatgtaatttacctagamcractcacatgtttgaattgttagcagtttttcattaaacaactttttgcgtacatgtgctttcagcttacaaaatgcagcctcacattcttcccaatcctgaagcatcaacagcattaggcaatgagtatgataggctttttcttgaaaagtgacctaatccactgtatcactcccatgcttgttctctatttgttctctgaagaggtcagaaaactgagtcggcgataaaggatcaggggaagaagcagtgtttcagtaaatgggaacagaatgtgcaaagggcctgaggtagaaagagcatgctgcatttaaagaagtaaaacctggctggtggtgtggctataatatcaagagcagagaagaaagtagcatatgaggctgaggaggtgtgggtaggcaggggctagatcttacatgttctcatagattatggtacagtttaggtttttctcctaaaagcaaaggaagtatttgaaggacttacttaggagataaaatcagcaggactaaggatgcagaaatagttcaagagtcagtgatgggtggtgtattaggatagattagactctggtatcaagtagacccccaaatgtataatggctcaaatacaatagaaggtttatttttgcttatctaagagcccaaagagtacacctggtcatctggagaggatctgcccccacagtgtcatgcagggtcacaggatgctggtgggtctgacatctggaacacatgccttccaaggtctccataggggttacctctatcctatcaaccaggagaggggaaaacagaatayggaggatggttgagaaggcttttaagggccacgcctggaaggagcatacattaagacttttcacaatcctttagtcacatggccacgcacaactacaaaggatgctggggaaggtaggctcactgggtactcaggaaaaagagggaaactggttttgtgaacagctatcgttgtctgccacagtcagtatggagaaacgtggaaggctggaaaccttctttccagactgccttggttttttagaataattgacaagactgacagttgagttactgtatcctttctcttttctttccctaagccaccctacctccacacctcctaggaagcttctagaatttcccatgtaaaggtgcacctttgagtggaaaccccaccttgagatgttgacacaccgccatggtgcaggcagccttccaaatgtaataagggatccagttaacaagaataccctgtctgggactttttaaaaaagartattttagcatcaccctacctggcagctccatggacatcaaaggcactggaccttgtaatcatatcaagttaccacccagtatgactaagctcttttactgatcctttcaagcagcagggagagcatggggctgttgaaaagatacaccacaggggaaaatgcaaacgtgggttcttttccttcgctgttttaagatacaaataataccagggaggttagcatgtggagcctatccaagtagctggtccacaacaacatagcttttggattttgttctgtggtagagcatattttctgtcattttcaggtgtttgtttttgtggcatttgctgtcacactacagcaggctagaaaagatcatctcccgcaacctgaccaagcttctcaacaagaaagagctaaaaagccagaacacatggattctggaacctctctcctgacaacaccttggttttacaaccacagcagaaacattaattctgaaagtagaaaggaattaagcctttgacagttcagaaatagtaaagcagcagttcagattttctctcaagwgtcaggctagtataatggcaggcggtgtacacttgttaagatggggactgttggcattaaaggtatctcagtttgaatccccaccctggcactggtgggttactgattggctgtagggtagggaactggggggaacagaaactcttttctgatgtaatgatgtaatcgttcaggcatccaaacaaatgtgaccttaggcagatttcttaatctctatgagaccctttttctcataaaatggagttattaaatagtacctgcttcacaggatcattgttaaaaataagtgattgtgtttataaaatgtttgacttatagcaaatgttcaatgttatttctccgtttaacacactcaggatacgtttgcatgtctcagtacactccgatgttgaggtattctgaacatcagtattaggcatgtgtatcactaccttttcaagggactctgtggaacattcaagggctggtgacgttttttaaagcgtcgttgtcatctcctgagagaaaaagaaaaaaaaactttataacacctcaattattgttttctatttcctcattctacatgcgtaatgtcagagccagttatggaaggactggctgtcactccaaggtgtcttagtaatatcattctccacctaaggcccacagttccaggcaggaagtcctcaaaatgtggcaccagtaacaatacctacatcggcaaactcataatgcagatctgtgcttgaatgaatctgagagaggtttgccagtagattaaagaatgattcccacttaatttctcttcccttgggactgctgtcaggtccatggttccaggtttacagaaactggaggtttcttcctccaccctgctattctgaacgtttccatttctcccatgaagtcccctgctgtcaccagaggaattcagcccttttggtttatatccagtcctgtcctctcaaacaagcacaattttagaacggcatgagatagacagacatcaagggaatggaagaagcttgcaagccattcctgggggagtgagaaatagctcccaggtctgtttccatccctgggttctctcccttctccctctgttccaccctccctcctcccctctgtcactctcactctcattttctctccccctgagtctttgtgtttgctgcccacagccctcctcaaaggaagatgcaggcagtaagtgctgcatgtgagcaatgtgagggaaagaggatgaataatggtagaaaatggtttgcagggccggcatggtggctcgtgcctgtaatcccaacactttggaaggccaaggcaggtggatcatctgaggtcaggagttcaacgccagcctggccaacatggcgaaaccctgtctccactaaaaatacaacaattagctgggcgtggtggtgcacgcctgtaattccagctaacttgggaggctgagacaggagaatcgctggaacccaggaggcagaggctgcagtgagccgagatcatgccactgcactccagcctaggtgacagagcaagactccatctcaataagaaagaaaaggaaggaaggaaggaaagaaggaaggaaggaacgaaggaasgaaggaaggaaggaaggggaaggaaaagaggaaaagggtttgcaggaactcatttttccttgttctttcaggagaaaaatagctaagagtgcatttcttcaatttacttctgaggctgtctcctaaatgccgtggattttttttttttaaatgggaaaaaaactaagctcagggtccaaagtccaagctggcatggacaggcatcatgatgctcttgctctccctagtggtgctgcaatgaaaaatcagctgttccacccctcacctgtgtcttttctccaggtatctttagagatgatgccaacctggcccctcttacacacttgagcataaagtatcctactgttagagccagattagcgtgtgcctctctctgatgtgacaaggctgtggtatccaagtctccacccactttcggtagccctgcctctctttctctagccaatttcaaggacacgtaacagatacacaggcaactctttgaagacactctgcattctcaacagaaggctagccattaagggcaaactgcccttgccccaaaggcaaaaaccagccccagctcagggaaaacactagaccactagactaaaggtctggctccttggccattcttggctttgaccccatttcccgggacttgacccttttttttttttttttttttttttttgagacagagtcttgctctgtcacccaggctggagtgcagtgaggtgatctcggctcactgcaacctctgcctcccaagttcaagtgattctcctgcctcagcctcctgagtagctgggattacaggtgcccaccaccatgcctggctaatttttgtatttttagtagagacagggtttcaccatgttggtcagactggtctcaaactcctgaccttgtgatctgtctgcctcggcctcccaaagtgctgggattacaggcatgagccatcacgcccggccaggactttacactttaagcatgccctggatacatgccagtgagttctataaataaactgtgtgagctgggtcagcaggctgagttgtgtaggggagggtgctttctgctccctagagacctgtgaatccgtgccacatatgttcagtctctcaacatactcagagcccagcctcctataggatcctcctaaaacagcatctaggaaggctcatcctaaactctcagggcctgttttccagcatgtcaaccacaaggaaacttcctgaggaattcatggggtccctagagcacagagcctggcttccaaagagagagcccatcccaggtcagcagatgatctccccatcccatctctctcacagaaaataaacttggattgtggaaagagttgagcactttccttttgtccttttcctgtggttctactgatactaccatttcatgttctcttgctctgagaagatatgcaggcttccaaaaatacaagcawgttttctacataagagtgtcaactccagtagcaatctagcagcttccatttgtctagttcatacatatattttaacgttgtatagctttgcactttttattaaaatatatctatacagaaaagtacatgtatcataaaggtaccaagtgaacactccccaccagaccagcccccggtcaagacacagagcatcgccagtggccaagccacttgtcccatttctcagtcacaacccctccccattcattccactgactactaacagcatagattaatgttaccaggtktttttttttttacttacggaaaggaaattatacagtatgtactcttgtgtctgccatctcttactcaacattatgtttatttcatgtagtttcattttcactggtgtatacatttggttctcatgtttttcaaatacattttctccaaagaatttgggtactctccttccaccttggcaagccccccctgccagcttcctgtttcctcctctttgtactggcctccctcttcctgtctcatcactgtaagtttaaaaggcaaaagatctggagacaactgagatgtttatcttgtatcaacatttattctgattctttggtcaccctgaagtctatatccttatcctaccaggctctggacattatttaatctggccaaagcctggtagaagatgtccctgtagagcagccccagggaagggggattcaagaagctataaatgcctctgggctcacctgaatgtgtttgactgatgagtggggttttttgtttttttttttcttcctaggagtgcctgaagctgaagtcacttggttcaggaataaaagcaaactgggctccccgcaccatctgcacgaaggctccttgctgctcacaaacgtgtcctcctcggatcagggcctgtactcctgcagggcggccaatcttcatggagagctgactgagagcacccagctgctgatcctaggtaaacacttcaaagctggctgcctctgctgcaccctgytgggagtgactatctaacccaccctctacctcctttgtgccctaatccaattaaggacataaaaggtaaaattgatatcccttcacttcttcccaatttagggcctttcgatagaacacaaactttgagcccaaacaagagcttgaaccttggctcttccatttactaactgcctggcattgggcaagttacttcactctgctaagccttagatactggtctctatgcggagactccagacaggaggattgcaagggcagaacaggtatctcaaacagagataacctaattaaaacaattgtccttaactcttcctgcattaaggacttctttgagaatcagataaaaactatggattcctccttctagaaaaattcatacatgtaatatttttcatataattccaggaagcttatggtctggtccatctaaagtctccacatgtacccctaaacataagaacccctgattaaagactctggcatggctcctggtataaaatgggtgcttaaaaataattgctgggacaccatycaccatctgattattgcccagttctggactcagccatgttgcaagctataaccgtttttgccccctggactagggacaccctgctgttcttcccccactgagtctgggtgctagggagataaagttaaaaaaaaaaaaaaaawtttttttggctttctcaaaaaaaagagcaattattagagcacttmtgctctaattatgctctttctcacctagagaaagctgtcattctaaggaaaaaagggaaagatgtaagaaataataattcatgccacacatacatacataaacatacattacagacttcctcagggaaaaatatttaaactttacacttctgttttcacaccgagagttgaagatataccaacacataggtccttctagaccctgcccactcagatttcagagagkcccaaacgggttttcatctcactggtggctgcataaacctccagccatcttaagaagccacagaaaactggctcagagaaagatgttatttgttttgcgctgggtttcatccagctgagctgctagtctggagcccagagaccagggaatattgccccacactgagttacggtgcttaccaatgagatttttctccctaataatccttccttattgtctctgctaacacagatgaaagtctaagatgtatggctgctactgtggctttgccaatgaagtgtgtatgttctgtaggcaggtgcttactgcattccaactctaatacagtgtagcagtgaacacggtgttcgaagagcaaaacatcttccccattttcatcaaacttaatggggaaaaaaatcactgtcaagactcttaggtttaaggcttttcttgatcacagttcttggtttattaaggaaagtttgttagcttttagcaggtactttatgaacatcaaagcaatgtctcatttaatctgcaaaaatgtagcttaatttttaaagggggcattttgtggatgaaactgagatttcaccccaagttccgtgacttaacctgtactatgaggacttgaaatgcagtaaggcagactttcatccatgtattcatatagtccattggacagatattcattaagtgttgccattttatgttgctgacattaagttccatgtcacctggacactggtaaagttttaggagaaatataagtggtggcctctacccctggagaatttacagttttcctgggaagagcaaatggrcatgcactgaaaaggaaaattactttcaaagctgtaaggacattaggaggggccaacaattggcccaaaaagagctgattgttttgaagatggaaagtaccctcccctttttgctcttagtaaataagcacagctttcatgagtttcaagaggaagtattgaggaggagagaaagagagatgctttgagtaaactgccaccatcagttcctaaaatcatggtattccagagtagaaagagatcttagaaaggaacctcattttgtagatgagaaaactaaggctctgaggacttaaatgacctaattagtgaatgacagaggcatggctcaaactgagggttcctgaacccaggcatgatgtttttctctatgccatatgaaaaggattctttttaaagtatattttatatatatatatatatatatatatatatatataaatatgtgtgtgtgtgtgtatatatatatgtacacacacacacatatgtaatctcaagttcatcattgttttctctatacaatggtctttgtcagtcagacagaaagactgaaggtatgtttttcaagtagactcaggcaccatcatgacttattaattcaccagccctaacaagtgccttacaaggtgccaggcacgtagtagggctgttgcagaatgctgttgaaatgaccatccatttcaagagcaatactcctgggctgctgcttccattccaacaagtgctctggagaaaaaggtgggagctggccttgggagtgtaaattgcagttcctcaggagatgcaggaagaggggaaaagggatctgctgcttttccaagagaatctgggatcatcccaccactaagttcagcaggttcttggctctttatttgtccagcagaaatgataagccactatatatttcccattttagtcacttttagcattaactgggaactctgatgacttcagcgctgattccttgtaagattctgaatgatgaagcatcgcatagcaacattctcctccctgctttatctaggtcctacttaggcataaaaatccaaaccacaaagcaaattaactcaccaacttcacaactgcatcttttgcttcatagaaaagggtccttttaartaagaaattcccgtggtgtttatctgtgtggacaataacagagtgcctcattctgaagactgttactagagctaaatgaaaaatggactgaaatgtatttagcacagaacttggcatagtaaatgctaaaattcacttttttaaaaaagtgtctttatgatatagtttaacttatctacaaatgtgtaggtacccagtgatctaaagtgagaaacccctgaacttggtatgcctgcttcttcttactgaccttattatttcaggcatcaaatacctgtattaagtttgaaattcagactcaccttgacagggactcctctataggaaaaataatgttaaaaggcaacaatagtaatgcctatcttacatatacgcatacatgtgcacacacatgcatacccacctcttcctcttgccttgacacagccctgtgctttaacctgcctgatccaccctctgccttctcacagatcccccccaagtccccacacagttggaagacatcagggccttgctcgctgccactggaccgaaccttccttcagtgctgacgtctcctctgggaacacagctggtcctggatcctgggaattctgctctccttggtgagtctaaccctyggaaacattgggcagaaagccaggactggacaggatttatggatgggtgactgtttgcaggtgggaaggaggcagcagtcgggggtggccaacaggraatcactaaattgcctacagaatccagactcaccagtggaaacttggctgactttccatatgaggtgaatgcagttgttagtctggactctgtggcttgtctagattccaatatggctcctttctgaatcctcttgggttgatgccatagtccagatcctctcaatcagattgactcttgaaactttgagaaagttacagcagtaaagaacagctcctatatctcctctcctcttgctaaccattccccagtactcctccatgatcccctgccacctaaactagagcaataatcaactttcgaggagaaagtcaaatatcagcaccctccaaaaggaagactatactatttagaccagctttctgtagatatagcctaaagccaacccagatagactcctcaaggcaagtgctgaactaatttcactaagtacaacctccctgtcatctagtgttggaaaccttcaccaagttatttcccacatgggtagtgccctctggtagcaaggagttgtacgagggcattcaagtcctgggcccccacacgagaatcatgaagatgccggaaaaaccttcacacatgacctctggagacggacaaggtggaagagaagaattcttctgccttcaaaaggcctggtgggggggtggggaaataggcctatacatgtgcagggacagggaatatatgagaagtttctgtaccttcctcttgtgctgtgaacctaagatctaaaactcctctttaaaataaaacaaaaagccaaagcctacaaagtggggaaaatcttcatactaagtctatgtgatcccaaatgttgacaataacagctagaattattcctgtggctcaaagtttaaagcttctgtattcttttacccaccaactagcaaggaacaggaggccagtgggttcccagtcgtattggtgatgayttatcaacatggccacaggggcctggtatctttaggattagagcacagaaacatgaccctcaattttcgttttcatctgaaacttgcaaagaatcttcacagcttatcagcatatggaaaaatctgatttctctatttttgacttgagtaaaaataagacacagggaaagtaacaagtagccctattctgttgcccatgatttatacaagtttggcactgagtttttctatatcttgttgatcagaattaatagaagcttcaaattgcatattgcctttggcttacaaatagtaaactgactcccagtgaaatgtgcrttgtgaacttctttattttagaatyactatgagaaactctcataactgttcatcacagcctggtcacaagcagggtggcagcaattgtttattttcaagttcartaactcttttgggtcactcaggtgccatttagcatgctggaaaagttagcctgttcatattttttcatgatagctttactttcagtctcccttattctggaataatattttgtttcattttagccatgggcaataagaatttattgtactttatgttgccacattccattgctagtttgtggtgctttgttaccttaggctggtatttaaatccagcagttaagagacaccttaaattcccagtccacatccagactgctccatttgaatgagacagtgagtcagtattcataaagtccctgaatgtaactgcctggaccaaatgaacttgaatggtgaatgtcagtgtcacgccagcactatagaactaggagactcacatggaattgtggagatgaatgagaaaatgatgtcaagtatcaggactctgagaagtaggttgagacagscagagcctcattatgatgctttggagctgagcactgcagaatgggtgggattcaaataggcagaaaggaagagaaatgggcactcaaggtgaggaagattccatgagccccaagatgaaaaatgtgcaagatatgtatcagatgtctgttcagaaacaactgtaaaacaccattgctttaagactgatgacaggcagctaaactgggatagaaactaggccatcaaaacgaacaagcctcagccacagcttgtccattcagatttggctcagaccctcaccccaacaatcctaatgccctccttccatcctgaacttccccagctagtacctcatcctggtcttagtccagtggctcccatctggacaagctcccatccctgactcctataggtggccctttcagaccacagtgtgcgctctgggtatgagaaataagccagggaggctggagaggaggttttgygtagggttgctgagaaattaacatcaaactgtggaagccatgaatataaaacaaaggaagtagatgtactacctggggaacgggaacaaatctttcgagggtttttaaataggagaatgacatactaaaagtaatgtatgagaagaattaatctggtattctgtaggaataatcgatagtgggagagatttaatgaagaaaccctattttgaggataacagaattctagaccaaggtggaaatacatggcaaagatactgttaatcactcctcccacagccaagacatccctagtcagtcrtgacattctttttcactcagctcaggcactgccttggaattcattttaatgttcttaccaagcctggtggtagttgatatatacaggatgaaagccattcaccagccttgttgtagccagtgagtggtgagatgccagccactgtatgtttcctctatgtacgaggtcagctggctgtaacagccttacagaacttcatggttctgtggcacaggaacagtaactcatagaccctgattttcatgtttcccagcagtaaggggggaaaggagagttggagttttttaagccatgtgtcagagctcattcttcttcattaagtctggagtgttgagatccccagtaggtgagactrttccagaactggctgttttagttatcggacaccctggtattgatttcacctcaagccactgctacaactctccaaagggaatgttgcctgagcaacacatgcacaggcccacctgggcctcacttttccataactataaaaatgaaaccttgggactagcaagtgcttgttgctctcatactcttgaccacatggcttagacatagaaatgcccagtagagggttgaatgatatttctgtctttaggtctttgaggaattgaccactgtcttccacaatggttgaactaatttacactcccaccaacagtgcataagcatttcattttctccacaaccttgccagcatctgttgttttttgactttttattaatagccattctaactggtgtgagatggtatctcattgtggttttgatttgcgtttctctaataatcagtgacgttgagtttttttcatgtgattgttggacgcatgtatatcttcttttgaaaagcgtatgttcacatctttgcccactttttaatgcaaytgtgtttttttgtaaatttaagttccttatagatgctggatgttagacatttgtcagatgtatactttgcaaaaattttctcccattctgtaggttgtgtttcctctgttgatagtttcttttgttgtgcagacgctctttaattagatcttgtttgccagtttttgcttctgttgcaattgcttttggtgtcttcatcatgaaacctttgcccatgcctatgttctgaatggcaatgccgaggttgtcttctagggtttttacagtcttgggttttacatttaagtcttcaatccatcttgagttaatttttgtatatggagtaaggaagggactcagttttaatcttctctatatggctagccagttatcccagcaccatttattaaatagggaatccttcccccatttcttgtttttgtcagtttatcgaagattagatggtagtaggtatatggccttatttctgggttctctattctgttccaytggcctatgtgtctgtttttgtaccagcaccatgttttttggtgaccatagccctgtaatatactttgaagttgggtagcgtgatgcctccagctttgttctttttgcttaggattgctttggctattagggctttttttgggttccatatgaatttttaaatagtttttcctagttctgtgaaaaatgtcgttgatagtttaataggaataacattgaatctgtaagttgctttaggcagtatgaccattttaacaatgttgattcttcttatcgatgagcatggaatgtttttctatttgtttgtgtcatctctaatttcttkcagcagtgttttgcagttctctttgtggagatctttcaccttctttgttattcatttataagatacaaatacttctttatacgtttgacccatatttgacaatctggtagttgatattcaatatataatacatatttaaagtttaaaatatgatgttttgatatatgtatacacctgtgaaatcatcaccacaatcaatataatgaacatattttatcagcccccaaagttacctcatatccctttgtaattgttccctcatacccctacccccaccactactgctcccaccctaggtgaacactgatctgatttatgtcggggtaaactagactgcactttatagaatggtatagaaaaggactaatgcctttgrgatattttatttctttcactcagaataattactttgacattcatccatattgtaacatggatcaacagggcatttctattgctaattagtatttcattgtatatactacagtttgtttaatcagtcacctgttcagagacggaatcgttattttcagtttctggttattacaaatctgctgtgaaattcatgtacattaatctttgtatgcacacatagtttcatttctcttggttaaacacctaggagtgaaatgacttgctcgwatcataggtatatatttaacattttaagaaacagccaaactgttttccaaagtagttgtactactttacattcccgccagcagtgtaagaaagttctgagttctccttgtcctcaccaaagcttactgtagttggtcttttgcattttggacattttactgtgtgtgtagtggtttctcattgtggttttaatttgcattcccttaattactagtagtgttgaacatgtattcatgtgtttatttgccatcctgatttcttctttggtaaaatgtctgctcarttttttggacctttatttaaamattgagttgtttacttatatcaaattttcagtgttttaatatattttgaatrtaagtcttttaatgagatatgtaatttcccaatactttgtcccagtcagcagctatattttcattctcttaacagtgtcttacaaagagtagaagattttgattttgatgaggctcaacttacccttttcttaattttttaaaataatttcaacttttattttagattcaggaggtacacgtgcaggtgtgttacatgggtatatttccyaatgctgagatttgaggtatgattgatcccatcacccagatactgaatatagtacccaatagtttttcagctcttgccctgttcctttcctctctcattagtagtccccagtgtctactgttgccatttttatgtccatgagtacccaatgtttagttcctgcttctaagtgagaacatgtggtatttggttttctgttcctgcattatcctgcttaggataatggcctccagctgcatccatgttgctgcaaaggacatgatttcattctctttatggctgcatagtatcctatggtatatatgtaccatattttatttatccaatccactgttgatgggcacctaggttgattccatgtctttgctactgtgaatagtgctgcaatgaacacacaaatgcacgtgtctttttggtagaatgatttattttcttttgaatacatatccagtaatgggactgctggattgaatgatcgttgtgttttaagttctttgagaaatatccaaactgctttccacagcggctaaactaatttacagtcccaccatcagtacaaaagcattcccttttctctgcagcatcaccagcatctgttgttttttgatgcttaaattgtagccattttgaccagtctgaaatggtatctcattgtcttcttttgagaaatgtctgttcctgtcttttgccaatttttaatggggttagttgttttttgcttgctcagtttaagttccttatgtattctgaatattagacctctgttggatacatagtttttgaatattttctcccattctgtaggttgtctgtttactctgttgatagttgcttttgctgtgcagaagctctttagtttgattaggtccaacttgtcaattttttgctttgtttcaattacttttgagaactgttttggttactgtagccctgtagtatagtttgaagttgggtggcatgatgcttctatctttgttctttttatttaggatcactttggctattcaggctcttttttggttgcatatgaattttagaatagttttttctaattctgtgaaaaatgakgttgatagtttgataataatagcattaaatctgtagattgccttgggcagtatggccatactaatgatattggttcttctaatccataagcacggaatgcttttccatttatggatgtcatctatgatttctttcagcattgtgtttcatagttctccttgtggagatctttaaccttcttggtcagatatattcctagatattttatttttgtgtatttttgtgttgctattgtaaatggcattgcattcttgatttggccctcagcttgaaggttattgayatayagaaatgttactgattttgtacattgattctgtatcctgaaactttactgaagtcatttaycaattccaggagccttttggaagtctttagggttttctagatrtataatcatatagtcartgaagagagatagtttgacttattttcttattgggatgccttttatttctttctcttgcctgatggctctcactaagactttccatttattcttttagggctcattcttttagcattgtatttaagaaatctttgcctacttctgtctcaaagacgttctcatattttcttctagaagtttcataattctaagttttaagttaatttatctttagttagttttgtatatgatataagctatatattgaagtttgtttttatacatatggacatctaacttatccactacaatttgctgaaaatattatcctttctccactgagttgcctttgcatctttctggaaaatcaattgttcttatatacgtgggtatatttctagatctctattctatttcattgttatgtttgtctcttataccacattctacttaatgccctataaatcataaggtctggcttgtggaaacagatactattccctaccctgtgtgagcctcagacactggtacttctaattcttttaagtggttcttcccctacttcacacacatgccaccaatacgcattctgcgccatactcaaggggatcctctgcagatttacaaaaaccacgtgtttttataagtacagttttactgtaacagagccacacccattaatttacccaagtgttctgtggctgctttcatattacaacagcagaattgagtacgtgtgacaggcaccatgtggcccaaaaacctaaattatttcctatctgcccctttacagaaaatgtttgccaacccctgatccggtccctctaccttattattggaaaggacaccaaggtcttatgggagtcgtgacatattccctgtttctaaggatcacatctttcctactgtatctctgtgtccttcatcctgtcactggcttaggcctccatgagrtcaaagaccctaaaagatgcactatattagcctgttttcatgctgctgttttcttcccgagactgggaagaagaagaggtttaatggacttacagttccacatggctggggaggcctcacaatcatggcagaaggcaaggagaagcaagtcacgtcttacatggatggtggcaggcaaagagaragcttatgcagggaaaactctcatttttaaaaccatcagatctcatgagactcattcattatcacaagaacagcatgggaaagacctgcccccatgattcagtcacctcccagcaggtttctcccatgacatgtgggaattgcaggaggtataattcaaatgagatttgggtggggacacagccaaaccatattacacacacacacacacacacacacacacacacacacacacamgcaaaaacctagaggagtagaaattgtcctcaggaaggtagggaaagagagaaaagctctaaagagcctggagtttcctcagaattagatagcctcaggtggctccagtttaaaaataaataaataaataaataaataamtaggctgggcatggtgattcacacctgtaatcccaatgttttgggaggctgagatgggaggattgcttgaggtcaagcatttaagaccagcctgggcaacacagcaagaccttatcactacaaaamtttttttaaaatataactaggcatggtggtgcaggcctgtagtccaagctgcttgggaggctgaggtgtagtcctagctgcttgggaggctgaggtgggaggatcacatgagccctggagggaggctgcaagtgagctataatctgcaagtgagctataatcgcaccactacactgcagcctgggcaacaagtgagatcctgtctctttttttaaaaaaaaaaaaaaacctaaaatatgtaattacatgtggcttaataaaaacagtgcctttttccagcatcttacttaggtgctgttcaagtatctttcagcatacatttggcccaccccctctttttagcagcacactctcctttttttttttaattttattattattatactttaagttttagggtacatgtgcacaatgtgcaggttacttacatatgtatacatgtgccatgctggtgtgctgcacccattaactcgtcatttagcattaggtatatctcctaatgctatccctccccctccccccaccccacaacagtccccagagtgtaatgttccccttcctgtgtacatgtgttctcattgttcaattcccacctatgagtgagaacatgcggtgtttgkttttttgtctttacaatagtttactgagaatgatgatttccaatttcatgcatgtccctacaaaggacatgaactcatcattttttatggctgcatagtattccatggtgtatatgtgccacattttcttaatccagtctatcgttgttggacatgtggcttggttccatgtctttgctattgtgaatagtgccgcaataaacatatgtgtgcgtgtgtctttatagcagcatgatttatagtcctttgggtatatacccagtaatgggatggctgggtcaaatggtatttctagttctagatccttgaggaatggccacactgccttccacaatggatgaactagtttacagtcccaccaacagtgtaaaagtgttcctatttctccacatcctctccagcacctgttgtttcctgactttttaatgattgccattcctaactggtgtgaggtggtatctcattgtggttttgatttgcatttctctgatggccagtgatggtgagcattttttcatgtgttttttggctgcataaatgtcttcttttgagaagtgtctgttcatgtccttcgcccacttttggatggggttctttgtttttttcttgtaaatttgtttgagttcattgtagattctggatattagccctttgtcagatgagtaggttgcgaaaattttctcccattttgtaggttgcctgttcaatctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtgtcagctttctacatatggctagccagttttcccagcaccatttattaaatagggaatcctttccccattgcttgtttttctcaggtttgtcaaagatcagatagttgtagatctatggcattatttctgaggactctgttctgttccattgatctatatctctgttttggtaccagtaccatggtgttttggttactgtagccttctggtatagtttgaagtcaggtagtgtgatgcctccagctttgttcttttggcttagggttgacttcgcgatgtgggctcttttttggttccatatgaactttaaagtagttttttccaattctgtgaagaaagtcattggtagcttgatggggatggcattgaatctataaattacctttggcagtatggacattttcatgatattgattcttcttacccatgagcatggaatgttcttccatttgtttgtatcctcttttatttcgttgagcagtggtttgtagttctccttgaagaggtccttcacatcccttgtaagttggattcctaggtattttattctctttgaagcaattgtgaatgggagttcactcatgatttggctctctgtttgtctgtttttggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaatamcctttatttccttctcctgccgaattgccctggccagaacttccaacactatgttgaataggagtggtgagagagggcatccctgtcttgtgcsagttttcaaagggaatgcttccagtttttgcccattcagtatgatattggctgtgggtttgtcatagttagttcttattattttgagatacatcccattaatacctaatttattgagagtttttagcatgaagggttgttgaattttgtcaaaggccttttctgcatctattgagataatcatgtggtttttgtctttggttctgtttatatgctggattacatttattgatttgcrtatattgaaccagacttgcatcccaaggatgaagcccacttgatcatggtggataagctttttgatgtgctgctggattcggtttgccagtattttattgaggatttttgcatcaatgttcatcaaggatattggtctaaaattctctcttttggttgtgtctctgcccggctttggtatcaggrtgatgctggcctcataaaatgagttagggaggatttcctctttttctattgattggaatagtttcagaaggaatggtaccagttccttcttgtacctctggtagaattcggctgtgaatccatctgatcctggactctttttggttggtaagctattgattattgtcacaatttcagttcctgttattggtctattcagagattcaacttcttcctgstttagtcttgggagggtgtatgtgtcgaggaatttatccatttcttctagattttctagtttatttgcgtagaggtgtttgtagtactctctgatggtactttgtatttctgtgggatcagtggtgatatcccctttatcattttttattgcstctatttgattcttctctcttttcttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgcgggcatttagtgctataaatttccctctagtcactgctttgaatgtgttcaagagattctggtatgttgtgtctttgttctcgttggtttcaaagaacatctttctttctgccttcatttcgttatgtacccagtagtcattcaggagcaggttgttcagtttccatgtagttgagcagttttgagtgagtttcttaatcctgagttctagtttgattgcactgtggtctgagggacagtttgttayaatttctgttcttttacatttgctgaggagagctttacttccaagtatgtggtcaattttggaataggtgtggtgtggtgctgaaaaaaatgtatactctgttgatttggggtggagagttctgtagacatctattaggtccgcttggtgcagagctgagttcaattcctgggtatccttattaactttctgtcttgttgatctgtctaatgttgacagtggggcgttaaagtctcccattattgtgtgggagtctaagtctctttgtaggtaactcaggacttgctttatgaatctgggtgctcccatattgggtgcatatatatttaggatagttagctcttcttgttgaattgatccctttaccattatgtaatgaccttcttggtctcttttgatctttgttggtttgaagtctgttttatcagagactaggattgcaacccctgccttttttgttttccatttgcttggtagatcttcctccatccttttattttgagcctatgcatgtctctgcrcgtgagatgggtttcctgaatacagcacactgatgggtcttgactctttatccaatttgccagtctttgtcttttaattggagcatttagtccattgacatttaaagttaatattgttatgtgtgaatctgatcctgtcattatgatgttagctggttattttgctcgttagttgatgcagtttcttcctagcctcaatggtctttacaatttggcatgattttgcagtggctggtaccggttgttcctttccatgtttagtgcttccttcaggagctcttttagggcaggcctggtggtgacaaaatctctcagcatttgcttgtctgtaaaatattttatttctccttcacttatgaagcttagtttgcctggatattaaattctgggttgaaaattcttttctttaagaatgttgaatattggtcccccctctcttctggcttgtagagtttctgckgagagatccgctgttagtctgatgggcttccctttgtgggtaacccgacstttctctctggctgcgtttaacattttttccttcatttcaactttggtgaatctgacaattatgtgtcttggagttgctcttctcgaggagtatctttgtggtgttctctgtatttcctgaatctgaatgttgccctgccttgctrgattggggaagttctcctggataatatcctgcagagtgttttccarcttggttccattctccccatcactttcaggtacaccaatcagacgtagatgtggtcttttcacatagtcccatatttcttggaggctttgttcatttctttttattcttttttctctaaacttcccttctcacttcatttcattcatttgatcttcaatcactgataccctttcttccagttgatcacatcagctcctgaggcttctgcattcttcacgtagttcttgagccttggctttcagctccatcagctcctttaagcacttctctgtattggttattctagttatacattcgtgtaaatttttttcaaagttttcaacttctttgcctttggtttgaatttcctcctgtagctcrgagtagtttgatcgtctgaagacttcttctctcaacttgtcaaagtcattctccgtccagctttgttccattcctggtgaggagctgtgttcctttggatgaggagaggtgctctgttttttagagtttccagtttttatgctctgttttttccctatctttgtggttttatctacttttggtctttgatgatggtgatgtacagatgggtttttggtgtggatgtcttttctgtttgttagttttccttctaacagacaggaccctcagctgcaggtctgttggagtttgctagaggtccactccagaccctgtttgcctaggtaccagcagcggtggctgcagaacagtggattttcatgaaccgcgaatgctgctgtctgatcgttcctctgaaagttttgtctcagaggagtacccggccgtgtaaggtgtcagtctgcccctactggggggtgcctcccagttaggctgctcgggggtcaggggtcagggacccacttgagaaggcagtctgcccattctcagatctccagctgcatgctgggagaaccactgctctcttcaatgctgtcagacagggacacttaagtctgcagaggttactgctgtctttttgtttgtctgtgccctgtccccagaggtggagcctacagaggcaggcaggcctccttgagctgtggtgggctccamccagttcgagcttcctggctgctttgtttacctaagcaagcctgggcaatggcgggcgcccctcccccagccttgctgccgcattgcagtttgatctcagactgccatgctagcaatcagcaagactctgtgggcataggaccctccgagccakgtgcgggatataatctcctggtgygccgttttttaagcctgtcggaaaagcrcagtatttgggtgggagtgacccgattttccaggtgccgtctgtcacccctttctttgactaagaaagggaactccctgaccccttgcgcttcccgagtgaggcaatgcctcgccctgcttcggctcatgcacggtgcactgcacccactgtcctgcacccactgtctggcactccctagtgagatgaacccggtacctcagatggaaatgcagaaatcacccgtcttctgcattgctcaccctgggagctgtagaccggagctgttcctattcggccatcttggctcaagtgtcggcagcacactctccttagtgagcaagctcccatgcctccttcagaggaactcctcacaaatctccattggaggcacrtgtcagccccacagaaagcaaacagcaccagccttttctcatgccttgtgatttaccaagaggaggaagatgtgggcagtcattccaacctgagtgtacagagtgaagactttccatgaaagaattcattgtgcctggtgcttctccctggtgggaggctcaagggggcacagccaacacacatggtggcaccaacatgctcaccagggccacaggcccatcataggcagggcctgcacatgtagcagctccacttcttagagcccttccagccatgcaaagcctggcagtgaggccacagctcacacattgcagttgggcagtggtattctgaccacccaagacaggcagcttatgcatttttttctctgcttattcctctgctgagaattgcagaacccagctggcatgagatgcagttcagacatccctgctaagagcrgcaaggctcttgttgaccctaaatctcatgcaaaaaggtgaaggaattacttctttctccaacactgaggttaagactgggacamtataatataatatcacgctggtatgaaaactgtgtttggaatacaggacccaggcctggagtctaaaggcagagctcacagtgttcacatgtaaccctctcaaagtaggagcgtatatgagaaaacagttgaataaatattaatatccaaagttgaaattcatgataaagggcctaggaaagcactgtctcaaagatagttccatttacttattcaagaagtatttaccaagtgcctaatatgtgccaaacagtgtactgtgagccaaggacacacagtaaataagataaatacaaacctagtcctcattcatttattcaaaaagaagtattgagcatctatttactataccaggcactgttctaggtactgaggacacagtaataagccaaacaaattgatgtttgtagtcctttgcagtgtgattccagtggrggcacttagagtctgatgggaaagttcaagtaagaaaagcacgatggaaatggcaagagctgggggcttttcaggtctcagcttggccaagattgctttgagaaaccaatgtttgagcaagactggaagactggatagaggttacccaggtgaggagaggggacgagcgcttcaggtagaggagccggcagaggttataaagaatgaaaatagaaaacctttcaagaacctttttgstcagaggtaagggggagtggccttagacaaggttaaagagggaggtggagcaaattgctggtgctctgtaagatatttacactttgccctaagtgcaatgggaagtcttaaacagcttaaaaacaagagagagaggttgtctaacttgcgtttttaaaagcttattctgactggtgtgtagaggatggttttttaggggaagaggctagatagagtcccctgtttaggaaattgttgcagtattccaggtaaccatagattactgtggcataaagtacagaggtggaaaaaaatggacagaagtagatgaattcagggatctgtaagaggtaacttcaacgggacttggtaaatagattaacatgagaagggaaacatcagccatagaatgaacagagtctcaaagacatcagatttggggggtttttctcactgaaactctcatgtacctcctagtggtggtgacacatcccagaccactcaagccaagatgttagaataaattgagagctacatgggtgtgtaatgcagaatgtgtagttataaggaggagaataccccaaagcttctgtttgctaagtcctgctcatttccttaacatctacctgctcaggctttattaaatgctaggtcctgtgcctttctcccagtttttgaacagctcagaagtgttaggacagacagaaaagtcaatcatgagtgtgagaaaagctctataggctgcacaggaaatcaaaaggaacaggagtggggactgctttctttgatgaaagggtaattggggtgggggtagggggcatttaacagaggaactgctcaagytcagcctcaaaggatgaggcaaagtattccatgcacygatacaacagacacacttactgagttccttccatgttttcagcaccattgaaggcagcagagacaaaacagacaaaagtccctcctctcatagaactgatgttatagtaggagaaatagaaaataaacgtatacagaagcaaatggcatcatatggtagaagtaataagtgctataaagaaaaataaagcaggataagagggagaggtggtgcctatgtgggaaggaggttccaatttaaaatacaacaggccagagagggctcactgagaaagcagttcttgagcaaagacatgaatgtgtgctcttgagccttcacatgtctggagagagaagagaggagaagagcatcccaggcacaggaagaatgagtgcggagttccgcctgcatgaaacgtgcatgcctagtgtgttccaggaacaacaaaaaggccagtgtggccacaatgaggtaacagagggagtacacagaaggagagaagatcagagaggcaaccaggcagagggcaagttgtgtaaggccttgtaaatggtcactttaaagcaacagtgagagaaaaatctataaatgctcacatttataaacagatgcaatattgcattgagcatcatgggcttttccagcattagacaggggcaggcagaagtgatttagtttattggaaaccatgtggccaactgaatgttatagagctgactctagtaaaacagaggcttatcaggctggctctggtacaagccratattgctgatttaatttggctcacatgtgctgggcacctgctcygtctgcctggccctgagcttctgcaggcatgtgcctggccatttccttcatctagtaagaggggatccccrttgcacagtagagtcagctgggaagtttagaaaaaaatattccaacagagaccaattaattcgagatctcaggatgggacaaggcatcagtacttttaaaaaatgattctcagggattgaggagattttacaagttacttctccgtcttctacaacccatgtataatagaagctggaatggaaatatggcgtgcttaatcatttagaatattttaatctgacattcaaggttctttgctattcagacctagcctttacatccatccttccatcctatttctctctcaggtaattcctttgttccagtcaaacctctccctcatacttgccatggccttgagcctcatgtaacttccatgcctggaataccctcccctaccccaccatatctatctaaatcctaaagattttcaaggcacagatcaggccctccatgcagcctcttggagcaccccagcctggaatgatcactctctgctgacttcctgaagcacctactctagmccagagttgggcaaacattttctgtaaagtgccagataggaaatagtttaggcattgttggctataaggcccctgttgcgggtattcaactctgcagttgaaaagtgaaagcagccatagaccataagtaaatgaatgggtatgtctgtgttccagaaaactttatttacagaaacaggactggattttgcactygggccattccctttgataatatcagcctatctcagataaacgaagcaagaaaaaggaaagagattttgccaactaatgaaccaaaactaatgaaaagagcatgaactttggaatcagagctgagctatggtcaaaccacataacctcaatgagtctgcctttctcatcaacctcagctctatgtcaccaatgtgatacttagcctatcacaccttayattattggacatatttcttacgtctgtcatgtctcccagctagatctaggtcctggggatagaagaggctrcataagtatttttaagtgatttaaaacaggactaggtggcagggccttgacttggaaggcctcttgaattgttttcatctctcatttctattctaattgtagctttatcatccgtcccacatacytccacccttcaccccacccgcacatttcctatagcctggatttttcttgtacagcctggatcgggcacttcctggatccaattatgtgataatgcaaacaatgacagttagtgaataccctgggccacagctgttgggaagccattttttatcataattgtttggaagactaagggcatcactacttcctctcttagcggtgggaacagcaagttctgatggtcaaaggttaggtaaaaattaatccacactgcagacccacccaacaggtggcaaggaaggtgatgccaaggaaggacagggatgycgggaaggggaggactggcccccttgaggagtgggaaaggaagacggagggaaagggaaggactcatgtcaaagagacacaagtcagcatctgtttcctcatttatactggaaggccgaggttttatgtcacaaggaaaatgcttttgatttcctaaagctttgcccacaaagagaaaatgctttgctattaagaagaaaggtcagcattttgtagttatttatggctcctgtttatatacttttgtatttttttaaataaaatccaaagtggagtatagagaccccatagggactgcagaaagctctatacatacagtgtaaaactaaattgtcatttcagagggcatttacaaggaagccacagaaaggaatacagcagttctttggactgaaatgcacatccataaatataaaaagacaccagagcataagtgacacttaaaatagttggacatggaaagcaaggcagtaaatstcactgcctagccactgttctaagccatagcgagcacccaggcatgggcttatttaaagacgctagataggaaatgaggaccttgagaaaacgcactcacacttgctcctgccctttcctggcagcaggacacaattcccaggcccmtgtgccctccctgccatgtccaacaggaatgatgtgaatgagtttcatgtccctgaaatagacagggattgaaagtccatcagtgggaaaacaaggaactctactctttccccaataaatccttcctcagccctgaaacagcccttgagaatatctactcttgctctgtgcccccttgtgtttggtggtgctataatggcagttttacagcactatcagagcccagaggctgactgtagaagagagggcaggattatggcctaaggccttgatgtgatctatgaagggagaggcagaccctactgccttggttccaagccaactttgtaggagacagaggacagggcacctcagtcagaaaagctgtttccaaatcctcagcatctgattsctcataaataaaggctcttggccctgcctgcttcttgaagtagagggatcgggtaagttaagatttcccttagggaccaggtcctggaagcagaaataaagaaggtaaattctagccccagtcaacctaccgttttattaacttactcattttatgctgtttttacttcctctctgtatttgctaattaatttaacttactttttaattgagttccctttgacaaaaccagccaatctcaggtaaattaagcaagaaaaaggaaagagtatctgcccacccagctcacagaactaattatagtaagggttaaatgagatgccatatgcaatgtgcccagtttagtgcttgctacaaagtagatgctaataattgctaatttttttttacctgttctcttccttgttgaaaaatctaagttcattctctttctcactgtggtctaccacaagttcttccataaattataggatcagaacttgatcaccattgtgagtgtaaattactgaccaaaaaatcattcaggagacaggtgccatatgggaagtttcattctatgccaagctctcgatgggagcagagatgtgcaaggtgtggcccctgacatcaagggacttcatatctagttagaaaagatcaacacagaagcaatggtgagaaagcagtatgagcaggtgagaaagggtaataaagagagtgctgaatacctgctctatgaatttatgatcgaggaggaaggttgtagtgctcccctggaaattctatttccatctagctgttagcagcagcaaatccatacaggtctgcagcaacttaattcttgcctccttagaggaattaattcattccaggagcataaggcagagtgagagactgaggcaaattttagagcagaagtgaaagtttcttaaaaattttcagagcaggaacaaaaggaagtaaagtacatgtggaagagggccaagccagcaacttaagagatccaagtgctctgttcagggttggcgtggggttttatacattggaatgatcccatggtttgtgtcctgtctcttctgattcttcccttggggtgggctgtrggcatgagcagtggcctgtcaacacttgggaagggccacgtgtatagtgtgtttactgaagttgtgggcatgctcacttgaggcgtttttcccttatcagtcaaactttcctagaggaagatcgtgtaccagttaaactccaccattttgcctcttagtgtacatggttgagcccactggcccagctcctgagattttatcaggaagctgctgatcaccagcttcaggtgttttctcctaggagactgcctttccctggcactggatgcaaccaattatcattttagagagacagtttaaccactgcctgaccatcacctaatggttgcstgacattgctgaaggggtgccctcttctgccttgctcgtgtctgcctaactacctactccaacaaatccatctaaccctatgctctctactggggtcctttacatgcaccttagagcttgcatagcactgtagttgggagcagcctccggagccagaatgcctggctctgccacttgctaataattgcatgaccttggrcaaattatggaagtcctctctgcctttgattgttaaaatggaggcaataactgcatatacctccagggtttttgaaaggaataaatgaggcagtatatgtaaagcacttagaatggtgccttcccacatagtaaatgctcagttaacatcagtcattcttattttggtagtacttgctcttgcccctggccactggaagtggaaaaatcaggaaagttaagaatgccctcagaagccagatcctggaagcaggaataaagaagaagaattcaggccccagtaaacctatcttctcattaacttgttcattttatgcagttcatatttcctttctctatttgttagttaatttaactttttagttgagttctctttgataatatcagcctatctccgaaaaattaatcaagaaaaaggaaaggactttcgcctactaaggaatcaaaactaatgaaaagagaatgaactttgaaatcagagttgcactatgatcaaaccacataaccttaatgagtctgcctttctcatcagtatagtgggttgataaactgaccctcaggactgatttgagaatcaaattagattaaatatataaaaacagtttgtaaactgtaaagtacgctataaaacctagttgttgccttattcctagggctagaagcaaagattgctggtaaggtaggatttctgggaccccatggagaaggcagatattcagggaagattctggaccacttgtgaagcctgcctttctagccaggagcagtttccttacttgttctttgctacacactgaaatatagatggtattgtttctttaaggaacctggaggttggggagatgctggctgtcctggagagtgctgttcataaaatgcaatgacctcatggcatctgagtagacttcatggggaaatgggacctaaacaacagatggggattagacaggccaagacaggaacataggtgagaattagacatctctccatgtgtgactgcccaacaggttgtttttgcctgctggccaggtkgagccaatttattaagacaggggcattgcagagccagctgaatgggataccagcgttttagtactcaaakcagttcccccaaaatttggagtctagggtttttcaaggatagtttggtgggttagggaatgggtacagctgattggttagggatgcaatcctagggttgtgggaaatggtccttgtgcatgctcagtccacttctgggtggggccacaggaccagttaacaggtccaagaggagtcattgatcatcagaaatgctggtaatcatttacatcttcaccttaggagaattcaggctcctctcatcctcctaaccttgtggtggtctttcattaactttgcaaaggcagtttagattcaggaagggctattatcatttaaactataaactacatgtctcccaaagttatcctggcccaagcccaagactgattaatggcagtttggaggcaaaaggcaagatacgggttggttagatcagatctctatcactgtcttaattttctcactgttataatttttgcaaaagcgatttcacatgaaggggaggaacaccaagcaaagagataagttcctgttctaagtccagtacttggcctgtggagtctacttgtattcactctctgtgtgtgtgtgtgtgtgtgtgtgtgtgtgcgcgtgcatgcaaatagttgattataatagaatcaaaatacacgcaggatttgtctccaagatattgtctaccactgttggaggtgggggggttgtaatctttcaccttttcatgtgccacatcctgctatgttttagaaaagtttgggaaagtggagttcagctaatattgtggaaattaagtgactctcatctcctataattagctacagtttttcctttcacaaagcaagagaatcactatgcagcttctgccttataatatctttttgtcttctagacaagagttttgaaatcatccctaacacacatatgcacgcacacacacacacaccccttcctctccttattgcccagtggtattggcattgatattgttaatacaaccgtaggttccctgaaaaaagcagctaatttgattgtactttgttcttgaaaggagaaaaagagaaaggtatggttttctttggggcaccagtttgtacatgattttcttaatttcaaaaatataccatacagatacacaagaaacttggaatactggttgcctgtgagaagaggaaccaggtagttgagggagatgggtgtgaggaagacttttcacagcatttcctcttggtaccttttaaattttgaatcaagtttatttcttgactattcaagaatagatgaatagaatggatgctagagatgtcggtagcagaggcaaggtgcaaaggagggaggagagagggcagagagaaagagctagagaaaacgaaagaaagagagtgaatagctgggctctagaaattaacataataagcctctgactcttggaaactggagagggtggaagaacatggaaaatgtcaatcaactctcaaacaattgttcagtgacatggaccatattatgactatcatcaatccataggaatcattaaatctattctcaaaatgcaatctaatattctccaaagaaatataaaattattgacgaaggttataattgtaaattattttgatcagattgaattacccctccccattttccagggtaagtctcagggtgaggtcttcagaaatagtcatgccactgatgcctctttgagtgggaacctaaagtgaattaggattgggaacctatattcttttgcacttctactctgtgccaagaattctgatatcttgaccatcacagagcttacagatttgggttttccattccacagagcctcagaaacacgaggctaacagcttggaaaacaacttccctttgctggtagaaagaaggccggggaaaataagccagaatcacatcttggcacgaataaaatcccagtaaggaacacactggtatagttggacttggggtttttgtgtaactgttttcatgagcattctgggagaaacattttgccagaacatccctgtgctagggttataggtaacattcctgaaaatagaaaaggattcttgctctttttgaaaaattgtatagtttaaaaaggattttgctgaccatctgctgttctctacccatgagaacctatcaaagcaaatcttacaaaatagatcaggccagaggtagggtaggccmaaggagaaaatgatgataacaataattgtattcgtgttctagaaacataacctagtaatatgtctatatctgtttaagagttcgaactcttttatccttcaccttcaatattttatctctgaaaggatgtagaaagaccagtttagctcataaaacatcattctatcaggaatctttttatgtgaaaatccattatgattatggaattcttcgtttctctgttggcagtgcctgctcaaaaataatgagctccctgtacattttgtttccaaggagataagaccaaaaattcattcaacgccctgtctagaacctggcagggaccattgtgtgtaatgtgtgactctttgaagtggtatcaagagagataaaccagcacaagcctgtgtgtctgatgtcctgccagcttcctgagcccagaaaaagaatttaggcacagaagaaaatgaccatggcactcttacatgcacagtaaaaactgcacctcctcttaattcttctccttgtaatcctgttgttctctacattaatgaactttcctggcatctcagattcttactgaaaggcatgttcagaaactggttcatgatagttcgtaaaacaaataccagggagataggaccatgagattttaatgaagagcttctgctaagcacactgaaatgatgccaaaaatggtataactgccgagataaaaatattataaaaagttaaattggaggaaaagtgaaggaaaacaatgcttttgttaagcaatcattactttttttcaggatctaaacatcttttatacaaaccttgattatgaaatgatggtttttggttcattcatatataagtattgcttattcagatgataataattggctaactaaacttaattttaaagaacttttagttttttagtcttattgttgacatagcaatgataaactggttgttgccaaatgataagaaggatttttttttttttttttttttgagacggagtctcgctctgtcgcccaggctagagtgcagtggcacagtctcagctcactgcaacctccatctcccaggttcaagcgattcttgtgcctcagcctcctgagtagctggggttacaggcttgtaaccctggctaatttttgtatttttagtagacacagggtttcatcgtgttggccaagctggtcttgaactactggcctcaagcaatcctcctgcctccgcctcccaaagtgctgggattacagacgtgagccagtgtgcctggcccaagaaggatttttttttaatttgagaagaaatcagcattcaaataaaacaaacttactgcgttacagactttgagttgtctgtagtatttaatggatagacaagacacttattttcagagcaaaarctggttggagaaagggggaaaattgttcaaatgtcatgcaacacattcaaagaactgtagaacaaccccgttttctgagccatcggcaatttcaccttggatgctcatgtttatcactttcccggtcctccaaatcctgaggtctcagtggatagagcaggttttttttcctttcttttcacatgttctacttcttggtttgagacacgagtttcaagacgtggtttgagacttggtttctttcttctttaatatacttttgttttgaaataacttcaattttacaaaagagttgaaagtggaatacaaagaactttttckacctcatccattcgggagtaagttgctgacataatacctcattgcccagtgcatattccttcaaggtttctcagttatcccaataatgtctttagtagcaagagaattcctccccaaatcacacattgcatttagttgtcatgtcccttctgtttcttcaaacgaaaacagttcctcgggcttccctcaatttttatgaccttaacgcttctgaagatgataggcctattattttgaaatatgtccctcagattggatgtgcctgatgtttccacatgattagatgagtctttgttgtgagactttggcaagaacatcacagaagtgatgctgggctcttcttatcacacccaatcacatgattatgatttcctttataccatgactgctgatgctaatgccagtctcttgattaaagtggtatcttctgaccttttccattgcagaagttaagttccaaagttttcctttggaattaatacktcttttgtgaggaggtcccctgggactgtggcaaatatctcattcctcattgaacttacctgcatgaacttgtggcctcctgtcttatccaatgggctataatctatgctatcctaacttcttttattttaaagtaaaacattccscagatgcagccaatgtgactttaagawgactcatatcttttgacacgttcatatcattctttaagaacttcattactttctggcacaagaagatattctaggttcatcttgaactttccctgctccagccctagagaatagtatttagacaccaagatttcaacatcaagtaagttcattgctactgatgtgtcactgctctcagtacccagaagttaaaaaaaaaatgcatatatctgtgcatgtatagccatatacacacacactaatataatcatttctatattaatctatacattgagtcatgagtcctcccttgtatgtccaactcttacccaacaccacaggatttattcttttttcttcttccatatttgtaattctctggcacccactatcattaacacactttcttatgcgatcaagccctccatataaacagcctcctaccattgctgcccccacccccacacagatgctgtcctcgcctcactcaggttctacatccctcctcaggtcaccactgcacccctggyttagatgcccttttcactctgttcagcctcaacatcccatcctggactaccacggctccctgtctccctatgaacattgatgaacattgtcttctttagccttgcstaatgggtttcgactgaaccatttaagaaaagaaagcaaaagtatgaggaattgctgaggatttctgaacagaaaccctattgtttccaggcttagaagctagtcggtgaaatgggtagagaacaagaggagtaggtgctgggcaatgcccagcctctgtgctccacggtgcaggaaggatctgcttggccagatccctgattattgccttcctggccaggcacttgcttacgtcaaatcttacctatctgccaggctgggacatgatctcaggtcttacctttgtgactttgaataagagaatgctgtcattggtaccccttccactcccgctttctggttcaggggtatttaacctggggtccacaagctttgggaactccataagccctctaatatatgtgcaaatatgcttttctctggtgaaagaatccagaactttattsagtttcttaatagatgcattacccagyaacattaactacttgctctacatcaaaaggttgacaacaaattcggtcttaccaataattaaagaaaagcaaataaaatgaaatactatttgccataaataggttggtgaagatgaaaaagtttgtgaaatctgtattaacttgattgcagctgtaacaaattaccatagatttagtggcttaaaacaagacacatttactctgttacagttctggaggtcagaagtccaaaacagatcttactgggctaaaatcaagattgaccaagatgtttccttctggaggctctacggggaaatrtattcgtcttttccagctcctcaaagycacctgcatcccttggctgtggcccttctcccatctgcaagaatggcagcatagcatcttcacatttctctctgactcgctatcttccccattataaggccccttttgatgacatgaggcctacttgcataatcgaggataatcccccatctcagtattctttcttaatcacatttgcaaagtcccttttgtcatgtgaggtagcatattcataggtttcrgggattagggtgtggatttctttaggggggcagttattctgcctatcagaagatcaaagaattaaataatatatactatcatgcattgttgcccaaaacgtaaattaggataacatttctgaagggcaatttagcaatgtatatcagtattttcaaatgatacctactgagctatcagtgctacttcagtcatgtaacctagggaaatatttggtcacagagatgtatgtactaggaaattcaccacagcgtagtttatattagtgaaaaattggaaacatgtaattatctataaagagttgattaaagattcttttttttgcttcataatggtgctgattttttttttatttcaatatcttttggggtacaagtggtttttttgttacatggatgaatgaattacatagtggtgaatcctgagattttagtgcacccatcacccatttaaagaatgaggtagacttacattcattgacaagaaaattgtccaagatttattaatctgcctaatgatgtgtgtgcatatgtgtgattggaaagagagacattcagatcaattacgtctgagaagtgggacttgagggatttttgaatttttatatttttgtgagcttttagtctataatgaacatgcattggtattttttaaagtaacaagttggatcttttaattagaaaagaaggtattgaattcatcttccttgtcttgtgaaaatggctgctttctttgggggtaaaaatatatcttgcccaggcagttagtggttttactaggccatttgttctcagcatacagaaactcaaatgatctcataccctcgaccaggggttggtcctgaaggcaagtctakaccaccacccctttataaataagattttagtggggcacagccccacccatttgtttatgtattgtctatggctgatctcaagttacaatggcagagttgagtagttgtgacagagaccatatggctcacaaagtctacaatattcactatctggcccttaaaaaaaaaaaaaattgccaactcctgctctggccttcttaccaacaatgacaaacatcttttgactactttgtttttaataattttttgacaagagtgaagagtcagatggcaatatgtaaacaccttattgtaaacactgttcattcccaattcccacccccaccatcataattcaaaaataaattttaaggggaaaaaatctcattactgtaggaaaaggttggttttccttctytatattctagggtttctcagctttggtctttagagagatctaagagcaaactctaatgaaatgctaattgtacattttaaagcagaatacaggtgcccagtaatgttactggataacaggcataatttctgtcccacagtaagcgtacttgctctgtccacgtctggatttaggctttcaaatctgctgtccttggaatgcctttgagaagctctgtggaaactttagttctcacttccattcgttatgcagagatcacatacacatccctcgtttcacagagatcatatacacatccctcattatacagagatcatatacacatccctcgttatacagagatcatatacacatccctcattatacagagatcatatacatatccctcgttatacagagatcatatacacatccctcattatacagagatcatatacacatccctcttttgatacacatttcccattctagaccctccaccttcatgcaatgtgagtgctatggaaaatagggaagcccaaaaagaactgattcaatcaagttatcaattcccagcagaacagcatgtgctctgcctcatccaggtctaaattggcctgaatcccaggttgcctaaggagactgcattggttttagggctcctaagtccatgtgaatctcggaaaggtcagaattggacccaggaatctgaaccaggccacttcttccttaagccatcagagagtccactaaatgctccacaggagtctctggagtatataaatccaaggcaaactgagaaccacacccaaagaagattaggagccaaaacaaatcaatactagaaatgtaggttgcaagacaaatagcaggcatttggacaactctctgcccttcagatgcccatcacactgatgctgtgacgtttccagtaagggctgtggatggatttctgatgtttctttataggacctatctatttatgggtccttgaaaaaccattcgctctttgggcttggctgccaaaggccagacatcacttgccagagcatattcttatcccaggagcgagccagccagatcctttcagacacctctgtccttactcctcctcctgctcccttgccatggctctcatccctacttcagctcaccactcaactctcccccgtctttacttccctcacattgtttgttattttctttcctttgttgagaagtttctggagcctcaagacccaggagactaatgtgggaataataaatccaggaaaggtctttgcgttcccctggtagctccacccccactgctcaccgtggaattcctagtcagcagcggctccttcctgtggcttgcagctgaaccctgtgctgtgcccagtgaggcctcccgggatacgtgctaggaatattagccattcttcatatccactgctatgctgtggctttggttcagcagaagagaaatgaaatgggatgtagacagggctgtgagcgaaggttctttttttgtgttggggtaaagggcgttatttcttttgcaraggctctcacccaaaatcagagcaaaacttagcctgagttcctgaggcatgctggctcggagctgctgctggcttttgtttttcctccaagctgatctgtgtattttctagcttgcctttccattggctggagtgaggggatgagaacagctatatcactcaagagaagggaatattcatagagtccgcaggttttcctctgaaactgttgttttcttctcagagcagtagcaccttgattatagagcgcttccttgaaagtcctaaaataatgtcctatttcagaccaaatgtgaaacatcaatttcattccttacagaatctaatcttggtgtgcgtgatagataagtatacacagagaggggaatttctgacctaggactctcctcamaagtatggtatgacccaagtatgatccacattctagagttcattaaaaggccatctcatctgtggattgaaattacttccttagctccaggcagcctgcagccaggcctccctagggtcatcctggtcttccctcctgcaggccaggtggcacctgccagcagcctgagggtagagtcaactagggacttataaacccagaaagttgaaactttaaaaaaaatgctgatgtgtttttaaaaggtatattttatgccaagagcctactggcagagaaggacttatgggaaccctgtgtattatcctcatgaggtaggttcaattctgatcaacagtactgtgaacttttaaaattggactaatttcctagagcctgcctgcctgctaccccctagaggtggcccagtcaatcctggagaagcatgctgtttaacacggccaaactctatcttacagtacagtcacattttcatagttgtgtgtgcaaagtatcaggagcaggcatctcatcttcttcacctgtaagagaataaccaagtcctagggtatgggtgaaggtagtaaccacacagtaacccaatcattttggaaaatgcaaggccttaatsaagtcataaatctggatggagctacttttcatgctgagaaatatatcaagttcttctaccagatgcccaggatcatgggagacgttagcataccccctgccaacggaaacccaaagcttacgctaggggtgaagagacatttggggaatggaaaatgggcttggatagttttatttttccaggaatgtcttaaagttagttttctttgggaaaatgtacatgggaatcatcttggcccagttatttgaccagcttattgggaggtcccagaaatcggagtgaaaattaaagttgmttgtcttctcccacagccttctagggtccagctgacaaatggagggagtaactgagtttttccaatatgaattaatcattcctctcagccagctgcttggtgccagctcccactccttctaagctctttagcgaccatctctgccacccaagagaatgccaaaccagaaatggaaggagccagaaaaggcactgaaatgacttccctacttttgctcagtcaccccatggccttagagtgaggcccgtacacaccacataccacgagcaaaatggagatccctctataaaatttacaggactgagtgttttccagttttggaaaattaaattaaggaaaggactcccagactgactacaccaagtgccaagtttcatcccgacacacatcatttttatagtaagtttaactctgtgaaaaatagaggattgtaatgaaaatgctgacaggcctggagccagctcatgaagtaataatgccacatctttcatacttttacacagcatgtcstaatcagccacagctttcttttcctttagaaagcagttaaatacgtgaaaattcccagagtactactttttctcctcctcttttagattgtatattcttattttcagagcattcttccccgtgaactgggttcagtccatttacagcttttactctgtgcaatctgtttatcaagctcaggtgcctttttctgagctgtttggctggagagggggaagaggagaaaaaacgtgcactcagaattcttgcttctgcttattaaggctaggaacacatcaaaatgaactttggctgtgtggctcactcaaagtgactggcagctaatgaatgcctgagctggcttgatctatcctacaaggaagcccacaaattaagccactggccaaaaatcttggtgattttcagacctttgaatcaacaaaaaatccactatataatgacccttgtattgtgaattcagagcttctttagagacaggtgccacaaaggcaaccttatgctaccagtattaaagttagcatcttctgctgagggtgcgaggaagtgaagccagagatgccagggctcccagttttcttcccccatgtcctcatctgtccaactcaggctgtttccctgagtcaggctgtttagtcacagaagccaatgtaaaatcaagagacaaacatgcagaaagtcagtgaagtcaatgggaaaaagcaaggatgtcaattggtggcacattataggttacatctggactgatgccctgtccttgctggaggccattgattctgtcatagttggagcaaataatgaggggaaccccctggtctttagtgtttccttttccctatttcatgtcagtacttagggatgttagacccattcagagagatgtcttttctggtgtttaagattaaaaaaaaatcaatcacacattttttttctcctattataactttgaatattttgttatatttttccagtctctttttttaattatacttgaagttctagggtacatgtgcacaacgtgcagatttgttacatatgtacacatgtgccatgttggtgtgctgcacccattaactcgtcatttaacattaggtatatctcctaatgctatccctccccgctccccccaccccacaataggccccggtgtgtgatgttccccttccygtgtccaagtgttctcattgttcaattcccrcctatgagtgaaaacatgtggtgtttggttttttgtccttgcaatagtttgctgagaatgatggtttccagcttcatccatgtccctacaaaggacatgaactcatcattttttatggctgcattgtattccatggtgtatatgtgccacattttcttaatccagtctatcgttgttggacatttgsgttggttccaagtctttgctattgtgaatagtgcctcaataaacatatgtcaatcacacatttttagaagggggcaacttcatgtataatttggttttcttattgggtacatctgtcccattytaaacttttcatactttccagmtattttttaaaaaatagatgaaactagggagaggaaatcttacacatatgtgaatcacacctggctttggctcagtttagaaccactttaggcctaggaatggggcctaaagacaatattttctttcagtggttaagaagggttgatagagagaggccttctgctgccagaactctcattagaaagcagccttgccaagtgctgcrtcctcctcagccacctcactaacccaagccctttaatagctgaggcctggagaggagacagcactgtcactgcctgctgatggcctctttcctggggtggaaatgctccgcatatacgtagctgggagggaaacagaaaagagagatgctagccccctgccttaaatactgtgaacttcttcgttgaaggaaagggagggttgggaatggtttattatttggcctctcaaaggtgtggaatacattattagcacgtgttttttggtgtccttgtaaatggcacacagagagattgcttgccttcaaaaaccaaaaaaaaaaaaaatgacggatacttcatttgttttaacaaatgagaaatgtccgtgacagaaaggaacctgttaaaagccaggttttctcattagcagtgaaacatggataattattcactgggaacatacacagtggggattcatgttaaattccttattttgactgttgctgctggcaatccatagagagcactgtgtacacacagagacatgcacataaatatgtacataaaattacaggggcctgtactacatgtgctgagaataccaattctgaacacaaagtttttataaaataagctacgtatttagttgaaagccttgaaaaacagattagtgacagaaaaggcagatggctgacaattttgttcatttactttggttataattaatttattttgatctttccctttactgttgaaagtggactttcctaaaagtgtttycaattcaagatgaacagtcatgcttattagaagcacattccctgaggtcactgtcctgatgtgaagggaaatacagtcacctctacagcagagggacattgcctcaggaatgagaggctatgttaggattgttgtagttaggatatacattcagcaacttttaacaaagactcccagcaacagtagcttaaagaaggcagaagtatattccaatttcaagtaacggtccagaggaagatgttccatgcctggtctgacaccatatcctctagagaccaaggcaaaatgtctttaatctcctcttgctctgacatctctggagtgttgcccttatccacctaggccaggatggcttgctgtacatacatgttctcaacagcaggatagaggaagaggcaagaggaacaaatccttttaaagacaggtttcaggaggtgtgcacagccctctccctctctactaaatgtaaccacatgctccacactttcttgcaaggaaagttggaaaaatctctattccaagaaactatgtacctcaagttcagaggttcttttccaataagaggagracagatatgaagggactagcagattctgccacacacagcaaccaacctaaagttgtcagaagcaaaggtattgagcacaaatgaaagtaatctctgaatgcaacagagctgcatgaatgaaagtgaacctaccagcaggaatttttaagttggacagattataaaatatttgggaaaatatgtttaaataggctggtacagcaattgttttaaacttgttaaaactttctagaaaatagagctgaataggcaaagtatgtaaaagcaattgtttagacacagagtcattcctgatgatttaaacagtgcaaatgtgtttttctttttattatgggtaatttcacatatatacaaaataaacctgatggtatataagagaacccccatgccctaatcaccaccttctgccattcttatttcatttgtactttcacctatgccccactccatcctactcaatgattcttttaggtaaaatgtatatacattgaaatgcgtacatcttttttttttagatggagtcttgctctgtcgcccaggtggagtgcagtggtgtgatctcagctcactgcaacctctgcctcctgagttcaagcaattctcccgcctcagcctcctgagtagctgggactacaggcgcctgccaccatgccaggctaattgtttgtatttttagtagagatggggtttcaccatcttggccaggctggtcttgaactcctgacctcgtgatccacccacctctgcctcccaaagtgctgggattacaggcgtgagccaccatgcctggctgaaatacatacatcttaaccgcacaattttaacagacacacacccatgtattcaccttgtctaacatatatttgactacttgattttttttctagtctttttactctctctgctttactttggctaatttctattattatatcttggatttcacagatctttttctataatgtttcatctgctattgatcctatccagtgaattttttatttcagaaaatatatgtcatttctagaagtccaattgattttttattacttccactttcttcctcagtatgcacacatttttctttaaatacttaacatattttaacactctgttttaagatccttgtctaccaattccatcatccttgtcgtttctggatttgtttccatcgactgatttttgtcctcattatgtattacattttcctccttgacttgtcgagtaatatttggctatctactggtcagtgcagattttacatcaaatgtctaggttttgttgtcttcctttaaagattgttggggttttcttctattagttaagttattcaaagttaaatttgatgtttttaagcatagttagagcaaatctagagtagcctttaccctaaggcctttctggggtctctattaaatgctctggatgatcaacaattacattccactcttgctggtcagaactcaaaggccttccagccctatttgaagtttggaaaatataaagctcacagctycctggttgctctttgctaaaccttgcagattttaacctgatgcacgtacatcttcagttgggcaaaatctcaagaggaatttatgcagattttgggagctctttttctgtgtagcaccctcaactccrgaattctgctcaatagtgtccagttgcctccgcctcttcaaactctcttctttgtctcatcaatttgtctagactattgtgctctgtttgggatatccctctgttatgtgttgaattgtatccccacaaaagatgttgaaatcctaatctccagtacctgtggatgtgcccttatgtggaaatagggtatttgtagatgatcaagttaagataaggtcattcatatggaccctaatccaacatgactggtgtccttatggaaaggtgaaatttagatatacgcagacatgcacacaaggcagaactccatgtgaacataaagacagagcagagtgatgcatctgcaagccaaggtacaccaaagattgccagcaaaccaccagaaactgggagagaggcatgaaacagattcttctctcacagtcctcaaatggagccaaccttgccagcactttcatctcggacttctagcctccagaactatcagacaataaattcatcttatacaagccaaggccacccagtttgtggtactttattatggcaaccctagaaaactaatacacccttccatgctttgcagctcacaatgtgcctccagggaaattgcagagctcacctagtctgtttcctttcttccagggatcacagtcctctagtttctgttgtctaatacctgaaaacagttgtttcatacatttttatcccattttctagtatttatggcaagagaataaattcaatcctgttgttacctcatcatagctggaagcagtaaatttcatttttaaaggagggtttatctagatgaaaattccgggttcaccagtttatgtttccccagcattttaaagtaatagttccattatctcctggtttcctttgtttcctataagaggtcaaccatcattcacatcattgtttccttacatgtagtctagctttttttctgtcctggctttcaatattttttctttctctgctatctactaattccagcaatttgactatgatgtgcataggtggtttgtaaactttttagaactttcagatttcccaaaatttgggaagtttgaggattttatttcttccaatatgttttagttattttcttctttctttcatggcctccaattagacatatattagacctcaattttttttcaatttttttctgtttttcacaatggataatttatgtggaacttcaagtttactgacactcctgccagctctaatcttctgttaagaytgtctrgtaaatttttcatttcatttttcatattgttaagctctagaagtttttatagtttctacttgtctactgatacacgccatctgttcatttattatgagtgtattttcatgtccttaaacatatttataatagctgcttaaagtcagtgtccactcactgcagcatttgtatcatctcaggattggtttctgttgacagctcttttgctgaaatattggtctcatttcctgtctagtggtttttgattattcttgtcaactggttttgaacattatagatgtacggatatagaggctctgaattatgttatgttcctctgaagaacatttatttttggtctaacaggcaattaactcaaactctagcctctatcttccctgcagtgggcagcaactgaaatctctgctctgttcttttagcttctacctgctgctcttttgctgggtcctctggggtctgcctgctaaaaatctagtaaaatttatgcagaaatctgaaattcatcgcctttgttgctcttctgtgacttgcttctaaacttacatgctgtcttaacagcccccagactctgacctctgaaatcacaagccaataaagttataagctttccagctccttaagccattttcaggcaaaaaaaaacacaagctggtagattatacctgttgcaattgccaggtttctaggctagatacctgtcctatttctgccactgtttttggtaattcttcaatgttttcaagtagtaattgtttttctcggggtttgttttgtttttgtttagattttatgattgctatctgcaggaaggtaagtccaactaagttattcaccattaatggaagctagactcctcagtcaagttgttttaagagttttctggccaagatctattcattctgttttgcaaaatttgaagcattgttactcaacctcttttctaattctttatcttcttaataacccagttgttagtatacttctaaatrttcaagatccagaagtaaatgctctcctaaattatataaagagataggtgtccatggcattaaatgtaatattttgattatacaaaatgctttaatttctgatttcactacctttggattttttatcattccaacrtgagtcagaatgaagttcaccttctatattaccagaggtggggagcctattattagaaaaatatgtttggtcagttattttcataaacaaatgaaaccattaatccattccaacaattcttattagccacttatttgccatcttgcctctttaaaattttttgctttctaagcttccatgttattacatagtctcagttttcctcttctctctcaaatcatttcttctcaggctcctttgatatctcttcttccttcttcaatcactgaattctagagttcttccagtgtttcgtcctgaggactgatctcttgtcattgattattttgtccacacatacctataagacaagttcccaaaatctgtgtctccagctcttatttctaactggcttccatctttatcatcctgatggattttttcatcttggggttccatcacaacctttaaatgaaagaaaattaaaactacatttttccatccacaggggtggtgataaggaagagcttctcttactgacttacctatttctgttcatggtctcactcgtgttccaaactctttagctcttatttgcatcctcccctttcttcctcacattccatcagagctgcttttgcaaatatgtctctcttttttgccaatttgaactgatacagactctctaaagctagtgcatcttgcaaagaaccaccttaacgatccttctaaagccaacctagataataccacttcccgtcttcaggcgtcttcaggcatcttcagggattcccaaaagaccagattctggccttcaaggccctctccattacaactcctacccacaatgctggctgtatctatgtttcccaagttccaaccaagtcagtagtttttactcccagccacactacaagttttctcatctttgcacctttgcttacactgcttcttccagaataccctccccttcctactgtatatccctgctctctgcctgtatcattcctaaataaccttcttttttttttaacagatagaatataataggacttggttaaacaagtattggagaactgcaaaagttctgtgatacttacagagcaatcatagaggtagcaactgctgaaagcagctaccatcactagggctgagggaacaagggaagaggttgggattattagaaattaccttttttattattaatttcagtaggtttggggggaacaggtattgtttggctatatggataagttcttcagtggcctgatttctgagattttggtgcacccatcacccaagcagtgtgcactgtacccaatgtgtagtcttttatccatcacccacctcccatgcttccttccgagtacccagagtccattgtatcattcttatgactttgcatcctcatagctcagctcccacttatgagtgagaacataaaatgtttggtttttgcattcctgagttacttcgcttagaatagtggtctccaattccattcaggttgctgcaaatgccattatttcatgcctttttatggatgagtagtattccatggtatatgtatacaccacagtttctttatccactcattgattgatgggcatttgggctggttccgtattttgcagttgcaaattctgctgctataaacatgcatgtgcaagtgtctctttttatatataaagacttgttttcgtctgggtggatacccagtagcaggattgctggatcaaatggtagatctattttcagttctttaaagaatctccatactgttttccatagttccaccagcagtgtaaaagtgttcctttctaccacgtacatgccaacatctattattttttgatttgctgattacagccattcttgcaggagtaaggtggtatcacattgtagttttgatttgtatttctctgataattagtgatgttgagcattttttcaaaagtttgttggccatttgtgtatcttcttttgagaattgtctattcatgtccttagcscacttatggataggattatttgcattccttatagattctggatattagtcctttgccagatgcatagtttgtgaagattttctcccactctgcgagcttctgtttactctgctgattatttcctttgctgttgagaagctttttagtttaattaggttccatctatttatttttgtttttattgcgtttgctttgggttcttggtcatgaagtctttgctgaagccaatgtcaagaagggtttttccagtgttaccttctagaattttttatggtttcaggtcttagatttaagtccttgatccattttgagttgacttttgtagaaggtgagagatgaggatccagtttcattctcctacatgtggcttgccaattatcccagcaccttttattgaatagggtgtcctttccccactttatgtttttgtttgctttgttgaagatcagttggctgtaagtatttggctgtatttctgggtcatctgttctgttccattggtctttttatgcctatttttataccagtacaatgctgttttggtgactatggccttatagtttgaagtcacgtaatgtgatgcctccagatttgttctttttgcttagtcttgctttgtctatgtgggctcttttttagttacatatgaattttagaattgttttttctaattctgtgaagaatgatggtggtatcttgatgggaattgcattgagtttttagatgacttttggcagtatggtcattttcacaatattgattctacccatccttgagcatggaatgtgtttccatttgtgtcgtctatgattttttcagcagtgttttgtagttttccttgtagaggtctttcacctccttggttaggtatattcgtaagtattttaattttttttgcaactattgtgaaaggagttgagttcttgatttgattctcagcttggttgctgtagttgtatagcagggctactgatttgtatacattaattttgtatcctgaaactttgctggattcatttatcagttctaggtgctttttggaagagtctttagggctttctaggtatatgattatatcattggtgaacagcaacagttttacttcctctttaccgatttggatgcgctttctttcttttcyttctcttgtctgattgctccggctagggcttccagtactatgttgaagagaagcggtaaaagtgggcattcttgtcttgttctggttctcagggagaacttttccccattcagtatagtgttggctgtggatttgtcatagatggcttttattaccttagagtgtgtctcttctatgccaattttgctgagggttctaatcctaaagcaatactggattttgtcaggtgctttttctgcatcaattgaaatcatgggatttttttatttatgtgatgtatcacatttattaacttgtggatattaaaccatgcctgcatccctggtatgaaacttaattgatcaaggtggattatctttttaatatgctgttggatttggttagctagtattttgttgaggatttttacattgatgttcaccagcgatactggtctgtttgctttatgtcctttcctggttttggtattaggatgatactggcttcatagactgatttagggaggactccctcttctctttttttttggaatagtttcagtaggattggtactaactgttctttgaatgtctgatacaattcagctgtgaatccatctggtcctggacttttttttgttggcaattttttattaccatttcagtctcactgcttgttattgatctgttcagagtttctgttttttcctggtttaatctaggagggttgtatatttccaggaatttatccatcacctctaggttttctagtttgtgcatgtaaagctgttcatagtagccttgaatgatcttttgtatttctgtggtatcatttgaaacatctcccattttgtttctaattgagcttatttgaatcttctctcttcttggttaacccactaatggtctatcagttttgtttcatctttttaaagaaacagctttttgtttcatttatctattttttgtttcaatttcatttagttctgctctgatctttattatttcctttcttctgctgggtttgggtttggtttgttcttgtttctcaaattccttgaagtgtaaccttagattgtctatttgtgctctttcagactttttaatgtagacattcaatgctgtgaactttcctcttagcaccacctttgctgtatcacagaggttttgaaagactgtgtcactattattattcagttcaaagaattttttaatttctaccttgatttcattgtcgacacaacagtcattcaggagcaggttaattaccatgtatttgcatggttttgaaggttccttttggagttgatgtccaattttcttccactgtggtctgagagagtacttgatatarttttgattttcttaaatttactgagacttgtttcatggcctgtaacatagactatcttggagaatattccatgtgctgatgaatagagtgtatattctgcagttgttgggtagaatattctacaaatatctgttaaatccatttgttctaggttatagtttaagtttattgtttctttgttgactgtcttgatgacctgtctagtgctttcagtggattattgaagtctccacaattattatgttgccatctatctcattacttaagtctggtaatgattgttttataagtttgggagctccagtattatgtgcatagttaggattatgatattttcctgttggactagtccttttatcattatatatgtctctctttgtcttttttaactgctgttgctttaaagtctgttttgtctggtataagaatagctactcctgcttgtttggggtgttcatttgcatggaatacctttttctacccctttaccttaagtttatgtgagtccttatgtgttaggtgagtctcttgaagacagcagatacttggttggtgaactcttactcattccgccattctccatcttttaagtggagcatttaagccatttgtattcaacattagtattgagaggtgtggtactattctatttattgtgctagttgttgcctgaatacgtgtgtgtgtgtgtgtgtgtgtgtgtgtgtgtgtgtgtgtgtgtgattgttttataggttctgtgagatttatgctttacaaagttctattttggtgtattttgaggatttgtttcaagatttagagccccttttagcagttcttgcagtgccgacttggtagtggtgaattctctcagcatgtgtttttctgaaaaagactatctttccttcatgtatgatgcttagtttcactggatacaaaattcttggctgataatagttttgtttaaggaagctcaagataggaccccaatcacttctagcttgtagggtttctgccaagaaatctgctgttaatcaggtaggttttcctttatgggttacctgatacttttggcttgtagctctttagattctttcctttgtcttgacttcagataaccagatgactatgtgcctagatgatgatctttttgcaattaatttcctgggtgttctttgagcttgtatttggatgtctagatgtctagcaaggtcagggaagttttcctcgattattccctcaaatatgtttaccaaacatttagatttatcttcttccttgggaacatcaattattcttaggtttgatcttttaacataatgccaaacttcttgaaggctttgttcatttgttttaatcttttttttctttgtcagattgggttaattcaaaagacttgtcttcaagctctgaagttctttcatctacttgttttattctgttgagactttcctgtgtattttgcatttctctgtgtccttcatttccagaagttatgattgttttttatttatgctgtctatttctctggagacttttccatccatatcctgtatcatttttttgatttctctaagctggtattcacctttctctggtgcctccttgagtaacttaataattaacattgtgaattctttctctggcaactcagagatttcttctgggtttggaggcgttcctggtgagccagtgtgatcttttgggagtgttttgtcataataccaggattgtttttctggttccttttcatttgggtagactatgtcagagggaagatctggggctcaagggctgctgttgagattcttttgtcccacagggtgctcccttgatgtggtgctctcccacttcccctagggatggggctttctgggagctgaactgcagtgatagttatttctcttctgggtttagccatccagtggagctactgggcttctggctggtactgaggagaggctgtgaagagtcttgtgatgtgatttgtcttcaggtctckcagccatgaataccagtacctgctctggtggcagtagaaggggagtgaagtggactctgtgagggtccttggttgtagttttgtttagtgtgctggttttgtgtttgttgacctccagccaggaggtggcactttcaaggatcatcaggtgtggtagtatagggagtatacaagcttgccctagggtcacctggataagtattggggtttctcaggcagtgggcagggccacagatctcccaagagattatgtcctttgtcttcagctaccagggccggtagagaaagaccatcaggtgggtgcagggttaggcgtgtctgagctcagactctccttgggtggggcttgctgggactgctataggggattgggtgtagttctcaggccaacaaagttatattcccagggggattatggctgcctctgctatgtcatacaagttgccatggaagtggggaaagctggcagtgacaggcttcacccagctcccatgcagcccgaaaggccagtctcactcccaccatgccccaccaatagcaccaagtttatttgcaggcagccagtgagcagggctgagaacttggcccaggctacaagcctcccagctgagaaagcaagcagcgctttcaggtttcacacctccccacctgtcgtggcttctgtgctcctatctgcactccctgttaacccccctccccaggattctgtccaggaaacttcatatccagtcaaaattgttacaaagttcatttggaaatttcctactccttgtggtctttccccaattccactggcagctctctccaaggacccctgtaagacaaagtcagaaatggcttccccaggaactgagagccaacagggctcttcccactactacatctacccctacatttttctcagctctctaaattaatctcagctcctggtaaggtcaaatccttctcctgtgatctagaccttcaggttccccagtgaggatgtgcatttgggagcagattctcaccctctcacactttgggcactcccagttttttggctgttctcatggcacctgcagtggcaagctgcttccttgaaagggtctgcggattctctggcctttcctggtatgttcctgtggtagttcttggagcagaaaatcacaatgtgagtcttcacatgctgctctgtacatctgagtggaagctgcaagttagttttgtctcctatctgccatttttcccctcaggattattagaatttcraagcttggaggagaggccacaaggagctgagactcagagctctgcagggagtgggaggtgccagttgctgctrggatctctgagagggcacaataaggcagcctctgaagtgtgggaaaagcaaattgcaaactaggaccaactactgacaatggaaccagctgcactgccaggttgaaaagcctaaataaccttcatatataacatttcttccatgaccccatcattggcttagttccstttcactatatgtcaacccaagcaatatagatttaaataggtccactttgccctggcacttggctttgtgggagagagaagaggaggggtgagaatgaatttgagatgatgttaagacatttgggaacctaaaagcaccttaaaggttatttcattcgaacataaatgaacctttaaaatcatcaaatattctcacttgcaaattagaaaactgagaccagagaaccctactgaaacctagagttctccttcagagtcatgaatctgtgtaactaaccttcacagtaacaacaccaggatttttttaaaatttttccacaaaactgatcttagccttgataagtttcagaggctttacagttacatcctcaagatactttactttgggttcagttacagaccactgcaataaagcatatactgcaataaagcgagtcacacaatattttttgtttcccaatacatgtaaaagttatgtttacactatattgtaatccactaagtgtgcaacaccaatacatctaaaagaaaacacatacatgccttaatttaaaaatactttattgctaaaaaatgctaacaattatctgagccttaagcaagtctaatctttttgctggtggagggtcttgccttcatgttgatggttgctgaatattggaaagattctggcagtttttaaaagacaacaacaatgaagtttgctgcatcgattgattcatctcatgaaagagtcctctgtagcatgtgatgctgtttggtaacattttactcacagttgaacttctttcaaaattggtgtcaatcctctcaaaccctgccactgctttattaattaagtttatataatattctaaatcctttgtcatcatttcaacactgttcacagcaacttcaccaagagtagattccatctcaagaaaccactttctttgctcatccgtaaaaagcaactcctcatccattcaagttttattatgatattgcagcaattcagtcacatcttcaggctttacttctcatactagttctcttgttatttctaccacatctgcagtgacttcctcaacactgaagttttgaacccctcaaagtcatccatgagggctagaatcaacctctcccaaattcctgttcatgttrgtattttgayctcctcccatgaatcatgaatgtccttaatggcatctagaatgatgaatcctttccagaacattttctatttacttttcccagatccattttagaaattactatccatggcagctatagcattatgaaatttgtttcttaaagagtaagacttgaaagttgaaatcactccttgatccatgggctgcagaatggatgttatgttcgcagaaatgaaaataagaatctccttatacwtctccatcagaagtcttgggtagacaggtgcattgtcaataaccagtaatattttgaaagaaggctttttctctgagcagtaggtaacaaaatagtgatcttaaaatgttctgtaaaccatgctataaacagatgtgctgtcatccaggctttgttcttccatttatagagcacaggcagattagatgtaacgtaattcttaagggacccaggattgttggaactagagatgaccatyggcttcactttaaagtcaccaggtgcattatcccctaacaagagagtcagcctgtcctttgaagctttgaagccagrtattgacttctctctagttatcaagctcctagatagcatcttcttccaatagaagagtgtttcatctacactgaaaatctcttgtgtttaacatagccaccatcatcagtgatcttagccagattttctggataacttgctgctttaacttgcacttttatgtaagagagactgtttctttcctaaaaccttatgaaccaacctctgctagcttccaacttttcctctgcagcttcctcacgtstctcagccttcatagaattgaagagaggtagtagggcttgctctggattaggcactagattaagggaatgttatagcaggtttgatcttctaaccagaccactaaaactttcttcgtatcagcaatgagactattttacttcttatcaatttttttgtgttcactggtgtagctcttctaatgttcttcaagagctttttctttgcattcacaacttggctgtttggagcaagagacctgtcttggcttttgacataccttccccactaagcttaatcatttctagcttctgatttaaagtgaaagatgtacaactttttctttgtcttgaacacttagatgccactgtaggattattaattagcctaattttaatattgctgcatctcagrggatagggaggtggccccaggagaggaagcaagatgggcaaatggccattcagatgagcagtcagaatacaaacatttatcaattaagttcatctttttatatgagcatggttcatggtaccccaaaacaattacaatagtaacatcaaagatcactgatcacacataaccgtaacagataataatgaaaagttttgaaaattttacacagagacataaagtatgcacacactgttagaaaatcatgccagtagatttgcttagcacagggttgccacaaaccttcaatttgtaacaaatgcaggatccatgaagtgcaawaaagcaaagtacaataaagtgaggtatgcctgtattatgaaggcagcttctcaaaggcctgttagttgcttctcctgggtcttgagttccaagaactccacatccatggcaggcctgcccttsgaagcatctctaccctattctcatctgcacgaggaatagcaggctgggaggccctgggaacargaccaagacccaaggctcagatgggccaagagaggtttcctggctactcactatggcctctgattccaaggaggagggaggaatttggatgtgatttttgtgcaaatattcctcttatttagtattcctcttatttagctgactaaggtttctagctcccagataagttcttcagccatagtgaccaacctaggggctgctaccactcctttttctgcctaaatactctctcagaaaatcctaaggcagttgggaaaatgaggactatgagaaaatatgaaagattccctgrcaaatgtgcttaggagtagtaaggttcatatttacygactaaaatctcatcagcctcaccagggctgaccaaacaggattcatggagccagcaccttgatagcatatggcccttttyttttccttcaaagtagatgtgatagggagacacgcatttgcctatttcagtcaggctaaaaagctttatttgtttcagctgcagtttcaaaagtatatttgccttcatacacatatagttttcctggcttttattggaaaatggaacgagcattttactccaggctacaattagggttggagggtataggtgcccggatcccaggagatccccagtggactgayttctctccccaaggccatttctacactcatttcagaacaggagtgcagtgacaccaccatggacctcgtggcatgtagatgcctagatgccgccaggagcttgtggtgagactgcttctcctgagtaccttgaataaggtgayacagggccaggcaaggtggctcacacctgtaatcccagcactttgggaagctgaggagggaggatcacttgaggccaggagttcaagaccagcctgggcaacatagcaagactccatctctactaaaaaaattaattagctgtgtgtggtggcacatgcctgtaatcctagctatttgggaggctgaggtgggaggatcacttgagcccaggagttcaagattgcagtgagctatgattgcaccattacactccaacctgagcaacagaatgagagcctgcctcaaaaaaaaaaaaaaaaaaagaggatataggtcaggtaagagctgggtcagcamacaagtagcagctctgtcctattccaggccttcaatccattggccaagtggaaaagctggaagatacctctccctaaatgtatcagttagctatcacctcacacatacacatgctgcattttaaaaagcccaaacttggtgacttaaaacaacaatcaattgttcttactgatcttacttagttcagctgatctaagctgggtttggctggagtgacttgactgttctccacatttctctcatcttcctcttgggatcrtcaggccagtcccggcatgactttctaatataatggcaaaggcacaacagcacaagcaaaagctcccaagatctcttgtggtctaggtttggaactggtacattatcatctctgcctcagttttttattgtggtaagagatacataaaatttacaatttcaactctttttaagtgcacagtttgatgccattgcatacatctaccttgttgtgcagctatcatcactgtctccagaattttttcatcaactgaaactctgcactcctcctccctcycttctcccagcctctggtagccactattccactttctgtttctatgaatttggctgctccaggtacctcatataagtggaatcatacaatatttgtccttttatatctgacttccttcatttagcataatgttttcaaggctcatccatgttgtagcatatgtcagaatgtcattccttaaggctgtataatattccatcatacatatataccacattttgtttatctacccattgattattggatatttgagtggtttaaatcttttgggtattatgaataatgctgctatgaacataggtgtacaaatatcttttaaagttcctgctttcaattcttttgaatatataccctaaagtggaattgctggagcatatgataatcctatatttaattttttgaggggccaccatactgttttccacaacagctgttccattttatattcccactagcaatgcacaagggttccaattttttcacatatttgcaaacatttatattttgggtttcttttaataatagccatcctggtgggtatgcagtggtaactcatggtggctttaatttgcattttcctaatgattaattgagcatcttttcatgtgtttattggccattcatgtatctcttttggagaaatgtctgctcaagtcctttgcttatttgggcatttgcctgaacygggttgtttgttagttatcaaattttaagagttctttttatattctggatattaatctcatcagatctatgatttgcaaatattttctctcattctgtgagttgctttttcactcacttgatggtgtcttatgatgtgtcaaagatttaaattttgatggaatccacttkattttttcatttgttgcctatattttagtgtcatatctaagaaatcattgccaaacccaatgtcattaaagttttcccctgcgattttttttaagagttttatgctttcagctcttaggtttaggtctttcatccattttgagttaatttttatatatagtgtaagtcatttgttcacatatggatatccattttcccagaaccatttgttggcaagactgtcctttccccattgaatggtcttagcaaccttgtcaaaaatcatttgactacatatttaaaagtctgtttccggtctctattctgttcttttgttctctgtgtctgttttatgccagtacagtactgttttgattactatcactttgtattaagttttgaaatcaggaactatgaatcctctttgttcttctttttcaaggttgtttagttattctgggtttttgatattccatataaattttagcatgagattctctatttgcaaaatatatcattgggatttgatggggattgcattsaatctgtagatcactatgagtagtattgacatcctaacagtattaagtctcctaatccgtaaacatgagatgtcctcccatgaatttatatcttctttaatttgtttcagccgtattttgtcgttttcagtgttcaagatttttgtctctcagtccattttgtgctgctataacagaatacctgagactaggtaatttataatgaacagaaatttagtggctcacagtcctcctttgcatcctccaaaagggaggaaagctttgtcttcacatgctcttcaaaagcacaaagagacaaataagggctgaattcacccttttataatggcattaatccaacccatgaggacagagccctcatgrcctgatcacctcttactactgttacaatagcaattaaatttcaacaggagttttggaggagacaaatatctgaaccatagtagcctccttggttaagtttattcctaagtattttcttctttttgatgctgttgtgagtgaacttgtttttcttttctgattgttattgtaacatctgtctcatttttgtcatctaaataactcacatggccaaagccaagagggggaagtataaccgctttctcatgggagggcactgtcaagtggcatgggctagtcagyggatacatgaaggagtgaagaattggatcatataacactacatcccatactgagcttccaggggtccatttttaggttatctttttagaaccctcccttccaaatagtctgctcctaccctctcactactacctcaggaaaaacaaaaatgaaggggaaaaaaataagtgagcaaagaaacgaaggaggtagcaaggtgcccagctgaacaagtagcaggtatgggggaaagaacacggtccaggcgtcggatagaaggcctgccgcacaatctcaggaaggtctcctaacctctctaggcctctgtttcttcctctagtggtgaactagatgatttctagggattcccaatcttgtgtaaattttaacagttctatctctggattcaaaaacaagaaatgctaggccaggtgtggtggctcacttctgtaatccttgcactttgagaggctgaggcgagcagatcacttgaggccaggagttcaagaacagcctggccaacatggtgaaaccttgtctctacttaaaaatatgtatgtgtatatatacatgtgagtgtgtatgkrkatrtatatatatatatatatatatatatatatatatatatwtacacacacatacatatacatacatacaagtatatacatacatacacacacacagaaattatctggacatggtggtgcacacctgtaattgtagctacttgggagttggaggttgctgtgagctacgattgcaccactgcactccagcttgggtgaccgagygagaccctgtcaacaaagaaatgaaacattagaaaaaatcccttctctctatagttgcataggcacccacacatccacagagggtagccgcctgtcttagtccagtcaggctgatataacagacatataaaaactagtggcttataaacaaacaaaacaaatttgttttttacagttctggagtctggcaagtcccagrtcagtgcagccgcagatttgatatcggtgagggcttgctgtctgcttcatagatggcagcttctcattgtgtcccacatggtggaagggccaaggcagctctctccagggcctcttttatggggacactaatctcattcgtgaggacagagcccatgtgacagaatcacctcccaaaggccccaccctctgataccatcaccttggtgattagaattcaatatgaatctagggggtatacacaaaccctcagactatagcaccatctttgtgtctcgtatctcatcatctcctgccttgcatctgcagttttatgagtgtactttctaaaaatcttataccagctgagatctccctagaagagggaagatagtcttaattatcttaactgtccccagagcagtaggtaccaaacagatgtttttctaagtgaactgagggggaaaaaaatctatagattctttaattttcaatgacttactgcattttacacttccaaagaaattctctgtggaaggtaagttgctggggcacaacagcaaattcagcaagtaccctgaccttcaaggaatttctctcacaactgcaacctgtttatcttaccgattctatgctacaaagtcttgggtagacatttgagtttattatatcaaaatatgtttgatggctctgtagatgtgtataatattgtacatgtccagtgcaggcttggcaaaagycttcagaagacaaagccttatgcagaaaaaagatccatgtctaaaattgctttcctagtctctgattggaaaaatctcataacaagtaaaatgagggaatatgatacttttaccaaatcaagtttgtttcttaactattactatatagtatggtattttttcccaacatatcgtatttgaagaaggaatttctgtcagaaaaaaatcactataagaactacttaccttgaaaaaactgttcaatgaatgaagattaattgtatctttttttaaagttagtatagggacataaacagaaagaaayaggtacttttgttatccagtaattttacttaattgaatgaatcatagtcaccctcctagaaattcagagaataaaaacatctcctgtttgctcaggaatggcaaatgtaataaaaatgccacagacaaggccacattgtgtgtacaatttctagagccacamagacagtaaaccagtgcaccagcaatgtgttccttatggctttactaaggcttacttcttttcctctccttctaggctgccccatcaaaggtcaccctgtccctaatatcacctggtttcatggtggtcagccaattgtcactgccacaggactgacgcatcacatcttggcagctggacagatccttcaagttgcaaaccttagcggtgggtctcaaggggaattcagctgccttgctcagaatgaggcaggggtgctcatgcagaaggcatctttagtgatccaaggtaagaaaccctgcagactttgcatactggacttgaacaagaaagcccacttgggaatctaactatctagcagaacaaagagatttctgatctccagtggtactcaaggcatgaaaaccaaagccatgccatgtttccatacagtgagaccctacttctgtcaacatggcccttcagaagagccatcatgccccatcccagcagaacctggaaaagccagtgctgccttcataaataggcccttctgcttttaatgctgctgttgctcaggaccatggaaacaccactatatatcaaagtcagatgtgattcttttatgctgatttaactagtacagatctcacacacacagagtagcctgtttggttactgcctcctgcctggagagacaggcctgatgccagtgcctgctgatcattctgaagagtcttcagctttagtcataagctgagggctttccaggcacctttcatttggccctggcaaagaacagactgcgaagcccacatggctcatgcattaaccttccaggaaaacaggcaggtcagaaagcctttgggtggggcctggccttcactgcaccaagaaagagttgtaaatgaggcccaatcagtgggaaagagggaaactggccttcttatagtgttttccataggcttgttcgacctgtggcctatgtgtgatgtattccaaaatgaaggatgtgatgggaagggacagagttttgtgccaatacggcacaaaaagatgaagaaaggagggaaatttttctaagcagttaagttttcttcttaaatatcctccttcaccatttggcttttcagacaggaaaacaaatgttttcagacaagaaaacaaattttcttggagccagctagyctctgctgaaaaccagaagccagggcctatttgcaagacttgtaatatgcaactttgcaaataagcactcaaaatttaccatctcacctatcagtgagtcccagacccccaaagcaactggctttcttactgacatcattgtctcatgtaaataagcactctctgcataggctcttttgggtaacatttgcaaagtccagctcaaatctgtactgtgatggttaaatatttgctatatttatatatctttgtagaaaacaaagtcactttctggtgaaccaatgaggaaaawaaagtactgtagccaatatctttaaaaataagatgacctgtggcattaattgtgcactcttttatgtcagacactgagctactttactttcattatttcctgtccccacaataacttggtgaggtgaggttcactgtattcatttcatggctgaggcccctagagaccacgtgacttccccaaatagttcgggaatggttccctgcgaggagcagggcctcatttataatagctcctctccttcaggccacaaatccacccctgtcaccttctccctgccctgctcagaaggaattcagagtgtgggcaattatgctatattcttttctacwctgctcctcctcccatgacagattactggtggtctgtggacagactggcaacctgctcagcctcctgtggtaaccggggrgttcagcagccccgcttgaggtgcctgctgaacagcacggaggtcaaccctgcccactgcgcagggaaggttcgccctgcggtgcagcccatcgcgtgcaaccggagagactgcccttctcggtgagtgcagcggacactggctcagacctccccaccctaggargagccctccctgttagcgaagtcagtggccagcccttcagtagcactgtgcagggagagatgccagccaaggagctgttcttccctctaggcacaggcttatcaggcctctccaccttgctgaaaatatcctcagactatgccacctctctcagctttgtttattcctcaccccactaayggccarccaggtttcccaagtccctaacggggtctgttcagggagcaagagcttcccaggccctggcaagccatagacgccccccatcctacagtaatcaactgactctgagttgtttgtagaaagcaatgtcttttcaatcgaagggctgaggaaacaacgattactgggttctgcccaccctccaagtctaaccttaaatacccatgctaatcagtactccagttcagttggggaaatcttatcttcctcttttctacaaaggcttgcgtctcactaaagttggaataaatctctgtttctgacagtagcctcatgctctgcatttgggtcccttgtgtggcccagagtgacacctaaagcctctgccaccttccttatgcttcaagaggctatgagtccccctgtgcacctcatcctctgtcctcagcagtagttaaatggataatagatgggcttggagttggcactggtgcrgtgctgagagcctggggggatgtggctcagctctcaaatgcccctttactacctatctgtaggactttcatacaatacttaggcaactgctttctgttttgccagctgagtcataaggagcagctgaaaccaggagagattcgatgaaatatgaaacatgctcattaatatcagcagtttgacttgctgacgggaaggtttccacaggaatgattaatgtccttttatacccttcctgaactgtaacatagcctggcccgctcctttctcaaaccccccccaccccagctcctgaaaaattgctgaaacgtatatttggaaataaaagttgatggaaatgcaggcctgacattcaccagggatataagaggctggaaaactgcccttgccaagctgtgcaaaatgaagaagagatctttgatgtgccaggaactttytgacttgatttggtgatggtcagagtcaatcagcttaatttacttctgcaaatgaaataataatggctctgttttcttggatttcaatgcccccgggagtttttaaacacctcttgcctgcttcctaagtggctctgctcctgtgggttggaaatctgcrttcagtcatccctccacaaggcaaaagagcagggaagtggccacaaaactaagtaagtcacagtccagatttaggaggaatttgctccccttccctgctacatgcctctcctgaaagccagatgtggcgccgcttggctaggacgwagccataggttcacctttgacccgtttgcctgccaggcatttggaacacttagtatccttctttgcatgtgaacaagtgttgccctggttgtctctttsagatacaactgggtaaccccgctgygacccaggyagctgttttttaaccattttgttagataaattttctccatcactaaaaccaaagagtgggatttttttgttctagattacatgagcaacagtctcgcgatttccccaagctctctccttctcttygagaattaycacagggtgcacacatgcaacaagaatccctgcmtgtttgtatatggaccgaggatttcmgagtgttcctagtttacaggtkggctttgtgagaaaagtccatcggtcacagtctcacttttggaacctaacattcagagaacaactatttctaccatgtatgcagccctctgagaggtataagacctatggactgtcacgcggtcacgccaagagatggaactttacctgtttctgagagattgaccaaaatgtgcagcaggaagtataccgagcactaccagacaaaacsttgacttcagtgaggcccagattactttccaggtcaggaggtgacacraatttggatctgacttccctagaacaactgtctctcctgtcacatgcttggatctcctttaggaagtaccaacactgcagttacaaaacaacaaatttattctcttacaagtttgarggccaaaagtccaagatcaaggtatctatcaatcaggaggatcacatcacctccaaatcacctccaaaggttctaggagagaatccacttctggtggccccaggtggcttatggccacatcactccacattcagccttcatggtcacattgtctcctcctccacctctctgtatgaacacttgttatggcaggcatttagggcccagccagataatccaagataatcttatctcaagtccataattacatctggaaagaaccttgccacatagcattcacaggcactagggatttgacatggatatcttttggaggagtcatttttcagcctatcaatcatctttccaagtaaatactgtaaaaagggccttggccccaaattagtggcaagagcagggatgtcggtggggaggaggtctcttttccccagggcctgtccctttagggctctcctgacacttcttcctctccccaggtggatggtgacctcctggtctgcctgtacccggagctgtgggggaggtgtccagacccgcagggtgacctgtcaaaagctgaaagcctctgggatctccacccctgtgtccaatgacatgtgcacccaggtcgccaagcggcctgtggacacccaggcctgtaaccagcagctgtgtgtggagtgggccttctccagctggggccaggtgaggagccagagaggttgttatttgaaagctaaatctaaaggaatggaccctgccacagtaggaagtgaaatgctatcactgccactgccacctcctcctttcacattctgattggccaggcatagcttttgtgggttgtccagctgagacacccccagagcagcaggcttttaattctttgtgtaattctrtgaaccaatgtgattgaatgaatgtttttaggcagtcagcaactcaaaacatcttataattggccatctatacattattacatttatgtcctccactcccacccccaggtgtgtcctttggaaaacaatcaccggcgactttctattaagttaacacactgtggccacctttaatgaaaatcaaatgtttttggccatagagttcacgttccatctcgtaagccatttgtgtcccaggtaagttgaagctaccgctcaatgctagccaatcaayatacctagctggagactcctttctggagcttctactaacccctccttatttccagtgacataatgtatatgcttcataatcaaacaggcatgagctccctttgycagggggaatatcgtctttctcctacctggaaaagcctgcttctcataggtcacattcatctcaagacagctctggttccaggccctcgaggcttattggcagtttgtaaaattacaatagcaaacagatccggctacaaatgacagatgtttctgcactgtgtcatcaaggtcactcaaggagggacgtatggtgcaccagtgattatgtttcctaacagagagaaaaatacataggtcttgctccctttctgcattccttcccctcaaaaaattcaccccctcctcctcttttctacaaccctccaggccagtacgtgtcgagctttaatgtgaatcacctgggaatcttattaaagatgcaaattctaatatggtaggtctgaggtagaactggggatgctgaatttctcaaaacttctggtaacatcagtgctgctagtccaagggctacgcttgaaagagtagcaaggcttgaggcattacagattgcagacaaatacttcatctcacaatcctgttgatgtttttctgctgataatattgctgatattgtgcttcaaactgtagatgcttctcaaacctccacattccactcctgtgagacacaaaaaaatccttttggaatagtgttatgcaaatgttttttcttctgcctaccttcatgaagtctatgaaaaccatgctgattttagtccaagtaaaactaagaccaccttcttagctccaacaatctggcttcatgtaataattcagctttctccttttaatccaacatacatttatgggacacctgtcttgggaggggaatgtgtcccatataagcatgtgtgaagaaatgaagggaaaagcagcccacaatatttgcaggagaatgaggtgacagaatagaaatagaaatgtggcctggaaagcaggtgcaagaccataaaaggstcttgtatgctgtacaaagaatttggattttattgtaagtgcaactacaaagatttttaagaaggaatggcacaatcagacttttaagattactgtctggccaggcacaacggctcatgccggtaatctcagctactcaggaggctgaggcagaaggatcacttaagaggttgaagctgcaacgagctgtgatcataccactttcactactccagcctgggtgacagagcaaaaccttgtctttttttttttttttttttttttgaaaaaggtatgctgtctgcagtatagtgatcaaattggcaagtgaaaggactacagaaagagaaacctaatctaggtgagcaattatggtgatgagaatgaaggtattgagcagtaccaatggagaggaatccatttcctctttataagcgtgattcgcatggcttccatgatccattggatatgagggatgagagaaaggaaggaagtcaaaatttgactggaggttctgaattgaacaactagataggaatacagaaaaaaaagagggtggattgttgctatatggaattgtttgggacatgtttagtatgagatatctaagtacagatgctcattaagtagttgcacatayaggtctgggacttaaaagagagctatgctaaacactatcaatttgaaagtcattagtatacaagtggtggctaagaatcatagatggtatcacccagagagagggaaaggatcagattaagaaaaggcacaggacagaaccctgaggaacacaacactaattaaactgggggaaaaagaggaaaaagattaacctaatgagtaggaaaattcacagagaccagtggaggagctttttccagaaggaaggaagtcaatggtataaaaatacatccaacagaataaacaaaatacaaattaagcattggccttattttatacatacggtgcatattcraacttgactgacaggcagttacctgtaactctgtgaatgrcagtttcagtgtaaaagtaggcactgaaatcaaaccagcaataggtttagttacaaatgagagtggaggaaataagtgcttccagggacacattactccttcaagaattcccagtgtagtcaagggacattagcaaaatggcaaattaggacactccaagtccatgttctcttatagaagcatcaaaaaaacaactagacactggctaaactaaccttataagtgctctggaaaacagcccaagttctacagcaaccaagcaaacagccaataaagaaacagccatctttaagatgataggaaatttcctggtwttttcgttcatccttgccccaccccctccccccatgtggcatggwtttgatcttaacaacgtggcagccactacktgtgaaatctgcagaaggaacacagacctgcagacacctgggaaaagagattatgggtggagaytgaccctctatgcaactgacgctctaaagtcccaaggacagccttgagtgagactctgggaaattaagacactcaaaagcagctatgtatatggagaaggcccatacacaccacataaaagaaagatctgagaagaccttacgctttcacctcagactgattactatgctcagagtatacccagctaatcagtgatggattgcccaatcacagagccagtctacagagagtaggagaaatggctatttttcaaatgcccaattttcagcaataaaatcacaagccatacaaagaaatgggaaaatatggcccattttaaggaagaaaataaacataggcattgaacattaaagacaaacactttaaaacaactatcttaaatatgctaaattgggagctgaaagtactagaactgaattgaaaattttactggcrggattcaacagcagatttcgcaggcagcagaaagaattttcaaacttgaagatagataggccaataaaaatagaagaaaatraacaaacagagtctaaaagagttgtgasacaccctcaagtgaaccaacatatacattttgagagtctcagaagaagaaaggagttgaaagattatttgcagaaataatggccaaaaactttccaaatttgatgaaagacatgaatctacaaatccaagaagctaaacaaactctaagttgaaaaagccaaagggacccacactaagattaaaatcagtcttaagaaacaaagagggaatcttgaaagcagcaagaaaagcaactcattgtgtacaagaaattctcaataactttataaactgatttctcagcagaaaccttgcaggacagaaggcagtggaattatgtatttgaagtgcagaaagagggggaggggccaagatggctgattagaagcagctgcagtccacagctctcacagagaggaatgaaaatggggagtcaatttggcaccttcatctgaaatatccaggttctctcattgggactgactaggcaatcaacttgacccatggagaatgaagaaaagctgggtaggccactggcccacctgggagcagcacagagccaaaaaaccttcaccccccagccaagggaagtggtaagtgattgcacaaccccacccaggaaaccacacttctcctacatatctttgcaatcagtggatcaggagatcccctagtgagccaatgcaaccaaggccttgggtttgacacacagagctgtgcagtctcagcagagcagttgctcaggctcacacagagacccaggagtctttcagactcaggccctgggaatcccagcagacaagcagcatcattctgcaggccccacttaacatggcacctcagaagttaagacccactggcttggaattccagctgcctgccgagtgcatcaggctggagactgcctgagacagattagttcctgggggaggggtrgccaccatttctgtgcttaggtcaacccagctgttctagcctgccagttccagtgagtcctggcagcccaggtgaggagaagtccctcacaacacacctgctgtgccagatagtggccagaatgattgtttaagtgggamcctgatccatctggcctccctgcgggaatttcagcaactscaacctgggttatactaacagatgtctgatctctccctgggacagagcccccgggggaaggggcagtgagtctctgcccttgagttactcagccttcccaggactgccaggagagtccaggcagtctggacaaggaagggttccccacaacacagcacagctgttctaccaaaaaaacagccagactgattctttaactgggttcctgatcccatccctcctgactgggtgagacctcccaacaggggtctccagacacctcctacaggagcatctgggccagcaacaggtcagtacccacctgggacagagctcctagaggaaggggcaggcwgccatctttgctgttttgcagacttcactggtgatacatccaggtaaggggaaaacctaggcaactagggcctggagtgatcccccagcaaactgcagcagccctacagaagagtggcctattaaatagaaaacaataacaacatcatcaacgaaaaagaccccacaaaatctccattcaaaggtcagcaacctcaacaaaggtagataagcccacaaagatgagaaagaattaacaaaaatgctgaaaactcaaaaagccagagtgcctcttctcctctaaatgaatccaacacttctcctgcaagggcacagaagtgggctgaggctgagatggttgaattgacataagttggcttcagacggtggatagtaggctgggtgtggtggctcacatctgtaattccagcattttgggaggccgacgcaggtggatcacaaggtcaggagtttgagaccagcctggccaatatggtaaaaccccatctctactaaaaatatcaaaaaaaaaaaaaaagttagccaggcattgtggcgggcacctgtagccccaactactcgggaggctgaggcaggagaatcacttgaacccaggaagcagaggttgcagtgagctgagatcatgccactgcattccagcctgggtgacagagcgagactccgtctcaaaaaaagaaggtgggtaataacaaacttcgctgagctaaaggagcatgttgtaacccaatgcaaagaagccgagaatcacrataaaacagtagaggagctggtaaccagaatagccagtttagaggaggagcacaatgacctgatggagctggaaaacacaacacgagaaattcacaatgcaatcacaagtatcaatagcggaatagaccatgcagaagaaagaacctcagaacttgatgactatctttctgaaataagacaggcagacaagaatagagaaaaaagaatggaaaggaaccaacaagacctctgagaaatatgggactatgtaaaaagaccaaacctatgactgattggggtacttgaaagagacagggagaacagaaccaagttggaaaatccagcaccacatcaaaaagcttatccaccatgatcaagttggcttcatccctgggatataaggttgggtcaataaatgtcattcctcacataagaagaactaaagacaaaaaacacaagtatctcaatagacacaggaaagccctttaataaaattcaacatcamcttcatcttaaaatctctccaactagatattgaaggaacacacctcaaaataataagagccatatttgacaaatcagcagttgctattatagagaatggcaaaaagctgagagcattccccttgaaaaccagcacaagacaaggatgccctctctcaccactcctaggcaatgtagtattggaagttctcgccagggcaatcaggcaagagaaagaaagmaagcatattcaaatagagaggaagtcaaattatctttgtttgcagatgatatgaccctttatctacaaaatcccatcgtctcagcccaaaagtttcttaagctgataagcaacttcagcaaagtcccaggatacaaaattaatgtgcaaaaattgctggcattcctatacaccaacaacaggcaagcagagagccaaatcatgaatkaactcccattcacaattgctacaaaaagaataaaatacctaggaatacagcaaacaagggaagtgagggacctcttcaaggagatctacaaaccactgctcgaggaaatcagagaggacacaaacaaatggagaaacatttcatgctcattgataggaaaaatcagtatcatgaaaatggccatactgcccaaaggagtttatagattcaatgctattcccattaaactaccattgacattcatcacagaattagaaaaaactattttaaaattcatatgaaactgaaaaagagcccgagtagtcaagacaatcctaagcataaaggacagagctggaggcatcacactacctgactgcaaactatactacagtaacaaaaayaggagggtaccggtataagaacagacatatagaccaatgaaaccgaatagagaactcagaaataagatcacatacctacaaccatctgatctttgacaaacctgacaaaaacragyaatggagaaaggactccctacttaatagatggtgcttggataactggctagctgtatgcagaaaattgatactggactccttccacacaccttatacaaaaattaactcaagatggattaaagacttaaatgtaaaaccccaaactataaaaaccctagaagaaaatcgaggcaataccattcagaacataggcataggcaaagatttcatgatgtagatgccaaaagcaattgcaacaaaagcaaaaattgacaaatgagttctaactaaactaaagagcttctgctcatcaaaagaaactatcattagagagaacagacaacctacagaataggagaaaaattttgcaatctatccatctgacaaaggtstaaatccagtcaagaggaacttaaaaaartttacaagaaaataactccattaaaaagcaagcaaaggacaygaacagacagttctcaaaagaagacattcatgtggccaacagtcatatgaaaaaaagctcaacatcactgatcattagagaaatgcaaatcaaaaccacaatgagataacatctcatgccagtcagaatggcgattatgaaaaagtcaagaaacagatgctggtgaggttgcagagaaaaaggaacactttcacactgttggtgagaatataaattagtacaaccattgtggaagacagtatggtgattcatcaaagatctagaggcagaaataccatttgacccagcaatcccattactgggtatacacctaaaggaatacaaatcattctattacaaagatacatgcatatgtatgtttactgcagcactattcacaatagcaaaggcatggaatcaacccaaatgcccatcaagggtagactggataaaggaaatgtggtacataaaaccataatactatgcagccataaaaaggaacaagatcatgtcctttgcaaggacatggatagagctgaaagcgttatcctcagcaaactaacccaggaacagaaaaccaaacaccgtatatttccacttataagtgagaactgaatgatgagaacacatggacacactggggggaaacaacacacactggggcctattggcggtgggggtgggggtgggaggagggagagcatcaagacaaacagctaaaggattctgggcttgatacccagctgatgggatggtctgtgcagcaaaccaccatggcacaaatctgcacatgtactccagaacttaaaggttgaaggaaaagaaagaaatatcaaagacttggtaatgtaaaaatataaggacagccaaaaacaaaagagagtctggtgcctccctcccgtctcttaccatgtgacaagccagctcctcttgccttcctctatgattgtaagcttcctgaggcctcaccacaagcagttgctggtgccatgcttcttatactgcctgtaagaccatgagccaaataagccctttttctttatttaaaaaaaaaaaagaaaaattataaagtacagaaagaaaaaactattaaccaagaattatctggcaaaactgtccttcaaaaatgagggggaagttatgacattccagggagcttgttgccactattcctgattacaagacatattaaatggagtcctttgagttataataaaaagatgstagttaactccaagccacctgaacatataaagactctccaataaaggtaaatagacrggcagacattaaaaccagtattattttgttkcatagctccactttttattttctataggatttcaaagaaatgcataagaagtaattataaatctgttagtgaatatacagcatatagatataattctcaaaccaataatgtaaagtggggatgggaaacagagtggtatacatgtagagttttgtatgaaattgatatcaaaattcaaattagattgttataactttgggatattatatgtaatccccatggtaacaacaaagaaaatatgtatagccaaagaagaatgagaaaggaagcaaaatttgtcactataaaaaaacaactaatcacaaaagacaacataagtggagggaattacaggggaaagctataagatgtacataaaaacaaataataaaatggcaaaagtaagttcttccctatcagtaattactttaaaggaatcaaacccccaaaggcatagattggcctagtagatgttaaaaataaaaaagacatgattcaactctatgctgtctacagaatacttgcttgagatctaaagaaaaaattaggttgaaagtgaaggaatggaaaaagttattccatgtaaataaaaaccaaaagctgaggtagctatactaaatcaaacaacatagactatacagtgataaaagggtcaatataccaagaacatataacaattataaacatgcatgcaccaaacatcagagccccaaagtatatgaatcaaacattgacagaattgatgggagaaataattagttctataatagaaacttcagaaacccactttcaacaatggataggacaactaaacaaaagatcagtaaagaaacagagcaactgaacaatactataaaccaattggagcaacagacatacagaggactccacccaataacagcagaatacttgttttttctcaagtgcacatgaaaaattatccaaaaaaggactatatgttatgccaaaaaataattcttaatacagttcataagaatgaatgtatacagagtatcttttccaaccacagggaaggaaactagaagtcaacagcagaagtaaactggaaaattcacaaatacrtggaaatcaaacaaaacacaaacagtaaatcagtcagaaaagaaataacaaggaaaattagaaaataccttaagacaagtgaaaacaaaaccacaacataccaaaatatatggagcacagagaaaatagtgctaagagaaaattttatggctgtaaatgcttacattaaaaaagaaagacttcaaatcaacaacttaacttcacaccttaaaaatttatagaaaatgagcaaactaaacctaacgctagcagaagaggataataaagattagagaatagtaaagaaaactcagcaaaaccaaaagtaaattcttcaaaaagactaaccaaaatagacaaacttttagctacattggcaaagaaaaaaagagagaagactcgaattcctaaaatcagaaatgaaaatggagacattactaccagtcttacagaaataaaaaggattggccaggcacggtggctcatacctgtaatcccaacactttgggagtctgaagcaggcagatcacttgaggtcaggagttcaagaccagcctggccaacatggcaaaaccccatctctactaaaaatacaaaaattagccaggtgtgttggtgggtgcctgtagtcccagctacttgggatgctgagggtcaggaattgcttgaacccaggaggtggaagttgcagtgagcagagatcacaccactgcattccaagattctgtctcaaaacaaaaacataaaaagaaaaagaaaaaagaaaccaagtattaatcaaaagtaaagtagactggaaaattcaatcatggtatgttcataaaataaagtgctatacatcaatgaaaatgaacttcagttatatacayaatacayagtaagaaaacaccaaatacaaaacaaacatgaaatatggttcatttatgtaaatttcaaaaacaggcataaactaaactgttttaaaagttaagtctcagtggttacatgtgcagatgaggaaagagactagagagtagacacaaagtaggctcctgagttgctgacagcattttatttcttcacgtgtatacaggactagctacataatttgtggggcccagtgcaaaatgaaaatgtggggctgcttgttcaaaaactataatgaatgtcaaggttgacagtagagcatcaaaccaaccacagtttccttctaagggggtagagacatccatgcagctagctttgcttctctacagttgtcccttggtatccacaggtgattgattggtgtcaggagcacctgcatatatcaaaatccacacaaactcaagtcctgcagtcaatctcacagaacccgcatatacaaaaagttggccctccacatacatgggtttcacatcccaagacctttggttgaaaaaaaaaaaaaatgtataagtggacctgcccagttcaaacccatgttgttcaaaggtcaactatactcactctatagtaactcactgagatatacttcatgttttaatcactttttttttttagagatggggtctcactatgttgtccaggctggagtgcagtggctattcacaggcatgatcatggtgcactatagcctcaaattcctgggctcaagcttactcttgcctcggctttctgcatagctgggaatacaggcatccaccaccacacctggctgttaatcagttttctgtatgcacactgtactgcacaataaaaagttattttttggccaggcacggtggcttacacctggactcccagcactttgggaggccaaggcaggcagatcacctgaggtcaagaattcaaaaccagcctgaccaacatggcgaaatcctatctctactaaaaatataaaaattagccgggtgtgatggcacatgcctgtagtcccagctacttgggaggctgaaacaggataatcacttgtacctgagaggcagaggttgcagtaagccgagattgcgccactgcactctagcctggtgacagtgagactccatctgagaaaaagaaaaaaaaagttatttttaaaaatacggttaaagagagaaattttagccactcaggaggctgaggtcgggggatcaattgagcctgggaggtgaaggctgcagtgagctgagattgtgccactgcactccagcctgggcaacagaaagagaccctgcctcaaaaaaaaaaaaaaaaaaaaaaaaaaaaaaaaaaaaaaaggtccgtttatgtgtattttacgatttaaaaaaaatcccagtcattggtgttaagggggctttttttttttttttttttacatttaccccaaccctccatgtgtttgtgaataatagtgtcaaactgggcccttcagagtccagaagagcaataattcgccttgggcacagctgtctgacccaagagagctacttttaccttaaatcctgctctttcagtggttcttaacctttgaggtcatggatccctctgagtacttgatgaaagctagagggaacctcttgctagaaaaaagccaataaacacaaaacttttgcttatactgttaaggattaacaccccagcaccayccccagtggaaccctagggatccaaagacccccaagttaagagcctttgttctaaagtgacctccatgggatgcgtatcctcttgttttactgaaatagcagatgttggctasatgttggctaaaggcctgctgcttttgtatttcacagacagttgttgctaggtgtatttactgtgacagggtcaggctccatgaactctggggaaagtttaacaatctccatgagcacatagcaagagaatatgagggaggactctgcatacctragtctgctttctgttcagtcatcctaggtttaacctgcagaaaatgaagccagggtaagaaaggatggagttggttatttggatgactttagcaagaaaacgataaaccatattaccctctctgcaccgaaggggtggagctatttaagggtcttcagttctaaagtctactgccacattcctagcatattatgccaaaatatctttcatatgattaatctgagaggagcttgackttctcttactggttctacactaccattagccatttgctggcagaatgcccacagaccacaggaaatctaaccatcccataaagaaaacgtatcagtgagtgtcttttagttagcccaaagaggggaaagatgaatggtctgagagcctccaacaagacctacacaaggatcgtgcatgccatgcagcccaagcacggcggcctccacccttgacttggctaatgtgcggtatgttacctttttctgctttccagtgcaatgggccttgcatcgggcctcacctagctgtgcaacacagacaagtcttctgccagacacgggatggcatcaccttaccatcagagcagtgcagtgctcttccgaggtaagagaaagccctgaatctccttttcccagccccatgtcaacagcacggaaagatggtgctgagtgaatgtttctcctccaactaacttaccacagtcccaagccctgcctgggactccatctccattcaccgcaagccactggcctccccagaggcagatgactcagtgtcggtcttgtgcttatctaatgggctaggctgggcttttctctcttagtgatgaagagtgcaagggtgttattcttctgagagaggcctcatacctcgagagacctgcactagccccagggtggtcaggaggtgaggtctgcacagcggccaccaagtctcaaaggctcaagcccctcactcttgttgatctccctctagaagttaggctaagatgagagcccttgttcctgagtctcaacctaccattcctatccagtccccatccttatgacacttccttatagatgtccccctggggcacggggactcaccacccccacctaagagcccagcctgtgagaccaggctctgccggtgtccacatggggagagctcattctttagtcatgcagtgagatccttattcattacagagaagagcagatggaggcccagtaagaggaaatagtcttcttgagatcatatggccttttagtaacagcacagaaatcagaatccaggtctagtaacgctgaaagttcttgaggaaccacctaacatttctgagtttgcagcactattttcacatctgccctgattcagcccccacagaagcaaaccttaaccctgccaccatcctcctgcaggcctgtgagcacccagaactgctggtcagaggcctgcagtgtacactggagagtcagcctgtggaccctgtgcacagctacctgtggcaactacggcttccagtcccggcgtgtggagtgtgtgcatgcccgcaccaacaaggcagtgcctgagcacctgtgctcctgggggccccggcctgccaactggcagcgctgcaacatcaccccatgtgaaaacagtatgttccaaccccaaagaaccttctgcaaattccccatagagcatcgagtgcagagagcagtccctgggaccgaccctgagcatagggcatggggtcagcttccccagggattgtgagctggtggtggagttgagcattttcagtggggtgcatgggtgtatgcagagaggtgtatataagcatgacagggtatgccccaagggcttccaygatctccatcctggccctgagagagccaggtgctattggcccagtgctggaggaaatcagcctccagttcccctgcagtcagtctggctggtgcccacagggtctgactcatcaacaactctcaggggccaggctactaaacagaaaatgctgttaactctaaaggagcacagagtgcctcctgctcagccaaccagatctgcgcccatcacacctctgcttctcacccaacaaggaccagctgaccccctccctcccaaccccacaggcatcccctggaactgtccaggaccccccagccttggaatttgatactcacttcactccttcctcgtcatcccaataccatcatttgtattccagttgggaaggagtttatttttttcttcctctgaacccaaatcagaggtacttacccatgagaaaggyggcaaagcttgaggcaaagagtaggaagtaaaaaccaaatgtagctgtgcagttttctccccaactgggcctcmctgagcaataaattcccaacactaaggcagacgccatgtaggcaaatagcccacttctttttacacgctgggggatggatgatctttgtactcgggtagtgttaacccatgtttgtgtcagtggctcaccatgctcagagagcrccaatattcaacgcacatagttaaaacttaccaaaccaagtcagcacaatatttaagaccatctagtctgtgccracactgaactagaacgtcctggtgctgtgtttaaggcatgatgggtagaaggaagagagactggagggcacatgaaaataaagcttaacagagaaagtaggcccaagtgcctggggatgggggcacccgacgcaagtctcacttcacactcctgcaaagtyggggaggatgcagtgctgggaaccatcttgaggaggagagtcatttacttaaaataccaaaacccacgggaaaaggcaggtttgcctagggggagaggtgatcacctaggagatgaggtaatcccaagaagatagagaaaacaggcaccttcaggaagtagagggagctgcagaaaacaagcagacagcccagggaggggccccatcattcagccagacagctgcaggctggtgccacccctgctgttggcagccttggggagcaagtggctgagctctgtcaaagttaggctggagagcggtggccaaggcagaccccaggatgtaccccagtggctgaaacccccggctgcacctcacacaggctgcgttcattagtctctgtttcacatctcttttctgtctcctctcccgaccccgtcctcctttcccagtggagtgcagagacaccaccaggtactgcgagaaggtgaaacagctgaaactctgccaactcagccagtttaaatctcgctgctgtggaacttgtggcaaagcgtgaagatagggtgtggggaaaaactctaccctggccacacgaaggactcacgcaaccacctcggacagaacctaagctttcttcattttatttatttatttccccctccccactccacacacacccttccaacctcctccacctccaccttcaagcataaggacgtccgcgtgttttctctttcagttagctggaggacaggatgttgggaaaggaaaggacagatgtctaaaggaggttgcagagcaggccaggcagacagtgggggctcccttgaagagcttcctccctcccaaacctgggtctcaaagacctagaaagaggcaggcacagcccctgcggacagcagggagccagaaggtttgtagcctattggtgcaaacattggacaaattcctgtgtctttcctagaagcgcactatcacaaacacaggagtgttttgctcctttgtctcctcttccccatctatgtccctttagtcacagttaggacaaatggggaggggacaccatgctgaggcagaaactagcccagaactcactcagttcttctagtgggtgagtgcagagagagaagaactcagatcaccagtagggagaggtaaaaaagcaaacaaagcaggctctaaggcacacaacattgcagaaaatgaggaagggaggggagggaagggacagaagcaaaaaggagcctgtggtgttccccagtggggcagggtgagcaggggcttccaggctgcatgaggctcatggaccagctctgatcccatgcatgtgcgcatgctcagagccctgctgcccacaacagagcactgcgctgcgtgggagtccccacttcccargctatcagagtcaacgtcctgcctgtgcagctgcagcaaagccagtgagaggtgggtctcgccatgcagtaaggccaccctggcacctctttatctaaatccgaagtcccctagccccgcactaactaactgctgctgtgggccagggccattttgagcatgaatggcccaggttttttgccttctaggacctttgctgctccaccgaagggccagggactatggttaacttatcaacatcaacccattaactagtcactgtgccagagagtatctgtcaggctgtcaggctgtcaggttgtagcaacctcttcattccagagctrgcccagggaccggggtgggacaatgggtttatgcgtgtccacagtacaccctccctctcccagcctccaccccagggtctgcaggtcctccggcatgtagtatttatctagcaaggcggggtggtggaggcagcaccctggcaaagcagctcacacactgcagccacactcatcagctgtggtgaggcggctggagcaaagtcaaagtcatgcagcaaaatgaaaactctgggactcttcggcaaaatcctcattaagccgagcagctttggccaagtaatttttgcctccttccctcgcgtggcctgagtttaggagcaagggtggccagagtcccttacccacagataagcctcccctcatgaaatgccactcaccccgggctaccattgacatcagggctgcatttccagccagcctggaagtaaaatttgagaggaagacaatattaatctgtgtccccacctagtgagctgtggacaggtttaagttgggtctccttcttcttcaccacaaaaacaggctctaagaaatcatgttactaaaaaatcagtgtaaagtctgtttaaaataaaaaagaatgttttctatgtctgtatatcttttgtgaatatttattaggatttcttattaaaaaagtgcaatattaataattgtacattgtcatccagaaacaaaactattggggggactttattaactaacttcctgcagttstkttcctgtaaactcagtagtgattattatatttttcctatttttaatagaacctggtgtttaactctggatccattcactgtacaggatgtgttgtaaaaactaacatgggatgctgaggcagtaagagggaattcatttgtggcataatagttatgcatggaatgataaagacagacaaattccatactactactaatgtggttaattatttctagttcgatagtgattgaaaatcagtggtcactatttacatttcctaaagagcaagcatcctccagctccatgttgggttggagcagttggcagtgggtctcagtgagctggcagaacctaggtttgggtgggaagcagaatgctcgttgcatgaaatgaatgtacatttaatgtttgttctgtgaattgcaactcagcagcaccacaagacaatgaaggctgctggctaatgtggaaggaggcactttctcctctaaaacacaaaactgtatttgtattttttgtacagataatacagcttatttatttaaatcttgtcgtctgagtctctgttaaactcagccttccttcccctggtggtttatgcagggagcaagagaagtccctgtcagttgggtggttcccagccagttatttgcgtctggctgaagtggaaggattgcagttttcatctttacacaggaagctgggggcccatgcctagaagtgctagctctgtaaataaacccaaagaagctgcgtttgtagatgtacacacattcaggctgagtgagtgcagccaaatgagacgacagttaactcactgacagccctatgtggtgggaagatggaagccacagtaccttcgggaagtgaagcaaacagggacatcgcttgggagagatgcagacttgggtgtggaattatcctcactcatcaggcttcctaccaacagagacacacacagcgggaggcagctgcatggtgaaagttcggatgtatgctattaataaagactaacacttatagatcacaactacatttaatcctcacattagccctatgattatctccatttacatatgggaaaatagcagcccaaagaagcccaaggtcacccagctgggggaactaggattgaaagtcaggcagtcctactctagccgaagactcgatttgacccaccatgctgcctccaaccccgctgcctgcaactgctgtgccacagccacctttggcacgcatgccattcttccctactgctttaaggtcggtcaatgacagtaacaggacattttactgaaattgtcactttctcctaccctaaaggcagttcttttaccatgatagcacttctagctccctatttttaaagcattttaataaaaacagctactgtaggaagtgcgggggggaaacaagcacacctgtagaactctttataaacaggccctagtgaaagggcagcatgttgccgggcggagaagatgtccatgcagagtctatggtgagagctgctccagaaagcccaactccagccggtctgccagcagctcgccccggcacaccacaggcctgtcgaacagtgtgaaaatataccagaaagctcttcttgacatttcagttacttttttaagaggttttaggttttgctttaaagaaaaagccaatgctaaaactatacctattcacagaccagcaaccaaacaatgtcttacagaggccccacggcaggagggaggagctggaaatgccagagcaaaaacccagtaaggctcaaatggtgggaagggccccaatacaatgtatgtaaatttttccagccaaaagcacagagtccttgcttagcctcaaagatttccaggaaatccctgatcccattaagatcagagtggtcgacagtcactgaatctcatttatgcctcagtttcttcttcctgcaacagcatacctcatcaggtagggctgtgtgaaaaccattagttaattcacattgaactgcttgaacccaggaagcaaaggttgcagtaagccaagatcacaccactacactccagcctgggtgacacagcaagactccatctcaaaaaaaaaaaaaagcttggggggtatctggcatatcatcgaagcacttattgactgttaattgctattatcatcagcatcatctaagttaccttggaagaaacagggagatgaagggcagggctgacagaatttttgatattttacattacttcccattgtcagctttgaaagactctcccatgtttccatttttaattgagaagaaaatcaattgctccttcaaagctcaatactacacaacagccaggcacagtggctcacacctctaatctcagcattttggaaggccaaggcaggaagatccctcgaggagtctgagaccagcctagacatggcgagaccatgtctctacaaaaaaatttttaattacctgggtatggtggctcacacccgtagtccccagcttctcaagagccctggagctcaaggctgcagtcagctatggccaggctactgcactccagcatgggtgacagagttagaccctatctcacaaaaaaaaaaaaaaaaagaaaaaaaactacacaaaagtataaacaagaaagacatcaatgaaccaagttctatgtgttggaagaaaacctatcaatccaggtagccaactcaaaacctcaccaaaaaactgacaaacttccagaaatattacctcccaggagaaatgttataattccaatgtactgcctagactcaactcagaacacccaaatgtacacataactaccatttccttcaagtaactaaaaagtatggagaaatattcattcatgggcaaatatacaagtaaaagctaaaactaagggtatttcacttgcaagtggttgagtttttcataaataacatgcagttatcccctcacttcatcctgcaaatgaacccaaagaaatagtccacctttattgatggttttcagctaaaatgagacaagttagatttcaatcatctgttagtggcattcccaaaagaattcaaagccatctacaaagggtcagggaatggtggggtagagaaaaagatggagcacttcagaagtaacctaatgaaaactgacctgttaggtgaattaacccagggaaggataaatcaggaaacaaaataaggcataactcccctttggtcttgtctctctgtgttcctcattttgttccgtaaacccactataacgtatagacttcaggattcagattcagtctgcactgaatgtgagttaaatcagagaaggttatatctacccacatcacatactgccaattaggacaatattggtgttgattgatgtaaggccttgaagtaaacagtaaagacttgaatacccaaagaattctacaatcctccaagtttaacctcaaattattgtctgctccccactcacccagttcacttggagatgcttttacaaatcaaatgtgtatgagcttgtcagagactgttctctttggccaaacctcagtttattcgtagcaccccaagattttcagctgttttgttgctaccccaaaactgaaaggcagatattggtaatcaagcctttgctaaaagaactgggctgctgccttgtcaactcgttttacaatttcactcagattctgtaaagcacctggtcccaaccaagcacgtgtcacacctctgataacacaatatacagatgtcactcacctctgtgttttcaaaaggcaaattccatctccaacctaggatttcccaggctgcccctaaasatatggtttatatgtgtataaacagaaattaaatgtgaggttttatgtgagtgaggaaaaagcagacagtcaggaatggttctcctgccgaacataaataatgtttgtttaagcagaatgcttaggagagcctgagagaytgcatgatcaacattcagaccagaaagcagaaagcctgggaaacctgcctccctctccggaacttcatgatggccagggtggctatcgttagaatgttacgttacaaatcctgtgaagcatagtagacaagctgtgaacaacttagttaccaggtgagcaagttgaggaaatgtctagtggtgaagcccaggagtgtagtgataaagcttggttttcttctcctaagccctgatcatcattttttaaataacagtagaagggccaggaaatggcttggctgaggctagtgaagaatggcaaaattgttcttcagtcacccatctacagacaatccctgaattacgatggtttgacttacaatttctcaactttacacaatggtgccaaaaaaatacacgttcagtatacttcttcactgacagtggggctatgtccaaataaactcgtcataaatttaaaatactctaagtcagaaacacacttttcatttctgatatttttgacttataataggtttatcaagacataacttgattattgaggaacatctgggttctgtctcatggctggaggtcagcatgtctcagtgccagagcacagggcaggtgccagctccatggactcctgagctgagtttcttcagcctgcacacgcccctccctactacagtgaagagattcaaggtaaccccctaaaagcaggcccccatgacctgaatcctccacactctttgcacagtgagggtttgccttcgtacttggccaagtatgaagcagggatggaaaacaaccaaagtcctcatctagccctggtggtcctcgctcaacccttcccagatgagtgtccatcccttctcatctcatcttcttctccctgatttctttttccatgacatacctttccttttcctcagagtttaacacactttgctaagcaccaactctgggctccaaggacacagggatgagagcctagtccctgctatcagggagctcacagtctaattgggaaacagacacatcccacagcaaatgacagtgtgtcctaccacagttatgaagtccaggttctgaggaatctccagctcttctccctcatttggccccttccacagtcagcacccagtgattgctctatttattcgtaatcttctctcattgaggcatttgcaaaggtcttctaactggattatttaaatctactctggtctctaccaatccactttccacacaacagctaaaactattgttatattgcctataaaacttcagtataaactgatatatatgtataaaattaacttaaatctgtactcttggggcagttagataacatttaaaacacccaatcataaatccaccctccagaagtggccatccgaagtatttcaaatattattatctaaatctgcactagaaagttcattaattatacaaagtttattagtcacacagtagtaaaatacgctgtgtttgaggactggagagaagaaacgaacatgactacccttgtacagataatctgagaatccagctactatcgtttgaacgtgcccctactcactccaaaattcagctgttgacaatgtggtggtattaagaggtgaggcttttaagaggcaatgaggtcatgagggctcctcctctcatgaagggggttaagctccctaaagagacttcacagagggagtccatttcctttctgcccttctaccttctgtcatgtgaggacacagcattcctcccttctggaggatgcagcatcaaaggcgccatcttggaagcagagaacagtcctcactggcaccttgatcttgaactttccagcctccaaaactgtgagaaataaatgtctgctctttataaactacccagtccgtggtactcctgagagcacaaatcaactaaaacaccagcaaacccagtagcctgatgatccaagtctagtgttg

SEQ ID NO: 12238 - DNA, 23597 bp, Homo sapiens
agacctaactgggagttgtaactataggaatggcatttaaagccacaaggctggatgaaatcaccaagggagagagtagataaaagagcagaagttgcacagctgccggttgacagatcaacaggagacatgggaaattatgatttggtggttgtgaaatgtccatggcacatggaagctgagcagtccccacccagagcataatatggaggaggctggaggctcttgttacaatagtttggtcattttttgcagggcataaatccaaaactatgtgtattttatcatttggcaatacttaaagaatttgaaataaacccttttggagtaatgagctaaaaaacaaatatttaatggaaatttaagtactgcacttctgttgctcaaggaagttgttgatgagcagatagcttgcatagaacgtttgttgacatttgcatcactatggggtctgtagcaatttcactgattgcaagaaaacctaagacacagagctgctactttagaaattagtaattttaagaacattgcaccaggctgggcgtggtggctcaagcctgtaatcccagcactttgggaggccgaggcaggtggatcatgaggtcaggagttcaagaccagcctggccaagatggtgaaaccctgtatgtactaaaaatacaaaaactagctgggtgtgatggcaggtgcctgtaattccagctacttgggaggctgaggcagagaattgcttgaacctaggaggcagaggttgcagtgagctgagatcgcaccagtacactccagcctgggtgacagagtgagactctgtctcaaaaaaaaaaaaaaaaaattgcaccctaagacacggttctcatccatgtagctgcaaaagatgctgatataagatcattctgagaggcatgacttttcccttagatcaaatgactgttctttaagttaactcagctcacatttaattccagcttttcttgtgcacgtgcaacagtggaagtgatggctgactgtgtgttggctccataagaagaacatcacagaaagcaaaatggtgccagctcaacaccagtatcctcggactcttcagacagaaaaacctgttaattccaatcacaattcattctttcattcagctcatggaagccaagcagggctttgggacattcattctggcaaagtgaaacaactgactttttgtgaatgctatttaagttgtttaaattttccacattggaaataaagtcattgcatttttgtgaggataaaacacaaattgtggtggagtccagcgtcatggtaacaataatattcctactaaattaagacactaatgaaacagaaatgtgattggaacaggtcatggtgcacacacaatttgttattgcatataaataaatgtcaatattctataaattgacatttatagacgtacgtgacaaaatttacaaaatgttaaaacatatgcacagatttactgaactacaaacttgtgataaagttgttcatgaatttttttaaaaaactggactttcacatgtgttttctcttttattttcccattatcaatcaattttagtggacattgagtctcagcatcctaaaatgttattaaacagtgtattaaaacagatctataaattttcgttgaattttgttccaaatcagttggaaatatttagtcaagttattcaatgaatagagcagcaaaacgtcaactttcaaagcttttagtgaattataaatattgaaaacaaagctggtatgcagaaaaattataaaatgtatcagaaaatgatcaaaatcaaatgctgtacaagagttaattttgaaattctaaaatgagctctggaacatttcagcttgtgggaagaatctttttaattggataaattcatgttctgtatgaaatgagatgaaattgagaaagccaatgattttttttttttttgcagtatctgaatctgacaaaacattcaaaacttataagtaggtacaacttatttgaaaggtttaatctggttaaaaaaaaatacgtgtgggctgggcacggtgtggctcatgcctgtaatccctgcactttgggaggctgaggcaggtggatcacatgaggtcaggagttcaagaccaacctggccaacatggtgaaactttgtctctactgaaaacacaaaaattagccgggcatggtggcaggcgcctgtaatcccagctacacaggaggctgaggcaggagaattgcttgaacctgggaagcggaggttgtggcgagccaagatcgcaccactacattccaaactaaggcacaaagacagcacctgtgaaaatatctgggctaaaatatttatgcaattccatatgcaaagaattggacttgagaacagcctctgcctggcagaatttgctgagagcttatcactcagaacctgcacagggaacattttctcaatatattatggttcaagagaagagtcaattgaaggtactaatttaaatttgttaattgtaaaatttgtggaaaaaagatttcaggcaattatatggaaaaattaaaaataacaagaccccactgaagaaaatacattcttgtgaaaaatgccagtgacagggtatcagtcaggtacaagaaactgtagcatgtgaatatacaacaagaacaattattttgcttatcttatttttaaatgttcagttgattaacataaacatgttttcttttgctttaatattcataggtgtatgcatatatatttaaagacttttttgaaaatagtttttatctagaactactttataacaccatcaatataatataaccattttgttggattttttccccttccttccttccttcccttcattccctccttctctccttccctccctaccctccttccctccttccttccttccttcctccatccctcccttcctccctcccttcttccctccctcccatcctgctttccttccttccttccttcccttccttctttccttccttccttctttcctctctctttctacctgtaaatactaatttttgggggaaataatttttgactattggggtgccccggcagtgtgcacacacatggcctgaccatccctctcctagctatctctgatgatggccaggaagctgaggtctatggtgacagaggctggcaggtgggaatctgtagaattccccggcgattggttgggatttctcagggagaaaggaggcgaggtcctgacctgtggtggaggggctggggcattgagagtttgagaagagatgggagggtgttgagcactgatatggtttggctgtgtccccacccaaatctcatcttgagttgtagctcccataattctctcgtgttgtgtgagggacttggtgggagataattgaatcatggggatggagaacaaagccaagccaatatcttgactttagctcagcgagactgagtttgaactcctgatctccagaactgtaagataataacttgcatcgttttaagccactcactttgtgataattaattatagcagccttaggaaaccagcacgggggtgaggytgcaccctgcccaggaagccagagacgaccagctacgcagggactttagctcgaacctgattaggtcagtggacaccgcccccatccccaggacggggaggtggctggggccactgcagccacagcatgtgtctgctcacatggggcttatttttaaagggattgtcctcacctgctgctgtctgtgtttataaagttggctagagaggagaaatcttcctttgccagttttcagctttagctctgatatttgcctggaacatagtaggtgctcaataaacaatatctctggatattgttagtaatatgtgaccctatttgaagaactcagaaggggcactgggcaagtctacaagagatggcaattctgtaattcctgtgtggtattttctgaattctgcacattttaacctaggctatgagacagtgtgactttcttcaacaaattagttaattcttcaaattaactccaatttcaacagcatggtgatgttaaaggcattggaaattcagccacagatgttaaagaccatcagcacggtcacatagtaagatgctactttcaagccacgaataacccaaccagttattggtcttatgaaatcttgtaagccatcccagagagactaatttaatttttatgattcagaatttgcaggctgtaactggtcagtccatgcgaactctggtggctgcattcagccctgacatgtttcacctgactttgatataaggagctactggaaccttcctacgagttctaaaacctttccctcctcctcctgttctggaaaagcaattaagacccaaactaggcatgaaataaaagtctcttaaattgatttagaattatttttaaaaagtaccctcacagaagtggaaaattttgccaataggtaggtgtaaaaggaagttttttgtttttctaagagacacagatttcctctcatattgtactctcataaaagaaaaaaaaaaggtggtcatttacttactcaggcagaaaatgaaggcgttcacaactgtagttgggttttctgatagtgagagctgcttttggaggagttttctcttctgggaagtgctgtggagatgtggttgctttaaattatataacctccgctccagtgatgtcattgtggggattgccgcaaaagtgagtctttcgggactcactccaagtggatttggaaggaaaaatccactctcatttcactttgcactttagggatgataagagattattcagctaccatctccccctttactttggtaccatctgcagaggtctgcaatcctgcccaagacctgtatgttggcaaacacgccctaaaaacatgttttgacatcgccaacttgccccaaggctcgcaaagtgtcagtgaacattgagggatggcttttggccccttcactattggcttctgaatgtctggggctctgcagcagcttttgtgggagccacttcgaatggcctcttttgaattttggtcatgaaagatacatcgccaagaatccatcagagtggacccatcacacaaacagagagctaggaaaacgtttgactcatgcaatgttcagagttgagtaagaccagatacattttttcctaatcctccttggcgtctctcaaattatgtctgcatgggtcaagttgaactactcaagacctcatgtttcagacagtaagatatttttggctttgagaatcaggtgacaagattctccaactgaaggccccttacctgtcaacttacaaattaagatctttccaggccaccccctacacgtaggagaactcattcatgccagaattcaggacttcgagtctgacttctggaaaggtgaccctccaaatgtttggagcagaaggtgtcacctctgtctttagaatcttgccttttgcttgtgttccctttttctgctagtgacatctcagcgggagccaactgcacttcaagttttcctgctgtcttctcctgttgctgaagaccttaaaactgtggaagtaggtggaacaaatagcattctgaggctcagtagcggatgtacatttcagggaagaagctggaatttgccttagaggataggatggtcccctcctatcaggagagacctcctgggtgggatttttaataaaaaaaaattgtcaacaggcaagcatcttccattactcccgggatagatctgaaccggaggaaggctccaaatcttagcctttcctgttacttagtaatgtaggcgggggtctctccagcccgtggctggcttattctcccttcagtatgagtttagactatactgtttctgagaagcgtttgttcttaggagatgtctccctgtttattcacccaggagtgcgtataaggccagctctgccacaaagagcacgtgcaggtctcatctctgctttgcctcttgctggaagacagtctgtgaagagagctggcctgagtgagctggacttcggagatgcatctggctgccttgccaaggtggtggagggcggaaaggaaagttctttaagaagacccacgtttccccttgttgctcatctccacgggaaatgcgagacaggcccgggctcaggggagcagagggtctcctactgtctctggggccaagggagtggggctgagggcagggggaggggaccccaaatctgtgaaagaaaagcaggtccctatagtgtggcagaagatagcaggggactaagaagtgggtaggcactgaggaccctcttctgaggcttcgcttgccttttttcttttttttttgagactgagtttcgctcttgttgctcaggctggagtgcaatggagcgatctcggctcactgcaaccttcgcctcctgggttcaagcgattctcctgcctcagcctcccgagtagctgggattacaggcacacaccaccacacccagctaattttgtatttttagtagagacggggtttctccatgttggttaggctggtctcaaactcccgacctcaggtgatccacccaccttggcctcccaaagtgctgggattacaggcgtgagacaccgtgcccggccaatgcttgccttttctgaatttagttgtttgtaattcccacagcctctataaggtttggttaaaccttacagtctgatgtgtgctgtgcttgatgaagtcccctgggtacttgggtgaagaggtggtcacagaggataaaggcctgcctctggaaatagaggacaggccaaccttccctggsgtgtcctaaatactagtgagggggcactccaggcaggctggactccctgtagtatgcgtgggcttgggccatactggatgtgtattcaagggaaggtgagctctggagtttgyggcccctggggacatgcagtcccagtgcccactgtgacatcaagggccacttttcagttctctcatccatcagtcctggagtttttttctcctttacttttctagtcatatccagcaggttcttcaaaatgaaagactctagtacatgtcacccagcagacctctacaaatagcacccagatgctgagcctctccagggttcgttcttagtccttacacgacatctgatgtctccagtattctcccaattgtagacggaggacagaaagccacagctgggcagaattcttgccaggatgaaatgcagcaccctcactgtggtccagctcgtgtcctttcacccccgaccaaggctgttggcggtcacacctttcttcccatcacagggtttagaaactcatgcaacgtacatacaagtctgcaacaaaggactgtaaaccaatctcctggctttctgattcctttccttcagtctatccttctgctggattaatattctggaaacacctggattttgtcatgccacaggacaacgacccaaccccttggaattcaagagctccccaacggtcttgctgtaacacccagagccaccctccatgctgagcgagtgactcatgggctctgaatgcatcctgcttgtgagcatttgctgaaaatgacctcctcctcctcgcactgttcagtgttcatccatcactcaagtcctggtgtaatcctctgcttttctctaagcacggggcctgagtgctttcccctttattttaaaaacacatatggagcacccagctggtgccaggcaaatgccaccctagaagagcatgcgtgtctagcacataggaagcggggaatggatggggtgaacagacggtgtctaagtgtaaggggggaggtaagcagaaaatcccaaatatacatttagcaaagcacaaacacttggagatctacaggatgacagggtggacatgarcacgtcctgggcattcaggcagctccaggtgctgccatggcctggcagccagcccagaagtgaagggtcctgggtgctggctctggggtgggaaggtgcccacttagcagataaagctccactgggccaggggttcctccccgcccttgtgtggccctgctttgggagatgaaagccttctcgcccaggcagagcagrggatcacgagaccttcctctttagggagcctcgagaatcccaggagtgcacatgctctcagaaggggcttgtaccaggaaaatcagctgcatttctctgtctcctaaagccgaagccaggccgtctcaygtctcttctcgaactcctctgctgctgtctcaggcccaggaaaacagagaccttacggcggcaaggttgcacatgcgcagacccagctgtcccccagagcacatgcgtagacccagctgtctcccagagcacatgcgcagacccagctgcctcccagagcacacgcgcaaacccagctgtctcccagggcacatgcacagacccagccgcctcccagagcactcgtctcatggtgcctggctgccctggcttcctcgagctgtgttttttgttttttgacacaaggtctcactatgtcgcctaggctggtctcaaattcctgggggcccaagccatcctcccacctcggcctcccaaaatgctgggattacaggcactccccactatgcccagcctttcctctctgttttgaatgtaccacctcctctcccacctcagggcctttgcactgtccgttcccctacatggagcaccttcccatcgagagccccatgcttgctcccccaggtccttctggtcctcaccaatcctcccttgtcagagagacctttcctgaaataacctctcctcctcttggcctgctccactgctcttcacagccctattgccacctgctccaccaggcaacggatttatctcttttgattaggttcatcttcccaacttgtacaacagggctgataagtagcacgtgctcaaatatttgctgagtgtattcataactatgtattacaaataagtatataatagcaatagcttgtcttatgtcaacaaacatgtgccaaaccccttgtgggggccaggccctgtgtgggcacagggggtgcatagacgaacacagcccactccgtgcccacttaaggagctcttgggatggctgaggacagggacaagctgacatccagtgacaacatgttgtagaaagcagagtggcaatgaagttctgaggctgtgtctgagtgtgaggtttgaaaaaaatgagttctgctcgaggtggagtgggatgggtaatttatgtgtcatgctgactgggccatggggtgcccagatatttggttaaacatggtttctgggggggccgtgagcgagtttaaccttcctaggttaatttgaatgattaatgtttgaattggtagactgagtaaggcagattgtcttccctgacatggtgggtggcatccaacttgtcggaggcctgaatacaaccaaaaggagcagcaagggagaattggttctctccgcctggctgttttcaagctgggacatctgtcttctcccaccttctcgctggccatcctgggtctctggccttcacaatcccactggaactacatcactggtcctcctgggtctccagcttgcagacagcagatggtgggacttctcagcctccataattgcataaaccaattccttataacaaatctatctatatttatctattttctgttggttatgtttctctagagaacctcgactattatgcagagttggggaagaattcatggcaggggattatttaaactaggttttcagggctgaataggagtttggaaggcaagcaagctgagaaaaccatcgcaggtggggggaccagcatttgtattataacgcacacatgttcataagcctttgtggaaggctcacttggaacttggggtcagaaagcccaggttcaagccccacaccccacttactcacgctatccatgaatatcccatatcccctaccctccagcaggccctgtgcagctcttggtttggttcagggaagagaattgaatgatagttttagcccagagtaagggtgttttgagagagcaggtgcataaagttttgcagctcatggaagcaatttccatttccctgtacttggagttttatagctctaactgcatgatctattctaaagataaatgctcacggcaggtggagcccacctgcagggcttccagaagagagcagggccggtggtcctggaatgctctggtcctgcctgcttctgagagttgctgtgaggatcaaataactgtgtgggaaatgtcagtatcgtgctgtatagatgttcccaggataagatgaatatgtacatgttgatgcatcttttctcagtattatgaccttctttcttaatctagcagcaagtgccatatggaaaagctctttcatcatttttcaatcagcctagatgcctaattaagccatgtgtacagcaaagaatgggggtatggaataagatgttttccttagraaccagtagttcctttatgatgttttaaagagatggaattggattaccrtattataaagttgatgctgtgagcatttatctttcatataaatcatattggtccccatgatggggatgcaaaactccggatccagggaaactgaaattgcttctgtgagctgcagaactctgagtataggggaactgaaattgctgaagataaccataacttttcttgaagacttggggtcattctygactgtcccagccctcatgggggctacagacttgggatagagacagactaacagagaaacctgtacaggatygtgattgtgagttctatgaagaaacagaacaggatccagtggtcttcaaaacagaaaggaatgaggctctgtacagcagttcccccttaggcatggggaaaacgttccaagacccccagtggatgcctgaaactgcagatagtaccaaaccttataacactatgctttttgctrtacagtaatggkgggtagcttatatagcatgggtacattggacaaagggacaactcatgtcccaggtgggacaaagcaggayggggcgaggtttcatcacrctgctcagactggtgcataatttaaaacgtattaattgcttttttctggaattttccatttaatattttcagacctatattggccacaggtaattgaaaccatggataaagggggggactactgtacttagggaggtcaggragacagtgagcaaatctgactgcaaaaacaagtsccgtccctggtccttaaggtctgatttggaagtccaggcaggcaggtgtacggtgtggagctgcctcagcagcgttgacaccctagctccgtcactgctgagaaggtgaatctggaccattttcttcttcctcttcttcttcttcttttttttttttgtgaaagagacaatttaatgggaaattatggtagaaagcaacacattttttgtgtgcaattggagaatctggaccattttcaattccaccttccagagcctcagtctgtaaagtggagcatgttgtagaatttggtaatcacatgggataatgtggtgatgcaactggcctttagtaggcaccccacagtaactgttcctgattttatcattttactgttgcacaagacgatggtagtgtcattatgaggagggcccacacacaccgtgctctgtcttggccagaactgaagagaggaaacagacactcattgctcgcyggctgagtggacggcaaagggtgactcagcatgaagggaggcatccagagagtctcagaaccccatctttgaccatctttcagggttgtctataagtagcctcccacctgggtggggttggtggctgggctgtctggaagctgggagctgggctctgaggccatttatttatttatttgaatcctggtctgagactctttgaattggcctgccttttggttctggggaaggaagaaagaatcagcagatcccaggtcctaggtccgcaaggatgggcatttacactcagcacccggggcccatgattcacgctctgggggcttgggctggcccgcaatatgggaaaggcctcagtatcttccatttgaaaaaaatcctctacaatttagtaagatggcatttggtattatttcttaggaaatctgcacgaacaagtatctctaaccctaaaaagacctgagaaaaacatccagtgtgccctctcattgttgagagaaggggcctgcaggtaccttaatgggcaactggatggtgagyatgtgctcaaaaagactaaaatacctgtatccatttgctcagggctccatacaaagtatcaaaacctaagtggcctaaacaatgaacatttgtcctctcacagttctggaggccagaagtccaaaatcaaggtgctggcagtgttggttcctcctggagggtctgaaggagaagccactccttgcttcttcctcccttctggtgattctgggcaatccttcacatttcttggcttgtggaagcatcgctccagtctctgcctccatctctctctgtgtctctgtgtgtttttctcctcttcttataaggacaccagttattggatttaagggtcaccttagtccagtacaggttggggatcccttatccagaaatgcttgggaccagaagtttttgtgttttgcattttgaatgtttttggattttggagtatttgcagaatacrtactagctgaccatccttaatccagaaatccaaaatctaaaatgttccaataacatgtcctttgagcatcatgtcagtgctcaaaaagttgtggatttrggggcatttgtgattccagatttttggattaggaatgctcaacctgtgtaacctcatcttaatttaactacttctgcaaagaccctattcccaaataaggtcatattctgaagttccatgtggacatgagttggggtggrgggatactcttcaactcatcacaacatctttatctcactgaatcttcacaatacttggatcttcatttaatagatgagaaaagagacactcagagaaattcactgaccttcttcaaattcccacagctgggaagtggcagaggtaagatgtgaaccaggaacctgcctccaagcccctgtactgttggtgctggggccttcgtaaactatagaggacagcatcaacatcacataaggcagtccttcgagaccactgatctacatgccagaaacctgttagagtcatgacttattatctctccacttgacagacgagmaaactaaggccaaaggtggtgggagggaagatgagtaaagtggcttgctgagatcacacaagtggcatggtagggaacccatggactggtccccaraattctcccccaacaattaaacattctagctcagtgttaggaggtaaaaggagctagacacaaaaggcatgtgttataggctctacagagacagcatcctacaacatgtgcctggcttctttcacaacaggtaaatctagagacagaaagattagtggttgcccaaagccatgaggaagggagaatgggaygtgactgttaatgaatatgcgatttcttgggggatgatgaaagtgttctggaattagacagtagtgatggttgcatgaattggttattaagtaaaagctgaagtgggtaaactctacggcatgtgaattacatccaccagctctgggaaggtgatctgcaggaagcaagtatgcacaaggcctatgagatgcaaagcttttattgtggcagaaatagcccaagccctgggtcataagctcgtcatgcaagaaggcacttcgaggacttttcctgtgacagaatttgtatcctcggtttgttaaggcatgaacaccccaagaacagagagaatttccagagcaccctccttaagaactgcatggccttggaaagttacttccctctctgggccccagtttccataccatgaaccagtgatcatgcaaactcccagagtggttgtgagcgtgaagtattttgatggggtycctttgacctgggactattttgcctcagccagcaaaacaaaataaaaaactaaaaccagaataaaactctcatgaacaaacgattaaactttcagccattgctgttgccaaatcatgacctctgttgctcatccctgctccccaccctmatccttggtgaaggatcagagctacrtaagggtcaggaattgggtaacaaggagataatgcagcacatggctgggatctacacaatggagacactccccctctgagtcatgaaggctgtgctcaagaggctccagcactagcatgaattcccatgaggtcatctggtgtccagtttgcatctctgcatcctattctcacccctctgtggccagggaagactcaggagctaggccccttgcctggtctcctgagcccacctggacttcttctcattgcrccagcttgctggagccagagagggtcaggagttgaggggctgctcctgttgcctcgctggggaggctctcccagcattttttttttctttttttgcctgctaagagccctgctcaggtttccaggcatgtggtttcccctggattgcagactmccttgagtaatgcaggcatctgtgaacaaaattccctggaggagtgagctcccttgggcacttgtggacaacttcctccaagttcagggcacttagtgagggggtgcagtctgggtgggaagagtgggcactggaggcagaatgaaatatcttctgggatctgtctaggttcttgtgtccaaatggctggagggtagagaatgagcctggagcagagagagggagacatagagacaagacagggaccagatcatgaagggtcttgcaagccatgttacagctgtagaacyttatcgcaagaggggtgggacactatggaagggtttcccttggaggatgcccccatcacactcactgccaacaccaccaccacatcatcatcatcatcatcatcatcatcathaaagctagtacatgttcagtgccaactatgtaccaggcactgtgctagatgctttcatacattaatcctattaacaattttatgaggtagataccattattatccccattttgcagacaaggaaatgttgactcagaaaggataactgaggtacccaagactacacagcaaataagagcccaaggctgaaccacaagtggaatccaggtctacctaatcctaaagtcttggctcctgaacacagttctctatgtttatagcctccccatgaatgtatttgcattcttaaaagaccatgttggctgcagagtgaagaataagaattgggasatggtagtagttagtattggaggcacccatgacagacgatggttggacatagaaggaaacatagatttaggaaacacttagtgagtagaatctaaaagaggtgctgatcctattactgggtatatacccaaaggaatataaatcattctatcataaatacacatgcacatgagtgctcactgcagcactattcacaatggcaaaggcatggartcaatgtaagtgcccatcaattatagactggataaagaaaatgcggtacatatacaaccatggaacactatgcagccrtaaaaaagaatgagatcatgtcctctgcgggracatggatggagctggaggccattattcttagcgaactaacccaagaacagaaaaccaaataccacatgttctcatttgtaagtgggagctaaatggtgagaacacatggacacaaagwagggaacaacagacactgaggtctagtggagggtgggggttgggaggagggagaggagcaggaaaaataactaatgggtagtaggcttaatgyttgggtgatgaaataatctgtacaacaaacccccatgacccaagtttatctatgtaacaaacctgcacgtgtacccctgaactcaaaataaaagttagaaaaaaataaaagaggtgctgacccaccagatggaacagatgaaggagagggtacgttgagcgatgagccccaggttyctggcatggatggatggatgcatggatggaggaggggcatttatggagacagactaggcaarttttgtttaataaatgagtgaaggaatgaatacatgaataatgaagggatcccaaagtggcatggataatgaattccccatcactgggagtatgaaacaagtggcttttcatcaggatattgtagaagatactcctgatttgaagggaagtcaagtggtaggcactcagtaagtctatattgcatgaataaatgattgaatcgctgctgcgcctatgattctaggcctcatgagggtctcacattcatgtagtgggaacttggtaatgagttatccctgcagaaatgtaagatggaaggaaatattcaagcactgttaatattttttttttttacatcttctttcttaaatttctactggttgattatattttagaatgtacatcttcatacagattaataagtatacatacygggtatgcataatcaattctttttttcctataggaatatacaatcacaaaagcttggagaccactgatctacatgccagaagcctgttaacagattgagcagaaatgaatagcaccccttcccaaaggcttctgagtgtgcaaggcggtaccccagggaccaaactcgggggtttcgggagttgtaacaaatgctagagctatgcaaaaacctcatccatttattatgctctacagaaaagacacatgtttacatgattttctcgtttggatgtgaaatgcttcctgtttacaacataacagctcattgagtctttcacaggacagatgttctttatcagggcatctacaccatgcatagggccgctcttctcccgcagactcagttgcccctcagaccaggtgtggatccccacatggccattgcggcagagctctgctcctaagagagtctcagaccatcacgtgctctggtgctgaatgactgccctgtgtgacaaaacacagcctctttttttttttttcattcaccatgtgtggcacagtttgacttcattctaatactaatactaaatggtttttacttcttctttcacctgttttcttcctccagatacttactgaggcagaggagagtgggtggtgggaaaaaagagtgggttgggggtaaggagggaatcttttttttsacgcttttgctttaaaattcagagttggattggtcaggatttatgggctctttgccatgtaaatttttctcattctccaggttctagccctccaggttcattccctccaggttctagcttgccaggttctagcctgccgggttctagctctccatgttctagctctacaggttctagcccttccaggttctagccctccaggttctggctctccaggttctagcccttctaggttctaacctgccaggttctagccctccaggttctagcccttctaggttctagccctccaggttctagccctccaggttctagctctccagattccagccctccaggttctagcccttctaggttctagccctccaggttctagccctccaggttctagctctccagattccagccctccaggttctagcccttctaggttctagctctccaggttctagccctccaggttctagctctccagattctagccctccaggttctagctctccagattctagccctccaggttctagccctccaggttctagctctccagattccagccctccaggttctagtcctccagcttctagctcaggttttagcttctctaggttctagcccctccaggttctagcccttcttggttctagcctctccaggttctagccctccaggttctagttctccaggttctagctctccaggttctagctctccaaccagctaataaatattcatttatcaagtgaatgagtgctgccctggcactgccgatggtgaacaccattgccattccttttcacactcttctagggctcatactgggccaccttccaataaaccattgattgacaggaacaatcccttggttgctgagacaggaacagtccctgagcaggcctgcactctcccccttcccaggtaccggctggtggtggggggtctcagcactgtgatcctctgggcaagaccgattagaaatatcttcctctgcctcatcacaaatcagactttgaagacatggccttctctccaaatgctcctgtgtgtgtggcggttggggcctcagggtggtgggaatgacaggtggaagggagccaatgagcacctactgtgtgccagacactggtgcttcacaccgccaccggctcccaatactgattctgctccacggagctatttctagamctcagtgtcttttccttatagtaaacatatcccagttacgtctgcgtaawgatgcctcacatgtacgtagcaccctttgcttttctaagtactttatacctgttactgcctttaaccctcacaacgacttcatgttacagaagagggaactgaggcagggacagrtggttgtgcaatagttattggttgagctggaaccttggtctcccccttctgctgtccatatcacccacagcaccctgctcgaccgtctcgtcgaacagctttctggtggtggcagtgcccagtcgttcccacttgagtctttgagttccttcaagatggagatggctccttctctttcttccctcttgcctacagtgctcaatactgcatatacagcaagtgctcaatatgtgcttattggattcttctttggcacagacctccttgtccatcagtgaggggagccataaaatcctggtctccaggttgttatcagggacccctcagggcttaacctttattaatgcaagaaattgtccttcaaagttctagctgaatagattaaagaaacccagggcaacaactcacttgtgcactcagccattgcaccaaagctggatggcagttctcctggagatctaagttgtcttgctggggcagggacggagaacacacgggagggaagctcagtcactcctctccctgcccccaggcctcctccactcctgggaaggagcaggctggctcaggtgtggcagcaaataagaacagtaatgctgttgtgattttggagtccttggctgtgcgtgagttcaccccatcctcacagccatgctccctgcaaaattgggcagggcaggaattagtctccggtgttttaccggagacatcaactcatttcccaaggtcgtgcatagatgtctccttggcattcctgggcccatgctgaaaagcaactgtccctcaatccttacacaaattcacagcagccctgctggcgtttgctcactgtctgctccctgcccagtcctgcagtttgtgaatctggcgttccacggagatggaggtccgcagtgtgcccatggagttctccatctgaatgggttctgacctgcagcccyctttctggcacactccctggtacacctcccaagacttctttcggaagcgcttgcccacgatcacgtacaccagtgggttgaggcagctgttgctgtaggccatgaaggaggcgatctgtgtgattacrtcgatgatgcgctcgtcctggcagctggagaggatgccgaggcgatgcagcgtatccaggaaggtgctgatctggaagggcagccagcagatgatgaatagcagcagcacaaccaggactagcaccgtggccctcctctcygtctggatctccttgaacttctgcatctcgttgttccgcagcacctgcatgatctgcatcgtgcagaaggtgatgacactcaggggcagcaggaagcccacgacattcaggagcatgttggtgaacacttcccagatgagggatgggtagctgatgacacaagcggtgacgttgtggccctcatcgctgtactccttcatggtccggaacaccagcatgggtgagctcaggagcagcgtacacccccagatcaccaagctgtagagcttggcccagcgcacgccgcgcatccggcccatggacatggttttcaccagggccaggtagcggtcgatgctcaccagcatcaggaaacagatgctgctgtacaggttcatggagataatggcattcaccacgcggcagagcgtctccccaaagagccagtcgaagttgttggagatggtgatggcccagaagggcagcccgcaggccaggatcaggtctgctgcggccaggttccccaggtagatctctgccaccgtgcagctgctcttgtgcaggcagaagacgctgaggacaaagatgttctctagggtggccagcacgaacagcacccagaggaaggggggctggatggtgttgagccagcccagccactccacttgggggcatttgctctgggcaaaggtcccgttaagagtgggcccttgcaaggtgacattgagcatgtcggcgctgaaagaaagtggaaaagaggctgttacccctcagggtcacaagggaaggacaaaaactggtccagaaggagacaggggttaaggacaaccagccagggcaaggagaagccgaggtggagctcaggctgttttctgcagcccgcgctccagtgcacctgactcccctgggtcttacagagccccctctgatccttggatctaaacgggggcctcatgttcttcatctcgaggctccactgggatatttccttggccagtatccaccaacagcactaacaatctcaagtgttggacccttgacctccttgaagcttccgtgatgggaggattcacattccttccttatcaaccggggccctcccaagggagttggtcamctttgagcctctcaaagccgtgtggtgggtgagttaatttattaaaagagaaaaatgatatcattccagacctggagattccagtctggcttggagaccatggccagcccatctgcctagtttctgtcttcctggacagtctgtggcatcgtatttccgtaccttctatcagcaaagcactgaagatgattggaggatacagatggcgagggagggtggggactttgcagccagatagtcctactgggttcacatcctggctgccttacttataagccgtgtgacgctggggaagttacttaacgtccttgaaccacaatgacctcacctgtaaaatgggagttaaaaaaactacctctcagggttgtgatagggatcagagacaatgtgcaaaatgccccaagcactgcactaggctcaataaacattagtaattaacaattcttgcaaacccattaaaataaccagtggtaaactccaacaccaccgtttgttggtgacctcatctttaacccactggctcctctttcattcttaggcaagactcacagaccatagggcaggcacctttctagacttgttgctgtaattcatctctaccttcagcagaggcgtggggcttggacagccatgagttccactcctagctgtgtggtcttgggcaaattgcttgacctctctgagcttctattttgccttctttggagtagggtattgctctcatcctgaatcgctttgcatttcttttttcatggctgttgcaacattcaagctgaagagtggatgcgaagacacactgaaaagtccaaagcacaacccagagggcaggactcattgggcattttcccagtgccctgtgctgtgggtgagagaaggaaaaggggctctttctggaaggtccactgatagtcaggctcatggaggaagagctgaactacgagtcacgggagagatactgatcatcacctctgggatttcccaggaaaagtccgtttgcttctaggagcagctggctggcatcctggagccagactgggggacccacaaatcaatgcttctatcctttaaatgttttttgagcgtctgctctgtgctgagctctgccctgagtgcaagaacacaaagaagacaccacccggcccctgccctgcctgactcctgacaactgtggcccagagggtggagggtgccctggagggagcagggggsttgtgggacacagacttggagaggrggctggtgggtaaggggytggaggtgactctagagctgggtcttgaaggataagaagcattttgacgggacaagaaggaggacaagtggaccaggcagggggaacagcctgagcagaggcacagaactggggaagctgttggtatgttctggaaagtgacactagatgttggacaggagaggtgggaagtagcaagaggttgagtgagggagtaagcgtggtcttcactgggtgctaaggaagtgaggctttgcccctgagtcttaaggaactacagtgatggtataagaagtatgctctaaaaagatccctgtggtgtgtggtggctttcatatgccccccgaattacttgatattcttcatttcaaaaggaggaatctgcttcctcttctcctggacgtgggctggacttcttactaatggtggcagggatggtgtgtgatttctgaggctaggtcataacatgctttgcagcatctttcttggccttttgcattgcttacttggaaggatgtgagccgccatgtgaggatactcaagcagccacatggggggaaccaacttgccaccttgaaagtggatcctctggccccagttacgcttttggtggctcctggtttcctagcctttgaatcttccaaccaaggccccagacatcttggaacagagataagctgtctctactgggctctgaattcttgacccatgaaaacttgcagcctcctttccagagtcctctgaaggtaagacttcccctgggtagtccccttggtccaaccctcaaccccatttctgtagctacagaaaacccatttcctgcrtacccctggcttggagagtctgtcatctttcatgagctaactcactagagaccaaagtatagcaccagatgctgcttattaatttctcagcaagacagtagccaaggggatggatcctggcccatccctggctctgagaagccatcggatcatcagaaagatgcctgctgagtgcggaattggaaactataggtccagtgcactgtggccccagctgagatggccatctgctcatcttcatcataggcagcacctgcagcagggtggagaggttggagtggacccctcagccttgtttcttgcaaatgctgtccccaagaacagatctccctatcctctgcttctactctggctcaggtcctcctccccctccccttaaattctctctttagggtgttctgatctcccaccaaatgtcagccatgtgttggagatattttgtctccaaggcaatctggcacattgctgtctgatccactgggtatttactttaatgtttaactctcttcccttcacttccaagttcatctgggatagatcacatatgacaaccaggaatgtgcccttcttctccctgagcccctcttcctctagttccgcagaacattccctctgctcccaacaggcctacagggacttggacacctgagaggttttgtctttgggcttaacatcactggttccttcaactgttgtccggggcatgag

SEQ ID NO: 12239 - DNA, 31156 bp, Homo sapiens
gggattacaggtgtgaaccactatgcccggcctaattttaattttttataaggtaaaatgtggatagatacgactcccataaacaaaagcttttcaggattctcaaccaattttaagtgtattaagatacacttaatgcactgtaattaagatacacttaaaaggccgggcacagtggctcacacctgtaatcccagcactttgggaggccaaagtgggtggatcacctgaggccaggagttccagaccagcctggccaacatggtgaaaccctgtctctactaaaaatacacgtggtggtgcacgcctataatcccagctactggggaggctgaggcaggagaattgcttgaacctgggaggtggaggttgcagtgagccaagacctcaccattgcactccagcctgagcaacaagagtgaaactctgtcttaaaaaaaaaaaagatatacttaatacactttaagtacaacttaatacacttaagtacaacttaaagtatattaagtgtatttttggtcctaagaccaaaagctttgagaactgctgatctagatgacgggacaaagtggggctcccgtctactcctctacccactgcccatgcttcacccccagggccccaccaggttgtcactaacctctcagcacactgggctgagggtaggatggcatctgacagggtcactttgctgtggaacggcccaggtctggtatggttacttggttggttggcaaagagaacattgtaatccacgcatcgaaggaggaaggttgtgaaggtgacaatgaaaataaattgtctgccgggaggaagggggggtgccgggatgctgcagtgatcagggacagccaggtgggctcctgccccagcccccagagcagcccatggttatcctccctgaccctgcccctgctgagcccttgggctgctcgggaaagcatgggatggaagcagctggcacaattaaggaagcaaaatgacagaaggaagccatgggcccaggggaccgagttccgggcccgggctaagcgtctcaccccagctggaagacatcctccagcaagatgcaggcaaagccattccgctggtggtagctgtagatgtggctgcgtgtcaaggaacaagcctgaggcacggggggcctctcctgaggacacctcccctcagccccaacaagtctcccacccatgacgccctcacggagtctccctgccaagaacagtgccagctccaagaggaccttcccatgccacctctgcaggcctagcgcaaaggatatcttggtgaagaaactgtccaggttctggatgtgatgccaggagcctgggcacagaggggagagtgtcagcccctggcatgtgatcaattctccacgttctcaacccgctgccagaggcccagcctggggtaagtactggagctcccaggcaccactaaccctctcccacccacacccacacacatacctcggagcccttcagggacatgaagcaggggttgctgctcctccccgtggatgggtgagtcttgggacccctcagggtcacagtcctccagccgctcataatcctgttcagggatcaaagggcctacccgcagcccaggagagtcctgggggcactgctgtgagggagtgggggttgccggggccaggggtggggtggagtgggatccccaggagggagatgcagaggcaggtgtcattgcaggttgagcctgtgttgggggggtggctgggatagggagagcactgtggcaagactgagaagcccctgtcccctgtagcactgagcaagggggccctgcggtgggaggggaaaatgaggagggggagcttcttgtatgaggggcaggggacagagagaagatggagatcctccctcccccaggtccccggcatgaaggaggaggaggaggtggcagtggcatggggaggaggggcaccgatccgggccccagatctccccaccgccccagccgccttcttctccccycccagcccattcggctcaccatcaggccacggcttctccagaaaggttggaaggatgggagctgttgttgcttccacaaaggtctgtgacactgagctgggacttcaacaggaacaatgacaacaacattactaggtgactcagcctaggcaggcctcaggcgtcccagctctcagtcacctgtctgatcactcacaccccttccagggcaacctgaggccaaatccctcagggcctgagaggggcatcagtttaagaggaggggccaaagagcacattgagatgagaagattcctattatctccatcttcagaccttgaatgaatgaaagataaaaagaacagcagccaaaatgacaaaagcaaaaagcaaaatcgtgttagagccaggtgtggtgatgtgtgcttgtgttcctagctactcaagagactgaggtgggaggatggcttggtgcaggttacactggaacagtataggttacagtgagctagatcctgccccctgccaccccccccaaaaacatcctattaaaggattgtagcagggcgcagtacctcacacttgtaatcaatctcagcactttgggaagccgaggaaagaggattgcttgaggccaggagttcaagaccagcctggggaacagaatgagaagactccatctctacaacaaatcttagggccaagatgttaactatttcatttcttaagagtgtacctcccccacttccctccacacacacactacagtgatcaacagagaaatgttttgtgaccaaaacagaaaagaagaagtaaaggggccaggcatgttggcttacacccgtaatcccaggactttgggaggcccgggcgagaggatcacttgaggccaggagttcgagaccagcctgagcaacttagggaaacaccatctctacaaaatctaaaaaacaaacaaaataattttttttctttttgaggcagtctcactctgtcacccagactggagtatagtggcacaatctcggctcactgcaacctccgcctcccaagttcaagtgattcttctgcttcagcctcctgagtagctgagactacaggtgtgtgccaccacacccagctaattttttgtatttttagtagagatggggtttcaccatgttggccaggctggtcttgaactcctgacctcgtgatccacccgccttggcctcccaaagtgctggcattacaggcgtgagccactgcgcctggtcaaaaataaattttttaaaaagaataagaaaaggttgcatgttttattggtctgaggtgctaaggaagagaagaggggaggctgactttgcagccaagttggggaaaactaagaagaggaggtgaagaaaggaaaggcagctatcttggatttgagagttggtttggagaacttagagtagaaaattggggttctctgaaagttccattccgtttgcatccttatcattttcaactgtgacattctctcaagtccggatcccacttctgggaccccctgaaaagcatcagggctgaatcagaagggaggacagctgtgagtctgggacttggaaggataatttggatacccagggaggagctgaactgagttccttgttgtcacctcaacaaggaggaggagacccaggcagctggtctggtggcttgcccaacgccattcttgaggccctgaatcaccaggtttccttctaaagcccattactgagatactgactcagccaccaggtgtcaaggtctctagggcttaggcctaagggctgatgttggggccagtacccctgaaatggcgatatggacactgtgcttcccagattgttcactggaggcaatcatggaatcacccacaaaacttgaatccagatgtgcctgattttctccttctgtgtggggtattgtagtagtagctcaggtcttgcatgcctttatctcagagtaggaggcagagctatgaaaacaagaccctgtccttctagaggtagcaaaatggaatcccacattgcagaggggccaggaaattcccataatctttctgagacatctgtcaagatgggttatgtggggtgttgtctagtctctcccccacctcactcgcccaatgtcactcagtatcgtggctattccaccatagtcacaataggacccccccatacaccaagagctccccagctcaaccccaaactaatcctgggacattgtcctacctagtttcaccctgaattcattctcattgacagcctccctaccaccactcccaattcaagtcgatttattttaaagggcacttttccttgccaagcatttggaagggaagaggacagatgaataaaacagagccactacccaagaagctgcagcccagtggggagacaaatacgcaaacaagtaattacagggaagaaacgagtggtgcaaactctttggcaggagcctgaggcaagtcattctgacccgggtgaggaaggtatctgcgaggcagacagatctgaggccgcgccttgataaattacaggccctccataccaatagttctcaatggctgaggcgtagggcaagagtgtcagaatcaccgggggagttcttccccaagtacacstgactgtggggaaaagaaagagagatcagattgttcctgtgtctgtgtagaaagaagtagacataggagactccattttgttctgtactaagaaaaattcttctgccttgagatgctgttgatctgtaaccctacccccaaccctgtgctccctgaaacatgtgctgtgtcaactcagggttaaatggattaagggctgtgcacggtgtgctttgttaaacaaattcttgaaggcagcatgcttcttaagagtcatcaccactccctaatctcaaaccactccctaatctcaaaccactccctaatctcaagtacccagacacaaaacactgcggaaggctgcagggacctctgcctaggaaagctaggtattgtccaaggtttccagcccgacacccataaagggtctgtactgaggaggattagtaaaagaggaaggaatgcctctttgcagttgagataaaagaaaggcttctgtctcctgctcgtccctgggcaatggaatgtctcggtgtaaagcctatctctactgagataggggaaaaccgccttagggctggaggtgggacaggctggcagcaatactgcttcttaaggcattgtgatgtttatgtgtatgcacatcaaaagcacagcatttttttttttaccttgtttacgatgcagagacgtttgttcacgtgtttaccttctgaccttctctccactattatcctattatcctgccatacccgataatgatcaataaatactaagggaactcagaggctggtgccggcgtggatcttccgtaaactgaactccggtctcctgggcccatttttctttctctatactttgtctctctgtctctttcttttccaagtctctccttccacctaatgagaaacgcccacaggtgtggaggggcaacccaccccttcacgtgacagatgtcccagcagttctgacgcacctaggagagcggggtgggtggcagggcatatgtacgtgttttgaaaaaactcccagtcgatttttgttcattcctcccccaaaacccgcgttctacacgcccttgagacgacgggacatctagagatcctggagccttgggaaaatggcccgaggtcggcggctgacgcgttactatggatactccatagcttggagggccagtcgggccacaccctttggacgtcacccggagcccacaggagcacctggcaaaagccaggcccacttcctgctcggctccgcccagagcagggggcgggcggataggcgattccctccaatcacagttccaaaaggagggggctgacaacatatcctccaatcacagcttgaagtgagattgatgtgtcttttcaccaatcaccgccaaggcgcgagggggttgtcgggatgggggcgggagccaacatagagccctcagtgggatgagggtgaaactgctattgccggcggctcctgttttaccgcgtcagcatgctggtgcatttatttcgggtcgggattcggggtggcccattcccaggcaggctgctaccgcccctccgcttccagacattctcagctgtcaggtaaaaacggaaaaacctactcagmgcgggccattgaccgcccggcagggcagtgccggcccgccgggagatggagtccacgagcttgcgcgaggcttgctgggagctgtaggccaggcctaccggggtggaatgtcactccgcgggtgttggcctcaattatttatagtgacactccagtcgccagcaggaggctcctgcgtctgcagccgcgtgtcagccagaaggaggggacgctcggggtcagtgaccacgcccagtccgcactcccgacygggggtcccctttcctggccctggaggtgattgcgcgatttggacgaaaattcttattagtatgaagagacatttaatgtagtggtgcttccaggattcaaagtgagtcgaagaagaactagagatgttcagcagggataaagagccaatctaataggccgggcgcggtggctcgctcctgtaatcccagcactttggaaggccaggagttcgagaccagcctggccaacatggcaaaacctcgtctctactaaaaaatacaaaaatttgccgtgattggtggcacgcgcctgtaattccaactacttggaaggctggggcaggagaatcgcttcaacccgggaggcggaggttgcagtgagctgagatcatggccactgcactccagcccgggtgatagagtgagactctgcctcagaaaaaaaaaaaaaagagtcaatctagtaacttgtacatgtgtgtttttcgcaaaacactctacacaggttggtcgagagagagagacagacagacagacagatgggaaacaaacaaggaccctgaaactacaactcgaatgtaaatgctttatgagaagggactgattcctttttttttcttttcttttcttttcttttcttttcttttttttttttttttgagacagagtctcgctctgtcacccaggctggagtgcagtggcatggtctcgactgactgcaacctctgcctcctggtttcaagcaattctcatgcttcagccacccaagtagctgggattacagatgtgcaccacacccggctaatgtttgtatttttagtagagacggggtttcatcatattggtgggcagactggtcttcaactcctgacctcgggtgatctgcctgcctcggcctcccaaagtgctgggattacaggcatgagccacctcacctggccatcctttctaatcctagagtgaattasttgggggccaaacagatagaagattcccaagggcaggtggatgtggagttgtgtcatttggaaagcccatctgactgatggagggcaagagctggatcgagctggagctggaagtcttggtactgggaagtaatccacatgctcttggcaacgaccaagactttcttagagtcttagtttggagacaatgcaagaagctggaaaaagaccatgctaaattattgaaaggtttaaaaacagttcttaggaaagagtaagggtgttgatgttatttaaaccagagagaaacccaaggaaagacataaaataatattcaagtatatatgtgttcattagtcagtatttttcaatagattatgaaatgcatttagttggtcaggaccatttaaaagtaaatataggctgggcacggtggctcacgcctgtaatcccagcactttgggaggccaaggcaggcgatcacctgaggtcagaagtttaagaccagcctggccaacgtggtgaaaccccgtctctgctaaaaatacaaaaattagccaggcgtggttgcacgcacctgtagtcccagctactcgggaggctgaggcaggagaattgctcaaacctgggaggcagaggttgcagtgagccgagattgtgccattgcgctccagcatgacagagcaagactccgtctcaaataaataaataaataaataaataaaagtaaatgtaggccaggcacagtggctcacacctgtaatcccagcactttggggggccaaggcaggcagatcacttgaggtcaggagttcaagaccagcccggccaacatggtgaaaccccatacaaaacttagccgggtgygttggctcacgcctgtaatcccagcactttgaggggccggggcaggcagatcacttgaggtcaggagttcaagaccagcctagccaacatggtgaagccctgtctgtactaaaaatacaaaaattaaccaggcatggtggtgggcgcctgtagtcccagctactcgagaggctgaggcaggagaatcgcttgaacctgggaggtggaggttgcagtcagccagcatagcrccactgctctccagccggggcaaaagagtgagaccctgtcttgaaaagaaaagaaaagaatcagaatacatgttaagaattagagaaaatgttattttgtgaagcatttccattttgtgtggcatgtatgtgttcattgtactgggttgcaagtaagatatgtttcttgctgtaggccacagtaagtctaaacatttgcaaaaccctgtagtagttaggtcagattgtcctgcacctctaatgagggcatgcatgtgctcaacaagcataaacatttgcggaacatctattatgtaccggagttctgccagtgctgtctaagatataatttcctgcctttcagaaacacatggcgtaatgggaaaactggacagttacacaaggcagaaggagagtaagcgtctctatctttctaatagaaacaagaacacagtggaaaacaagacataaaaacctggcagttggaatggggtgggagaaggcctcatgtaggcaaaaggcacaggccttcctgaaagcaggggaaggatgagatgaagactgcaattagaagggtctagggatgtgaaaggccatgatggtaaagagaaaagctcacactactctttttttaaacctttccccatcagtaagcttatctagatcttctagatctcaccatcctctcctggctggataacttctgctccctacaaccagtcctgtctgcctccagcccatgcccctctgctatgatcttttttttttttttcaagacagagtcttgctctgttgtccaggctggagtacggtagcacgatcttggctcgctgtgacctcctcctcccaggttcaagtgattctctgcctcagcctcccaagtagctgggaccacaggcacacaccaccacatccagctaatttttagtagagacaaggtttcaacatgttgatctagaactcctggcctcaaatgatccacccgcctcagcctcccaaagtgttgggattacaggcgtgagccactgcgcccggccatgctacgatctttaaaatgaaaacctaatcttggcacatctcggcctaaaaatcaccatgacccttattgccccccaagtccaggagctttataagaactagaaaactgcccctcccgcaagtctcatgtctcttttcccttcttgtaggtcaggcttcagccatacaattcctgaaatttctctcccatcctttcttactggagataccygcacttgcttttcctctgcctagagctctcccctttacactccacccccacctgtgcctggcctgttccccctcacaggttcccccttacctagaaggcctttcctgactccctctgaggagaaggaggagcagggcttcaagctgttttgtgcctctgatttccagttaactgtgagtctcccgcactcaagcatgactgctgtgaggggagttacttcagctgtcatgtaactccataactccgagcagagcacctgcacacagtaggttcaaaatgtgtagaataggccaggcacggtggctcatacctggaatcccagcactttgggaggctgaggcaggtggatcatgaggtcaggagttcaagaccagcctggccaataaagcgaaaccccatctctactaaaaatacaaaaattagctgggcgtggtggctcgtgcctgtagtcccagctgctcaggaggctgaggcaggagaatctcttgaacccgggaggcagaggttgcagtgagccgagattgtgccgcttcactccagccggggtgacggagcragactctgtctcaaaaaaaaaaaaaacacaatgtctagaatagtggaatcgatgttagcattttatagatgtggcagctgaaggaaagagaaggtaattgtcctattcaagatgacaagataagttattagaattcttatttttctctgtttcctccttcagctgtggagagggagtgtgtgtcatggcgccccaggccagggaggggaggtagggtaatgggcctgggacatcagaagacatggcacactggcagagtagagccagcctgggtgctggagtcagactgcagacttggttccctgctcgtcccagttctgctgcctgcggacaagttatttcagctctcttagctccacatgatttttttcatctgtcaggtgagaataatggcacctccctcccagggaggtgaggatcaagggaagtagcccattagctccaggaggtgrggctgtgtctgccctggtggctgctgtgagcaagtccagtgccgggcacaggagcagctctctttcctcacctctctgcaccgtggtcccttaaacccccggccccttcctgtccaggcagtgtgtggccatctaacgtgccatccagttcttcaggctgtcattctgtcagagcctggagtcgaggctgcgagggccctggctggctgggtgttgcctgagagttgcccaggggaataagacttttaagactagattttgtgctcagtgcctcattcctctgcgactttgcccatggacatgtcttagaaactgaagttgcttcagaacagccctgagaagggcaggggcaagggcctgacagaagaggaagtgctccttccagagggctcagccagagccccatgggtgtgctggtcagcaggagggcagtcggagcctcaagccatccatgcctctctctccttacaggtactctgatggctaccgcarctcctccctcctccgggccgtggcccacctgcggtcccagctctgggcccacctccctcgagcccccctagctcccagatggagcccctctgcctggtgctgggttgggggagccctgctaggccccatggtactgagtaagcatccccacctctgccttgtggccctgtgtgaggcagaagaggcccctcctgccagctccacaccccatgtcgtggggtctcgctttaactggaagctcttctggcagtttctgcacccccacctgctggtcctgggggtagccrtcgtggtgaggctttccccacttctccatcctggggacagggcaggacccagagctgcaaagggatggcattcctgcctcgctgcctctcaggggagagctcaggggagcagcaagggctagccaggggtccaggggtgccaggagcatcaacactgggtggctgggtgggcagggttccgtggggactggaagccagggtttgaacctctgagaggcactgatgtgtccacatgaccagccacaacctggacaagcgcagtgctcagtagtgggagaggaagggccaagatctggctggggatggggaggagtggctcccccacttaaaacatttgtsccctctgtctccccattccagctggccttgggtgcggcactcgtgaatgtacagatccccctgctcctgggccagctggtagaggtcgtggccaagtacacaagggaccacgtagggagtttcatgactgagtcccagaatctcagcacccacctgcttatcctctatggtgtccaggtayagccgggagtggggctggggaccgccgaggagccacccgaggcatccctgagtgcactgggctctttcgcagggactgctgaccttcgggtacctggtgctgctgtcccacgttggcgagcgcatggctgtggacatgcggagggccctcttcagctccctgctccggtactgccagcygcagggtgcagagttggggtgactgatggcctgaggggtctgggggtaggaccttatcctgaagtaatgtctccctcttctgccctccttattggttcttgtcccatgccagacaaracatcaccttctttgacgccaataagacagggcagctggtgagccgcttgacaactgacgtgcaggagtttaagtcatccttcaagcttgtcatctcccaggtcagtggcccagtggcccccaccacgtccacacacacactttcccatgtggattcaccaggccagcmctgcccgccccagccctgatgttgggctgacaggcgcatgctgactcgagaaacccactgcctgtgagggcatgggtgagggaccatggaagttcatggaaggaaagtgtagaggcagtgtccaaggtcaggacaggctgcttctccactgctctgaaaccgaatcttccctggaaagccttcccaagcactcagacaagagcctttcctggcaagagcaaaatcacttcgcctgccttgtccccagagtgcctggattgctgacaagcattgagcatgtgcagtggcctaccgaacacagatgccctccccttatccgcccacaccgactctgactgctggatcatgccacacactggcctaggcagtcactggtgtacccccatgcagttctctttgttcagttcctagaacagaaagagaagcaagctgggatttgtctaggggaaggatgccacagttcatagcattctcgctcrgccccctcaggcctgctgctcgcaccccaactggccgagttagggttacgtactgtgaccggtggactgccactgggcctcccaggggccaagacctgggccttggccgtgggagtgcagagctacagtcagctgacccttggaaaagtccttcctgtcatggtgcrgacgccgtagcctcccgccttccctcccactccctaggggctgcgaagctgcacccaggtggcaggctgcctggtgtccctgtccatgctgtcgacacgcctcacgctgctgctgatggtggccacaccagccctgatgggagtgggcaccctgatgggctcaggcctccgaaaattgtctygccagtgtcaggagcaggtaccggcattcctggccatcctcttcaccctscccacaccgtttctctttccactccccggaactcctccctgtccccatcctggactccttgtcctgtttyctggactccttgtcctgtttcctggactccttgcagatcgccagggcaatgggcgtagcagacgaggccctgggcaatgtgcggactgtgcgwgccttcgccatggagcaacgggaagaggagtgagtcctgggagggcggagcacaaagcagagatgccccccacaccctgccaacccttcgtgccagcccagctgcctcctgaatgcactggtctctctcaccaggcgctatggggcagagctggaagcctgccgctgccgggcagaggagctgggccgcggcatcgccttgttccaagggctttccaacatcgccttcaactgtgagtgagccatytgggggctggaggggcgcttgtgggctggggaggagctgggagcagccaaggcaggcaaaggccctcccttcatctgctggctgcctgcattcgcctcgggccagctgctaactcttgcaggtaaagggagggtgccgatgtcccaacccagctatgggactccatgtggaacgctacagggccaccctcaaggaggccatggaggcgtgcccaccccaacttgctcttccgaggaggaagccaacgctgggaccagtcatgcgcctcacctgactctcccagtcagcagtggcagagcaggcccagggctgtttcctctgccctggcttcgtcctccctcacttcccctctcctgcaggcatggtcttgggtaccctatttattgggggctcccttgtggccggacagcagctgacagggggagacctcatgtccttcctggtggcctcccagacagtgcaaaggtaagtgggggccgttcccattgctacagagccccctgccgccctccagagccctgctgggttaggggacacgggtgccagccttctctgggggccgactgctgtgcagctccaggcctgcccagcttccccagggatgcatagggtggggagagagagcccctcagggcccataacaaccctcctggctggggcagtggcgctgcagcaggcaggtgcttgtcatcttcagccttccaaaggacccagaagtttccttgacaggctttttaaaaatttgtttcaactgtggtaaagtacacaaaacataaaatacagcattttaaccattttgaagtgtgcagctcatgggcagtgggtgcactcacattgctgtgcggctgttgtcaccgtccgcctccagaactcttacctggcagagcggaaactatccccatgacatgggaatccccatttgccctcccccagcccctggcacccaccattccactttctgtccttatgatttgacaactctagggacgtcctctaagtggagtcagactatgtccttttgtgactgcgttttgtcactccacattgtgtcctcagcttcctccgtgttgcaccctgtccgaattcccttccgctgcaggctgtgacaytccatgcatggaaggaccatccttgacaggctgtgtgagctgcccttccccatgcctgccacttccagggatgacaagctgacccctgtccccacacaccccacccttatagcttattgctttgcgttggtccaaaaccacccgctcagctgagcctctgggatgaccagagctgatcaccagacagctcaaggcgggcctcccccctcctatctctttccaagctaaacacaagcagttctacataaatatgttatggtaaataatgagatagtaaatatgctgtaacagatcatcaaagggtgaagacccgtctccacgaaccgtgcatcacctctgccaccccatccctccccccacgacccccctgctcttccaccggggcccccaccccattctactgaggcatgtgtcctcgccctgctgcatggtgcacccctgcgtgtgtgtccgccggatcagaacccctcactgcagggtgtactgtcccaggaagcgggaggcggacggagacaggctcccattttcagccccaaacctgacattccacagagacgttcctcccatttccgcagctgcatggacaycctcgcgtgccccrtttctgctcgtgctccctaatctgagcaccttcagaccctttctggtcccgggctcaggcctccttggcagcctcgccctcctccagcccaaggagctgttctgtcgtggctttggaattcagatgctctcactgtgatagagatggggtcttggggggctgggagctgttctgtcgtggctttggagttcagatgctctcactgtgatagagatggggtcttggggggctgcctccaccactgcctgccctgctcagcgctgacccacttcccttgaccagagttttggcctctctgaatgggacggtcgttttagtcctgagggcccataagaagcccagtggcggctgggtgcggtggcgcacacctgtaatcccagcactttgggaggccgaggtgggtggatcgtgaagttaagagatcgagaccatcctggccaacatggtgaaaccccgtctctactaaaaatacaaaaattagctgggcatggtggtagtcccagctactcgggaggctgaggcaagagaatcgcttgaacctggtaggcagaggttgcagtgacctgagattgcgccactgcaycccagcctggcaacagcaagactccgtctcaaaaaaaaaaaaagaagcccagtggctcccttaataaaatcaccccttagccctctgtggtgggcagtggtgggacagtctccctgtggggagggtggctgcactgtccagccccaaccctcccgcttcgggacccccacttcccctttagggcctgagactctgactttacctcccaccgtactgcttggccatccagcagctttatgacacacacaagaacccccaggggcttgtctgtgctgtttcgctggctgctcccacagccacaggccctagacccatcctcttggaggtccttctagcgctgcctatgtggagattcttccccactcatcttgggggtttggatttgttgcataaagcagctgatgtgtttcccacagggtcctgccagctaagccaagggcccatgcattggcactggggtctagcagagagaggggagcaggatggcccggcctacctcaggcagcctaacctatgagcccatcctgagtactcctgatggagatggggaggtgcccagacagacagcaagtggggcccagccgcctcatcagaatcagggccaggctccacctgggaacaggcccgtagcctacagcccacggcccctgagagcagggtcatcacactccaatgagtcatgtgcattttgaatttcagttgctgcccagcccctttgccaggccctaatgtcttccagatctctggtggagaatgtgcccctgctcatcaacagatagctggctgggctggctccttcctgcctggtgcctccccmrgctgcctttagcaagtgctgactgcactgagtccactgggaccttttccttttgggtttcgaggctcctcccactcacccccaccctagtgctggaagaagtgagtctgcagctgaagggttgctggggagtcagtctttcctcttacttaggaggggaccaggcatacacacactgtcacaggtcagccaggccagtcagggaccagtgactcaccttcctcctcagcctcctggcagccggccagccctaccccggccctgccgggacgaaggaggccacccactgtctagacagataacactgtgggtatacttatctgcagggcaagctcatgagaaaaatttttttcagggaattttgttttggggtctcctgagagttcccctgtggcccagtgtcttctgttttcttctttctccaaaaagatttaacatcacttcttccacctaaatgtctgccaaagtcattgcttccccaagagtctgcagcattagatctgctctccccttctaagccacgcacccttgatctctgttcatggtggcggcctccgcatcctcagggccgagcagggagtccrtgggtcagctgggctcccttcctcgtgggctgatatcaccgctgcatgtgtgcacaggcctcaccctgcagaccacaggccagggcactggaggacacccacagaggcctgtgccttcacttccatttcctcgtggagcaccccctcccaggggcttgggctgagctgagggacagctgtcatcctcatctggccaaggagggagccagggctcagcgatctggtgttgctacgtcccagggctctacgcccccatggtgcaggagcagtctctgcatttggccacaggccacctgcttccttgctcccccgccccaccgtggcttccttcccctcctctggctcttcttgttcccatctattccacccctctctcctttttctgacaggtccatggccaacctctctgtcctgtttgggcaggtgagtggccggtagggtggagggcctggggtgtggagtttgtgccgtgtgtgccgctgtgggagctgcctattgactgggtgtgggcgggcagaggagctggggagaccccagcccagagccatggccactccctggagatgctgttgtcacccctaytcctgcctccctgcggactttggatcccctcccacaggtggtccgggggctgagtgcaggtgcccgggtctttgagtacatggccctgaacccctgcatcccactgtctgggggctgctgcgtccccaaagagcagctgcktggctccgttacatttcagaacgtctgcttcaggtcagcacgggtgagcaggcgtggggatgggtccctgggccggggatgaggcgagtggattcgggggtggaggtctggactaatgtcccccataaacaggccctctcagagggctacagggagacttcaggagggacccgggcaacaagggctgggagcctggtctgactgggggtctctcggctcctcccagctacccctgccgccccggcttcgaggtgctgaaagacttcaccctgacgctgccccctggcaagatcgtggccctcgtgggccagtctggcggaggtaaggggagcccaccacctcttcaccctctgactcttctctagcagccactcagagcaaggccgggagcagtgagcccccggtggggtcccttcctccactgccacaaggggccttctttcctgggacaatccctagaatccctggcctccctccctctcaacccaattccccaggaaagaccaccgtggcttccctgctggagcgcttctacgaccccacrgcaggcgtggtgatgctggatgggcgggacctgcgcacccttgacccctcctggctccggggccaggttgtcggcttcatcagccaggtgcggggccacatgggcagcccttggctcccactgcccgtcctcccctgggccctgcccccttagtcctcaggtgccttttctttctttcccaccctcatccttgctgctctcgggagaccctggccgtcttcacatgtcctcagctgttgtctgggtgaggcatccctgtcgtgggagcagccacagctctgcctggtctcccagagcagggacgctttgtccgcatttacagcagtctacacagatggggaatccctcagattctctgcaaatcccatagcatccaggtctagagaagcctatagtggaggtgctgagctgcagccgttctccctctgcttgaggtggcactgcccagcgagggtccacccttccctttgagggccgtgaatgaagagggcatgcctgctgtccgccagggagagtgcctgtgcagaagaaaggcaaatgcaagcccccaactcccagcgccctgccctgccagctcctcccactcccactcctggggagggattctgggcccttggtaggaagtcgaactgtccttcccttttgggggccactctgcatcctcacttcacctctgactttgaacgtctgattcttcaagagatcctaatctaatccaccagatagactgtcccattgtgtatggtggcccctccagtttctggggcaaagagaatgtttctatggactctgtctccataacccctcacccacaggagcccrtcctgtttgggacgaccatcatggaaaacatccgctttgggaagctggaagcttscgatgaagaggtgtacacagccgcccgggaagcgaatgctcacgagttcatcaccagyttccccgagggctacaacacggtcgtcggtgggtgctcgggtctgccgggaaccaggtggtgaggcactgggacacaggattccacaggagcagtgagcagcccagtgggactgagggcagcagggacagctggggagaaagacagttgtgtcagggaagacsagaaccacagccaaaggggacagagtcgttgtgtggggacaggggagtccaggccagtgtggttcagaaccagcagaccaggcaggctgcagagacaggacgggctctaggaggagctggagaatgcgacagagggcatatgacaggctcctggccagggacacagtgatgcatggtgtttggagtcctcaccgagtctaaaaggccgccacttccccagactgaacagaagaaatggggggctgcctcctctccaccatccatccccctctggctcctgtttccttcctgtgcttttcatctctaaagtcgtttctcattagaatcggggtgactggatgggccccaggagagggctctggtggttctgaactaggaacacgcagcctggcactgcagggcgtgcaccttgcagcttgacgtgcggagctcccaggtctttttccagccttcggggccatgtttctcggccagtgtcttggctctgttgcacagtgtttcagcacttctcaggatacagggatacctgggcttctcaactctggtcagtctgagtccagccttctgagctgtggggccagtgtccccagcccagccatcgtgttctagatggctcctccagccgtgttgatacactgtccagatgccagctgtcctcactgggtgctctcccacatctcttttgggtggcactttccttgtgtctctgatcctagtactttctgctcatttgggccttcttggggctgcgtccttactgacctgtcaccctgctgtcaccttgaggttctttttggctcccaggctgccacttgtgctgtcctctgtgggcttcgaatcccacctccctggagtcactggaccccagagcccatgtttgggtgctggatgttccccacagccacagagacccgggaggctgggaaggtggcttggaactgcaggcacagggcagggtgtgggtcatcctggcctgaggcactgccatggctggggaggggcatttggcaactcccttggagtgcaccaagccctgctggcggtgtcacaccaccctcagaggcagggcaagtgtgcacagtggctgagggacccagaggtgggatgagccagtgcagggggaacccagaggaggagtgtacacagtgtggggtggggggtcagaggcaggaggagggtgcacagtgcggggtgggggtcagagacaggactagggtgcacagtgcggggtggagggtcagagacaggactagggtgcacagtgtggggtggagggtcagagacaggactagggtgcacagtgcggggtggagggtcagagacaggactagggtgcacagtgtggggtggagggtcagaggcaggactagggtgcacagtgcaaggtggagggtcagaggcaggacgagcgtacacagtgcggggtagagggtcagaggcaggacgagggtgcacagtgcggggtggggggtcagaggcaggaggagggtgcacagtgcggggtgggggtcagaggcaggaggagggtgcacggtgtggggtggggggtcagaggcaggaggaggatgcacagtgcggggtgggggtcagaggcaggaggagggtgcacagtgctgagaggggcacttagaggatcttgatgggcgttcaggaaggaccctgtgcccctttgtgggccaccctcaagtgcacagcttcaggctcctgccctgcccctcccttcccaggtgaacggggcactaccctgtctgggggccagaagcagcgcctggccatcgcccgagcccttatcaagcagcccacggtgctgatactggatgaagctaccagcgcgctggatgcagagtccgagcgggttgtacaggaggccctggaccgggccagtgcaggccgcacggtgctggtaattgcccaccggctcagcactgtccgtggggcccactgcattgtcgtcatggccgatggccgtgtctgggaggttagttgtcctgggggcgtggatcagtgggttgaggatggcttcatcacggacagtggcacaatgctgcaatgagttatatgaagttgtggcctggccccagggccttgggggctatattctggaagcagcgtcccatatagagtcaggagttcctgcattcagccaagccctggcctctcaggccctcagtttcttcttctgtcccctgggatagtataattgcaccatcagctcccaggatcaaaaggaaaagtactagccgggtgcctgtaatcccagcactttgggaagccaaggcagaaggatctcttgaggctagcctgggcagcatagcgggaccctgtctctacaaaataccaaaaaaaaaaaattagccggatgtggtggcatgcacctgtactcccagctactctggaggcggaggcgggaggattacttgagccccagaggttgaggctgcagtgaacaatgattgtgccattgcgctccagcctggcatcagaatgagaccctgtctcaaaaaacaaaaaggaaacatactcagagtatggtgctgggagcaaggagcagggctagctgcccagggtatcaggtgcaggagaagcagcgccaaggaacctgtgcagggagtcaggagtaggaccccagaggccgtgtggcgttggctaacagccactcattcaagccaaggctgaggggctcgtgcagggagacggatcctgagttggagccttgggctctgtragggggacagagggaatcatgttcttccaaaattcagctaagtaaggaagtggcagtaactaatgcagcatgccagtggcggttcctttcagattgggcattggtttcagagtgtccccagaagggacaccggcctaagtgaccatgggcccaatggctgatagagaggctcagctctctgagggttctgaagcctgcatgccttggagcaaccatccgcccttccctcccatcttccaggctgggacacatgaagagctcctgaagaaaggcgggctatacgccgagctcatccggaggcaggccctggatgccccgaggacagcggccccmccgcccaaaaagccagaagkccccaggagccaccagcacaagtcctgagaagggccccctgaggtgtggtcgctgccaagcatcagtgttagggctggggctcagcctgggggagcctactggggactgagcccccaggagggccagcatgtggagagtcgctgcggctgctcctgctcacaataaagccggggccgagcagctggcaggggaggccaatccctccctcccctccccagtcctgccggctgcctccctcccaccagagtctgccagagtcattgggctgcaatgggcagagacagagttccmcgagacacctccactctattctccctttgcccagacccctccagacctctcaagagacgttctggccagtctccctgccccacccagcagcttcaaattggccaggcctacagtagctccagggaatttttaaaaatcagggtctggaagtgggcctgggaattcaaacctaggctcttcccacacccttgctaggacctcacttccctagactggcgactgactccctctcctgtgtccccactccctccatgggagaaggagcctatcccctggctcaccccrggacccacagtccccatcttccaaacaacctccctcctttctccctgcacagtgaacacagtcctgatttctagatttcacctcccctccccacccacaagggacacaggcctaacagggcccaacacttgggtcagggtaggagggacggggccacaatggccagttcccacgagaagcgccagcctgcctggctgtcttccaccggccctgccctgtgtgcctggcgtctttcacccactgagattgtgaaccagcctccatctacaccaagaacacccagcactgaaggagatgggaggggctgatgcccacctggagctctctgcttcctgcccacagtgctgacgagtacagagctaaatggagcagctactgcagaatccagtacagaatcggtccaggagggtgcggctgtggacaggccagcatccccagcaggttctgggaggcgcaccttgaaaggggaaggcagacatcctgagtgatgggcgcctgtggccctgagactgtggatgagggggctaggctccagctggcttctgaggggcctggaaaggcacacaagtaggtccttggctgaactggtgccccagcaggacctcgtgtccctgcactgctgcagatgcatcagccctccccatgttggtgccgctgtcacttcctactgggatccttcccctatccagccacatccaggctgtgggactacacggtgccctgttcccctgggcaggagaagaggtggtacctgcaatgcaccttcacagccaggcaagcattctggatttaccctgtgtaaagaagggtggtaccctctttcaggggtgtgatrcagtgcattgatggagcagctggtgctgctgggaggccagcctggaagaggcagcagtggctcaagtttgcgtgcaggagccagagtgggacccacgggctcttgtgggtgtggtttagaactagatggtgctttggggacaagccatccaaaaaccccaggcccacatccaccctgatttgatatcccacttcctgacagatcagaggctgtgtctttargcagtggaggtccaggagcagagcctggggctggttcacagctaaacccctccttagggcagcccagagtagggcctcagctggcaagtccacaagccctgctggggccctgcttgttggcctgacccctccctcaccaggcagccagccaaggtggttcctgcttcacccactcagtcatcagcctcaggctgcccaaaatgcctctgacaccagatttatatcttctgggcggcttctttaaatccagcccttcacccgccccctagagaagcagtgaaaccccttggctagtccagctggaagagctagaccgcaggagccgcgccgtcttcctaacctcgcctcggccttcgctccacagtggagagtgggagcctagctgtgcttgatgctgaatgcctgttttgagagtgtgagtgggatcatctacagtaaatacttgcaaagcatggcactgtggctctggggagctggtacgcctgtgctgtaaccatggtactcagtccttccaaagtgtttattaatcaagcacctgtcatgtgccattgagcccacgatggggaatgaggacagtccctgcccccatgaagcttgtgtcctgttgggaggacagacaggtggcccagcagttgcagcatggtgtgtgcacacgtttggctggtggaaccatgtttctaccactcatggtcaaaaaaagcccaccaaagtcctgggagttcacatctgtgtgatgatacggcaacattgtttgtaatggaaagactggacacccccagtgcccatcagtgggggagtcattaaataaactatggtatgtgcacataatgggtggtatgcagccctttggaaaaatgtaggttttccaggtcctggatatagcagcgtaagatgggaaatcacagaatacccatgttgtgcctgagatggcaggtggggtacccgtggtacccgggagggtggcaggtggggcacccatgttctacctggggtggcaggtgagcccataaccattgtagaggccaacatcctcagaggcctgagtgtggggaggtaggctttgactccctagggagagagggacacttaggaaacagacgggccctggaagtgggacatgaagagtgccctggccatccagtgtaggctgagatgctaggggcacagaaagaagagatctgctgatgccagccttccaaccatttcccagcttggccaagagccagctctggtattcgtgaaggaacagatcctgggtgaagctagagggaaggccgcagaggcaaaaggagagaggagctaggccaggggtcagcgactgaccctcgcggccagtgtacaggggttgcaactgggagcctagggggccccaaggcatctccaggcccaatctacctctgggcttttctcaagctctccctaggattactgcggtttcctcctggcgcctctcgtcttggacagccatgcccccctccatgctgcactaatggctcagcctggggccctagggacctctcctaccccccagactgctctgtcggccccctttcccccctactgctgaaacccaatcctctgcagcagcgccggctcagcaccgccggctcagcaccgctccgcagcccctgcctgccacggtcagctacgtcccacctggtctgctgcggagtccccagcccagtgcctagcccagtggagccaccgcctgttcctcgggaaggaacagtgggacctgaccggccagatcacctcctccaatcctgccaggctagtgcctccctgccttccaaccttggctgtctcccaccctctcttctcctctccttgcctggcctcctgaatcctatcttagcctccttagccccctgactgactctctctcgcttcttccaagcctctgtagctggttccgctcctgggttctggccatgaagcccacctcaggcccagaggaggcccggcggccagcctcggacatccgcgtgttcgccagcaactgctcgatgcacgggctgggccacgtcttcgggccaggcagcctgagcctgcgccgggggatgtgggcagcggccgtggtcctgtcagtggccaccttcctctaccaggtggctgagagggtgcgctactacagggagttmcaccacmagactgccctggatgagcgagaaagccaccggctcatcttcccggctgtcaccctgtgcaacatcaacccactgcgccrctcgcgcctaacgcccaacgacctgcactgggctgggtctgcgctgctgggcctggatcccgcagagcaygccgccttcctgcgcgccctgggccggccccctgcaccgcccggcttcatgcccagtcccacctttgacatggcgcaactctatgcccgtgctgggcactccctggatgacatgctgctggactgtcgcttccgtggccaaccttgtgggcctgagaacttcaccacggtgagctgacctccctacctatcctgccagggacccagagagccgaccagtccctgcccagcacccacaattccctagccagcacaggctcccccaaagccaggggacctcttccttcctaccagccatggactccccaccccccagtgccactccgtgcagcccaggaagctgtcctccttggggctttctctgtctcccagcccgaggggagcatgtgaggccacactgaccccggctggccctaggcctgaggtctggcccagggaggccctgctcctggggctgggggtcctccatggtgggaccattctggggcagaagacccctatctctgccaggaggtggggggggcttgctttccctctgccttttcaacatactgccagccccggaggacagccacaggggcccatttccttttcctgcagttcccagagaaacycagaaaaacctgtaggctgtgccctgggctttggtggggattggcggggtggaggrgctgagttgatgggctcccaagagcgtcctgcaacatgtgcccactggagcgtggggctgggggcattgagatgcgggcttcagtattcaaagaagagacgcaaacataccatgaggtggggagaggtcccatgaccatgtgcctgcctgggggagatggccatcaccctgtctgcccgccccagatcttcacccggatgggaaagtgctacacatttaactctggcgctgatggggcagagctgctcaccactactaggggtggcatgggcaatgggctggacatcatgctggacgtgcagcaggaggaatatctacctgtgtggagggacartggtagggagcacacaaatgaggctgggggagggcacggatggagtgcaaaaggctaggggaaggagaggaggagaggaggtgtcagggtgttcccccagaacctgtgaaaggggctgggctggctcatcccagtcctggggagaggggctgcagtgagaggtcttgtctggttgggcaggagacctgaccacacaggtcaggcctcacaggtccctccccgacagaggagaccccgtttgaggtggggatccgagtgcagatccacagccaggaggagccgcccatcatcgatcagctgggcttgggkgtgtccccgggctaccagacctttgtttcttgccagcagcagcaggtacccttccgtgtgcctccacacctactacttcaagcccacaccacctcggaccctaaaccctcagctcctcagacctgtctaggggcctctccccagctggcctctcacgctctccgggaagcctccttaaccctgtccccccacagctgagcttcctgccaccgccctggggcgattgcagttcagcatctctgaaccccaactatgagccagagccctctgatcccctaggctccccmagccccagccccagccctccctatacccttatggggtgtcgcctggcctgcgaaacccgctacgtggctcggaagtgcggctgccgaatggtgtacatgccaggtgaggggctggggttttcgtcccatggcgggcagggcccagggagctgaggctgcttctaaagccatctccccggtacccgcaggcgacgtgccagtgtgcagcccccagcagtacaagaactgtgcccacccggccataggtaagggcgagcctcccccacctcccgtccgccccgctccgcccgcgggcgtctgacgcggcccggtggcccgcagatgccatgcttcgcaaggactcgtgcgcctgccccaacccgtgcgccagcacgcgctacgccaaggagctctccatggtgcggatcccgagccgcgccgccgcgcgcttcctggcccggaagctcaaccgcagcgaggcctacatcgcgtgagctgcgcggggcgggcgggctcctccgagccgggggctcccgacggggcggaacggggcaggccaggccgtagccctagtgcgcacagcccgggcggaggcagcctccgcagcctcactggctctggggctccgtgctggttgcttaatctttctggccccgggggatgctgacgcctcctcccaggggtctgtttttttttcctttccttttattttttaatctttacttttaaaaaacagagacggcggggggcgggggaggggaggggaggggactcgctgtattgcccaggctggtctcaaactcctggcctcaagatcctccctcctcatcctcccaaagtgcagggagtacaggtgtgagccaccgtgcccggcctctcccagggttcttgaaaggagtgggagaacccacagctgcttcttgccagcagtgggcaccaggcggtggccagcccacatttgaggccattcttgtcctcagggagaacgtgctggccctggacatcttctttgaggccctcaactatgagaccgtggagcagaagaaggcctatgagatgtcagagctgcttggtgtgtgtgcagggcccccagggctgggggggtgtgggcaggcaggtggctgtaagttgaagggtgaccctgtctccacaggtgacattgggggccagatggggctgttcatcggggccagcctgctcaccatcctcgagatcctagactacctctgtgaggtgggccagggcccccactgcagggggtgggaggtgggaatcagggcccctaggatgagggrgaaggtgtgcactggccacctcccatcctgcttgcctccaggtgttccgagacaaggtcctgggatatttctggaaccgacagcactcccaaaggcactccagcaccaatctggtaacagcccctcttctggagcccttgcctgctccaagggtgctagggcccacccctgaagcctagaccaccatcccgccccagctgaggagaaacaggcaggagggtgtgcagtgacctcgactggtccctgggaggaggaccactccccacctctgaccctctcgtcctcacacagcttcaggaagggctgggcagccatcgaacccaagttccccacctcagcctgggccccaggtaacacataatggccccctaaaatcaagggagggcaggggcaggctcaggacagtgggtgtgcccgttcccaccccagcactctgctctgttccgaagacctcccacccctccctgtgccgtcaccaagactctctccgcctcccaccgcacctgctaccttgtcacacagctctagacctgctgtctgtgtcctcggagccccgccctgacatcctggacatgcctagcctgcacgtagcttttccgtcttcaccccaaataaagtcctaatgcatcagcctcayctgtttctcttacagggcagagactagccaagccaaggtcagcccaacttaggcattggaagtcttctgccagccatcatccagctggacgtggcttctgaaatgtggagctgggcccttgaacccccatgaatctctaggggagaatggtagcaagaggttatcagtcatttgcacctcagtgtgagtgagtttagccgactgacatcttagagagaagggaggacaggtatcctccaagcccgggttaggtgtgaggtgcagaatcacagtcagcaataaaggtataactggaagaaaactctgcccagagctcagcaagaagaggcagggagaagacggggtgactccactttcaagaacacctgtgtcctgccttacatcctgactcctttcccacatttgggaccaagtgcggcacacagcctgtctccatacaaacaagttctgcctcctcagcctccccacaagagctaaaggccccaggcttgagacggtgggggtgggggtgggggtaggcggagccctcccttcctcttcctgccagtaaggacacaccaggccccagccacaggcccaacttccctctctttcactggaccccaaacattgggaaactgacaaatagggagtgggagggggtgttcctgatggaaccatatctttggggctctcctgtgccagcctgcaggccttggtatgggggggatgatgagggaaaggacaagaggatccacctgagatatggagaaccacaaggagaggcccagccctttcctctccaccctggtggggagcccatccttgctcccctcactctgag

SEQ ID NO: 12240 - DNA, 14391 bp, Homo sapiens
caggtcagtagaaaatactcaaactgaaggacagagatttaaaaaagaataaaaaagaaaaagaaaggaggaagattaggggtaagctaaaatatctaccatacatacatctggagtctcaaaaggagagaagaaagattattgggcaaaagcaatattggaagagataaaaacagtagtgcagccatggataaactggacatgttttctttcttatcttccttttatagcccctgaggccagataattttccaaactgatgaaagatatcaactcacagagtcaagaagctcagcaaacccaagcagggcagatacaaacaaaacaattcctaagaatatactagtaatgctattaaacactggccaggcatggtggcttatgcctgtaatcccagcactttgggaggctgaggtagatggattacctgaggtcaggagttcaacaccagcctggccaacatgaaccccatctctactaaaaatacaaaaattagtcggtcatagtggtgtgtgcctgtaatcccagctacctgggcaggcagaggcaggagaatcgcttgaacccgggaggcagaggttgcattgagccaagatcatgtcattgcactccagcctgggcaacagagcaaaactccatctcaaaaaaaaaaaaaaaaaaaaaaaaaaaaaaaacacaaaaaacaaacaaacaaaaaaaactattaaacatcttaaagaagtcagaggaaaaaaagccacattaccttcaaagaaacaatatgactaacaggtaacttttcaacaaaaacaacagaagtttgctgggtgcagtggctcacacctgtagtcctagtactttgggaggttgaggcaggcagatcacctgaggtcaggagtttgagaccagtctggccaatattatgaaaacccttctctactaaaaattgaaaaatcagctgggcgtggtggcacatacctgtaaacccagctacttgggaggctgaggcaggagaatcgcttgaacccaggaggtagaggttgcagtaagctgagattgcaccactgcactccagcctgggcaatagagtaagactttgtctcaaaaaagaaaacaaaacaaaacaaaaaccgaaaaacaaacaaacaaaaaaccaatggaagccaggagacaatgaaataacacatttaaagctccaaaagaaaataactatcaacctgtgccaaaggataaatgctacaaaaataaaagtttaagaaagacacttttaccaaaacaatcttgaagaagaacaaagttataggtctcacatttcctgatttcaaaacttatgacaaagctacagtaatcaaaacagtgtggtactgtcataaagacagacacactggccaggtgcggtggctcacgcctataatcccagcactttgggaagccaaactgggaggatcatgaggtcaggagatcgagaccatcctggctaacatggtgaaaccctgtctctactaaaaaatacaaaaaatcagccaggcgtggtggtgggcgcctgtagtcctagctactcgggaggctgaggcaggagaatggcgtgaaccccgggaggcagagcttgcagtgagccgagatcgcaccactgcactccagcctgggcaaaagagcgagactccgtctcaaaaaaaaaaaaaaaaaaagacagacatacagaccaatggaatagaatagagagcccagaaataaacattcacatacatgatcaaatgagttttgggcttttttttttttttttttttgagacagggtctcactctgttgctcaggctggaatgcagtggtgcaatcatagcttattgcagccttgaactcttgagctcaagcaatcctcctgtctcagcctcccaagtagctgggactacaggcacatgccaccacacccggctaatttttaatgtttttgtagatatagggtctcattagattgcccaggctggtcttgaattcttgagcccaagcaatcctcctaccttggccccccaatgtgctggaattacagatgtgaaccattacacccagcctcaaatgagttttggcaagggagccaagaccattcaatggggaaagtagagtcttttcaacaaacagtagtgggaaaactggatatccacatgcacaagaatgaagttacagcaatacaaaaattaattggaaatgaatcaaagatttaaactaacagctaaaactgaactgttagaacacgggaaaagcttcatgacattgcatttggcaacgatttctggaaatgacaccaaagtcaggacaagaaaagaaaataaataggactacatcaaaattaaaagcttttgtgcatcaaaggacactttgcaagacaaactcagttcctgcctttatggaacttttagcttagtaaggcagtctttcaagttatgacgaatgctatgagaggtgttatagaattgaattacagaggatataaaacttcaaaaatcctcaggggatcctcaagggggactcacatactagtgcagccatggatacattggatatgttttctttctcatctttctgttctagtcccttgggacagaccttgcgtaggtcaagaaagaatccttaactgtattggagttgaaggttcaaatcccattctcttaaaaagtggagtagtggcccgggcacgttggctgacgcctgtaatcccagcactttgggaggccaaggcgggcagatcacctgaagtcaggagttcgagaccagcttggccaacatggtgaaactccatctctaccaaaaatacaaaaattagccaggcatggtggtgggcacctataatcccagctactcaggaggctgaggcaggagaattgcttgaacccgggaggtggaggttgcagtgggccaagatgtcttatgtcttgttctcacggttctcacgttcttttgaatattgcatcatcagtagttagcagtttgctttctctgacatcctactctcaggagggatgackctggatcckctcatttaaaaaattattttatatatagataaaatatatagctatattaccccaccggtaacatagcttctaaaagctcagggtcacatccctgaggtgaccctctcctgccttaaagtgtctgcctgagaaaactcaaggctgccaaaataatttacrttgttccagccaatacctgagaataggccaggggcagtggctcacgcctgtaatcccagcactttgggtgggcagctttctctctctttcgttcttcctttccttcctttcctttccctccctccctctctctcttctcttccttcctttccttttccttcctttcctttcccttcctttctttcttcctttctttttctttctgtctgtctctctttcctttctttctttccttccttcctttcctttccttctttcctttcttttctttcctttttttgagacagcgtttcgttagttctgtcactcaggctggagtgcagtggtgcaatcttggctcactgcaacctctgtctcctgggttcaaacaaatctcctgcctcaacctcccaagtacctgggattacaggcgtgtgccaccacacccggctaatttttgtattttttgtagagatggggtttcatcacgttggccatgctggtcttgaattcctgacctcaggtgatccgcccatctaagtctcccaaagtcctgggattacaggcatgagccaccgcgcccggcctgaggtgggcagatttcttgagctcaggagtttgaaactagcctgggcaacatggtgagatctctcctggtctctacaaaaaaatacaaaaattaggccggtcgtggtgtctcacgcctgtaattccatcactttgggaggctggggtgagaggattacctgaggtcaggagtttgagaccaacctggccagtgtgatgaaaccccatctctactaaaaatacaacaacaacaacaaaaaaaaattagctgggcatggttgtgcacccctgtaatcccagctactgaggaggctgaggctggagaatcgcttgaaccagggaggcggaggctgctttgagttgagatcgtgccactgcactccagcctgtgcaacagagcaagactccctctcaaaataagaaaaaaagaaaaaaaacaaaaacaaaaattagccgggtgtggcatctgtagtccccagctactcgagaggttgcagctggaggatcgctggagccggggaggcaagggtcgcagtgagccgagatcatgccactgcactccagcctgggtgacagagccagaccttgtctcaaaaaacaaacaaacaaaagacacctaaggacagrgttgaggytggtaycctcaccagtctctgtgggaggatggaatcctaacttccataaatgccagctagcagacatcattgacctaagcacatttacattgactaattctgtaaatgttcacttccctgactctactgaccctctgtctcactgtcccctaacctcattttccctataaaatacccattacttgcatacaaattgcagttgagttcagttcatgctgaactgtttttccttattgtagtagttattactgattgaaatctgtcctttccactttagtgtccggctttgtttatctttgacaaaattcaccagtttgattcaagacagtttccagcccctgctatggagttacactgagaaggaaacccctggaatttagtttcacccctacacttccaatggaatttttctgtttctttagaggtgggcaagggcccttgacaataaggaaactttcagacttgtctaaggtcccacagagagtgcttgatccacctgagctatcacaccccacagggtatacacaagtgtattctttttttttttttttttttttgtgacagggtctcgctctgttgcccaggctggagtgcagtggcgccaccttggctcactgcaacctccctcgggttcaggcgattctcccacctcaccctcccaagtagctggaattacaggcctggctaattttttgttttgttttgttttgtagaggtgaggtctcaccatgttgccaaggctggtcttgaattcctgggttcaagtgatcctcccgtcttggcctcccaaagttctgggattacaggcatgagccaccgcacccggccctgattcctttttttattctagcttcaagattcagttctaccgttatcggctgtgtgactgggtaaatcactacaccgcaagcctcggtttcctatttaccaaatgggtcgaataatgcctgccacatggggctgctctgaggagtacagatgtaagagatcctgtgttcactgatattttcatgtgggctttttgataatgatacaaaaggaacatgagaacwgtgacttctaggccgggcgaggcggcttactcctgtaatcccagcactttgggagtccgaggcaggcggatcacctgagatccggagttcgagaccagcctggccaacatggtgaaaccccatctctagcaaaaatacaaaaaattagccaggcgtggtggcaggcgcctgtaatcccagctactcgggaggctaaggcacgagaatcgcttgaatctgggaggcggaggttgcagtgagccgagatcgcgccactgcattccagcctgggggccagagcgagactccgtctcaaaaaaaaaaaaaataaaataaaaaattgtgacgtctcactcaggatcagcgtctttaagtggccacctccccaccccaccttcatgcctccctcctccttgaatcgtgtgttagaacgctgtgatctggtccaaactccacggagatgcgatgcgatgcgaagcgatgttgggcaatttcaactccctgtctcggtcgccacctaggattactgcatgttcagctacgacctcatcaacatggctgctggaagtcgtctacaggaaaaagaaagaaatgacactgamggatcacttccgcttccgttggcgcaagcgctttcattttttytgctaccgtgactaagatggaagcgtttttggggtcgcggtccggactttgggcggggggtccggccccaggacagttttaccgcattccrtccactcccgattccttcatggatccggcgtctgcactttacagaggtccaatcacgcggacccagtaagttctcggcgctttcgtttgcgtagcgggagggaccgtggggcctggtgctgccggctggttttgagagcccgggaaggtgaggcggggaccccgggggcgcgcgaacggcaggggagctcagggcgcggagtcctggagaatgcagaataattggaaggaattatagaaaatcagaagcgcagctcagtgcgcggaaagagggcgcagtccatcccccctctcagctcccaccgttctcactctttaggaaccccatggtgaccgggacctcagtcctcggcgttaagttcgagggcggagtggtgattgccgcagacatgctgggatcctacggctccttggctcgtttccgcaacatctctcgcattatgcgagtcaacaacagtaccatkctgggtgcctctggcgactacgctgatttccagtatttgaagcaagttctcggccagatggtgtaagtcatccagagracaggagagtggttcccaagtagagaggggagtcccctgttttttattcccttcgatgggatggggggacttgttgcagcgggggactggragagttgttggaggtgggcgatctgtgtttgcaataaagtttttggcattaggtgtaaaatgggggaaggtgtggtaacttcttttggggatgggtggagaccccgacttaattctctcccttttctcacaaccaattccttttaaggattgatgaggagcttctgggagatggacacagctatagtcctagagctattcattcatggctgaccagggccatgtacagccggcgctcgaagatgwacccyttgtggaacaccatggtcatcggaggctatgctgatggagagaggttcatatgaatacaaataacttatttcctttaccacccaacctagtacctgtgtagtatcycttctgtctcttctccccaagtgaatcccactttaastcagaccccatggtccccttcttcagctaagatgaayctaaggtgaaatgagttttgacccattgtgtcctgttagcttcctcggttatgtggacatgcttggtgtagcctatgaagccccttcrctggccactggttatggtgcatacttggctcaggtaagtagtaagtctagaggtgggggaaagggaagacaaaaggaaatggattagtggttgtctgcttttctcctgaaattctgatatgagggatgggctgggatcgctattactgggcagatggttttctttgtagtctgggggctgtaggtgttgacactgattccagtgacaagatgacatgactgggagtcagtagacatgcaaagagaggacaccctagaacttcttcctgaagtggctcttagcttattttctaagcagagttcattctggtgaggcaagaagtagaatgtcatctttcactctaatgctttttataccatagatttgagacaactagcctgttattcagcccaatatccccccatggttttcccccaatctccctagcctctgctgcgagaagttctggagaagcagccagtgctaagccagaccgaggcccgcgacttagtagaacgctgcatgcgagtgctgtactaccgagatgcccgttcttacaaccgggtgagggatgtgctgggaacctaattggcgggctctggctacttgcaatccctgggtctctatrctttgaagaacagattgccttacttgtgtgactcctattttcacattggggaagacctccacctgacctttcatttaaggacttaaggcgtgggcattattgaatgctctgctttcttccagtttcaaaycgccactgtcaccgaaaaaggtgttgaaatagagggaccattgtctacagagaccaactgggatattgcccacatgatcaggtgagtaatagggaaaaaattggtgacagacttgggaggtctttggcttacactaagctgggcttttctgggaggctcacccaggaaaattttctgggtggaaagttttggttggacagtacagctatttttaggaattgatccctttatgcttcacaattttattattctgtcttccttttttagtggctttgaatgaaatacagatgcattatccagaamtgaagttgccctacttttaactttgaacttggctagttcaaagatagactcttcttttgtaaagtaaataaattcttcaaaatgcttgctgagtggtttttgtctgactgggtcacaccaagtgcaaaactgctgagtactgccatgtgccatctccctccctggtcggagaacccttgtggtcttgcagcacacacagaaattctctctgcacaacacagaaagacacactagcgtcatttggagctgtattagaagcagagcttcctgtagaagccagacttaatttttgtgtgctaactggcttttgtgttcaaattcccctcccaaatcttcctccactgcactggattatcaaatacagatttcttaatgttggctgtgattttcattaaaataccactttaaaaataatctagtagaactattctgcatcaggttgccctcaagtcagctggggcatcagccatccctggaatggttctaaacctgaatattttagagacaaaagtctcattctgttgcccaggctggcgtgcagtggcatgatcatagcctactacagccttgaatttctgagctcaagcaacctcctgcctcagcctcccaagtgctgggattactggcatgagccatcatgcccagcttgaatttttaaaatgaacactgtaggcgattctgacacatatcctctccaaacttcttgagaaagaaaatataggcagcaaattcaaagtacagaaattcagtgagaactgaaggaaaaaataaaaccatccctccatttgcattgtccgttaacaacaaacttgtaaagccaaacaatgagctttcaatctgaaacctccacacattcagtctcaacacaggaaacagtcaataaatacatgtttattgattaaactgaattataaaaaacaaaaccaaaaaaaaatttccttctactactaagccatgcaggcagagtccacaaagacaacttcctggccaaaacccagctgatccactgttggtataatcttaaaaaaaattacccatcaagaaagtcaatcgtgtgcagaagacaggaaccccagctctgctaaggctgtggctgctgcagagactaccaaagagtaggattaggttgtagatagacgtgaccaaccatagttcttgaactttctcaaaggcaaaggctgacttcaaagtccattgtctgtcaataaaatggcatcaggcaaaaagctggggaagagaagcccagatggatccttggttgttttcagatgtcaaaggttcacaaagctggccaagctgtttctggaagggacttttccagttcactatattatagtgtgctgggggatgaaaaaacaaacaaacaaaaaagcagggtggggtgggagaaatgggtggtaacaaatgtcacacctgtaccaccaggcccatcacatcttgagcattccccagtctgtgaaagcctattaaacagggtcacctagaaaaaaaacaagtttataaatccatttcccctcattttattaaatgttccacttatgtacattttaaagacgaaccatttacaagcttgtgcagtttgcctccttggctcacaggaggggaacattgtggaaagcctcaggataaacagaagacttggttttttgctccttttctctgtacggtacagtacgttttggtttacaaccatgagtacatacaattaaaaaaatccctcatgcaaattgtagaaaaaattttctttccttgaagctggcagtgaaaaataaagattcatgtcattttctttgtgcacacccctgtgcgcttcttcctgtcagattcttccctaagtattaagagaaataggggaaagccacagagcacgctggatttcaacaagtggtcttgtctttttaaagttcaacacttcttgaacaattagctcctggctgtaggaccagtaatcccttaaacaggcatgctctccatctaacaggatgaagttcagtaaagcagggactgcccctgggggcttacaggatgaagactcaaactgggaatggcttccaccctaaaactgtttgatcgcttcagtatctcttgcttgctaataacacctgtatgatcctttgtccagagggatggatggtgttgagaatggggaaaggggccaaggatcacaagtgcaaaaaatattgtttatgtcatgttttggagggaaggtggtgaggaaaagacaaatctattcattctggataattaaaggtggtttcatgcatttttaaagccacaattttatatctagggttgctgtagaaaccaacatctctggagagggaaggaaagaaaaggagaaggaagagagagttcagtgggactttttttccattttcatttttatataaaagtgttaagaccacaatgaaaaaagttttttatccatatatataataaaccagtttgtgagctacataatttgtctttcccatcttcagaaatgttctcacattaacaatgattagatagcatcatgcccaaagacattggccacacaataaaacaaacaaaaaaacccagtactatgatacaattgaggtaaaaggggaaacaaaaaaatttaacatttgcccacaaataattttttttctttttcttaattttgtcagaaaaataccaaacacagtgatttaaatttaaaaaaaaaaaaagtcacaaaaacctgtttttagcagaagtgaatgaccaatgggccagctccttggctcagacgtgattactattggttttcctaattaatccacaaatccacagggaagtgtaagtcaacttcaggggggagtggtggtataaaattaaaaaatagaaaccaaataccccacctggtatgcccccttttccctaagcccctttaccctccctcacatgttcccacccccactccacaccccctcatgaccccaacactcaaatctccatcagatctaggtcagcttcttcaaagccatagaaagactcggtctcactttcaccctcaaagagctggtgaagactttcaggctcaattgtctcttcaggagatgatctgggtcgtggagtggaagactcagaatgttccccactcagcttcagttgctcctctagggaggcaattagctcctcctgcatgtcagcatttcttgtaggtgagttaatgttgccatcggggccaggcagaacactagccaccaggaaggagcgctgaactagctctggacagtccccaatgacacctagcacttcacccagccagacaagcaccagctgaagcaggacatcagaatcacatgcagtatctgccatttcccgagcctgttccttccattttttatgcaggaagttcttgacagttcttttgatgcatacatctaatggctgaattttggagctacagcctgctgggaccactgcaggcaaagtgctagaggcactaagcatagccagtacctcttctgacaagtgagtgcgatgacagtccatcacaagcatgcctttgctgcgctggcaagctgtgtgcttctgccacactcgagttgaccacagctccatgatctcgtcatcactgtagccactctcctttgcctctagcaatatggagtctggcatgttagcaggctgatccatctgccctctgtagaaaaccagggtgggaaggacagtgccatctgccagaatggctaggactacatcacaccaaggttcccctgtgcccactgtctgcagggcattctcctttcgatcatcactgctcagcacctctgtatccaggaacaaagagatctcatcaatagccacaatcatagacaagggtaagtcctggttgtgaatctgccgttgtacaaaatcaatgaagagtcctgcattctctgctacatccttaggtagggtgtgggccacagctcgccgggcatggggagtcaggtggtgccgcagcatgaaacgcacagcccactcataggagatcttaaaccccccttccaaagaacgtcctattttggtggccttctggaacaaggtctcctcatttacaggtagctgttgttcgcgctgggttagcacccactcagccagtttctcttctgcctcaaagctcagatatttgccctctagattctccccctgggaggcctggaaacgtcgaagccaacggcgaatacgtcgctggggatttcggaagtgttcagctgcctgttctgtattgcagcatagagcaaacagtactactcgaagcttcttcacagacagctgctcctttttgccaactccaccactaccaccaccacctgatgctagctcaggttcttgggtgactgggctcccttcatcctgatcatcaacattcagacattcggctccctctgtagccagcggtggaagggctaaagcctgcgggtgagtgggggttggtggtggggttgcagttgaggctggtgatgggagtgctggggctaagggagttagtagctcttcaggctcagctggggtggcccccgcagatttcacagtggcagctttgttagtggggaaggaaggaggagggtacatattcttcacgttccggtcatgcactcggtcacgagtctggccatgcctaaaggggtgaggagcaaagagaagaggagaaatctcagttcaactaggaaattgaaacaataatatgataataataataataataacagagtaaacacactgcaaaccagaaattaaattgtgaggtgagtttttgttaccttgagtgagctatccaagtgagtcctatggaaaatgaaacaacaaaaatagttagctcagtgaaaaaataagccctccaaagacagtgccctgggattcaacttactacatacaaatacgctgttcgcagtgaccagctttcccagttttatataaacttcaggtcggaaggtttctaattaggtccagcacatctcaacagtgaatgagtgaggccaagtaggtatgctcctgatgcatacagtacgaacctgtatcttttttcctccccttgctcaactaatccccttctctcctacttaccccgtggcaggatgctgctggatctgtgagaggggttgaataccaaatgcttggccatagcatcgcccacagaggtaacaaaggtacatgaagtgcaggccagcttgattccactaaaaaagagaattgagactatgtaagacaaacacagcagtgacacttgagaccattaagctttgaggcttaagaaagaaaaggaatgccctcccactttctcctttttctgaaattaattcacataaccacctctccaaataatgaaaaacctgaaaattaatgtaaaaacctgaaaaattaagatgctgccaataagttttttcttacctcacagaatttttaaacaaagccaaatacttggggctcttccgtggaacatgattgctgagaaagacaaagaagtggtatgagttacggagttctgctggctaagctagagatcaccagccagtgacaatgcccccaacaaaagagacacttcttcagtgcaccctaatctcaacctaagccagttttcctgtcaccatgcttcttaaactttaatatgcatacaagtcactgaggatctattaaaattcacattctggttcagtaggcctagggcggggctgagagtcagcatttctaacaagctcccacctaatactactggtacttgaatagcaaggccctatgaaattagagcacagaccatcaaaaccgaaaaaacagagcctctcactctgctaggagagaagaacaaatagctctaagagttgaaggaggaaacatattagaagcaggggagaaaatgaaatgagtgctcaagaatctggctggggccgggcgcagtggctcatgtctgtaatcccagcactttagggaggccgaggcaggtggatcacctgagctcaggagtttgagaccagcctggccaacaaggtgaaaccccgtctctactaaaaatacaaaaaaatcagccaggcatggtggtgcacacctataatcccagctacttgggaggctgagacaggagaatcacttgaacccag

SEQ ID NO: 12241 - DNA, 24105 bp, Homo sapiens
  misc_feature (1)...(24105): n = A,T,C or G, or insertion/deletion polymorphism (see Tables 1-2)
aatcccacaaattgtccctggaagggctcagagcctggacatggacgcagggatgagagggaattgctgactctggggacagaggtcagggagcgaagggctccttggtgttatccctgagcctggaggtagctcagggaggccaaagggccagaacatccttctaggctcgccaccacctggtattgcctgtccagcaggctggacgcagctgacggtcctgccctcctcacagagggtgctgtggtccccccactcccagctgcttcccgtggagcttcccaggtcagggcactgccgacctgctggacccagctccatatcaggccagcccaggcctcctgctctggtccctggggaaaggagcggggctgggctgagggctctagggaagaagtgggcacctggctgtgccaaggctcactccctggggatctgtggctcacatcctggccggtctccaccctctcccacaggtgcccctggagggttcctggtggcgctcacctgtgccaggggatgtggagccctggtttgggagtccagagtcctaggatctcacccttaccggaagtcacttccccagggcgattaccactcccaccatccatacccagagaatccactgatgtgttcattcaacaaatatttattggatgcctcattagagtcctgagaatacaaaagtgagcaaaacagatactgctctcattgttactaaatagatcatcttgtcaatgacatcatcttaccctgtgagcgggcagagtcgggagagaatgccaggggaggggaggacacagagaggcctgatctggcacaggatacctaacacaggtgagccccaccagggagggcttctcagaggaggagtcagacatcagaaccaagagcaggagtgagcctgtgtgggaggcggggccttcctccaggataggagcccccaggtggggaagaacttcagagtgggggtcagtactctccacctgaggtcccagccacctcagccccttgccctcgtccccggcacttgctctctgtcctttctctccttgcctctctccctttcggtcctggccagcagcggggccatggaagacagcaggcagagggctcagacccccagctgcccccagcacctcgttacctccttgttccaggccagaggggctcagtggcccaggagttgggctgggctctttaagaagaggagaaaagttaaagggagccaggtgtggtggctcatgcctataatcccagcactttgggaggccgaggctagatggatcacttgaggtccggagttcaagaccaacctgggcaaaatggtgaaaccccgtctctactaaaaatacaaaaattagatgggtatggtggcatgtgcctgtagtcccagctactcgggaggctaaggcaggagaattgcttgaacccaggaggcggaggctgcagtgagctgagatcatgccactgatctccagcctgggcgacagagtgagactccctctcaaaaaaacaaaaagaaaagttaaaggggaacctctgagggcctaggccctcaagtcccccattctctgctgatgtaaggagggactgtacctgggttctggggtgggggtgagggctatggcggccactgcctggttctggaggggaaggcctggatcagagatgggggagggcccccgaaaggcctgcaggagacagcaggactgcggcgggggtgaggaggtctcccctgttcctagttcagggtgcccctccaccctgctcccctgcagaaagtaaccccggtgcctgtcccccccaggtccctggcaccgacccttaggggctctttctatgacctaccctgttccaggtgttttttttcccagggtcaggccaggggagggggcaggaggaggggcctgagccacctgtgtgctgcccagggctgggcactggagtgaatgtgccccaggttcagggggtgtgcacaattaggtggtgggtggtctggctttgcagcctggcaagtcttctgcaccctcccatcctctttcggatccaggagggtccatggatgcacactgggagggaggacaggaggccaagggtctttgctgtgtctgatttctccccctagatgagaagcaggagagggagggggtggttgacagaggaaaaccacttgagaggcctggatcagagactacccccagtctcctggacagccctaggctgtcgaaaggcagatatctgtcagccaggccaaaatgcttacttccagaatgacgggccctgagccctggtttctccatttgtaaaatggagtctctgtccctactccactttctgtggggcgactgagcctgtaggtgaggaagccacgtggggaggtatacgggctgacactgccctctggtggccgtagccagagttgctggctgccagtgcgctgacctagagggtgtggtcagctgggggagctttcagggtctcctaacttcatctctgtcttctccatcccactgcctctgccttcttccccgtcaaactctccaggggtttcccagggcttcttcctcatggggccagaaacaatttaattcagcaggagtgtaataggcttcttctgtatgccctgttctgtgcttggtggttggggctgcagagatgtccaaggcacagagagacagtccaggaagctgggctgtgggaggaccactcggcagagcctatggagctgtagcctcacggaagcctgggctgtgccgatgcccgaacagccacctccttatgttcttcaacctcactgtcgtagcaaaccctggggttgtgtgtctccttcaagctttctgctgacaaagaaaccataggaaacatgcagactttgggctgggcacagtggctcacgcctgtaatcccagcactttgggagaccaagggggaggcggatcacgtgaggtcgggagttcgagaccagcctaaccaacatggagaaaccccgtctctactaaaaagacaaaagtagccggatgtggtgacgcatgttattggggaggctgaggcagaggcaggagaattgcttgaacacgggaggtggaggatgtggtgagccgagatcgtgccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccctccctccctccctccctcccgccttccttccttccttccgacagggtcttgctctgtcacccaggctggagtgcagcctcgacctgtgctcaggtgatcctcccacctcagcccctgaagtagtacaggtatgcaccaccatgcccagctatgtttttttttttgagacggagtttcgctcttgttgcccaggttggagtgcaatggcgcaatctcggctcactgcaacctccgcctcccgggttcaagcgattctcctgagtacctgggattacaggcacccgtcaccatgctcaactaattttttgtatttttagttgagacggggtttcactatgttggccaggctggtatcaaaatcctgacctcaggcgatccacccgcctaggcttcccaaagtgctgggattacaggtgtgagtcactgcgcccggccaattcttgtatttttttgtagcgaaagggttttgccatgttgcccaggttggcctcaaattcctgggctcaagcaattcaccctcctaagcctcccaaagtgctgggattataggtgtgagccacagcgcctagccttctttctgttttcattttgttacctctcgttatttcctcactcctctttggtctctctcaccccctctaccaagaccgctctttttttttttttttttttttttttgagacaagtcttgctctgttgcccaggctggagtgcagtggtgcaatctcggctcactgaaacttctgcctcctgggttcaagcaattcccctgcctcagccttccaagtagctgggcttacaggcttgttccaccacaccgagctaatttttgtattttagtagagatggggtttcactatgttggctgggttggtctcaaactcctgacctcaggtgatccacctgccttggcttcccagagtgctaggattacaggtgtgagccactgtgcctggccccgcaagaccgctcttgccgaggccatgaccccagctcaccaaggttgcccatgaccccagtttgccaagctgagtctctgtcctcagtctttgcctggcccaacagcaccacccaacacaggtggccactctctacatgaaacattttctttactttctaggacccaactttcctggttttcctctacttcactgccccactcatcccagtcttcctttgatgcctcctcttcttctttctgccctctgaatcctagggggttagtcctgggcgctcttacctgtcttctctcagtctcttggggatctcaccagtctcatagctttaaatggtcatcaaagaacaatgactcctacatttaaatctccagcccggtctctcccctacattcagatttatacatctaattgtctacccaacatttccagtaggatacttaaaaaaaaagtattctatttatttatttattttgaggggtaggctcgctctgtagccccagctggaatgcattggcacaatttcggttcactgcaacctctaccttccaggttcaagcaattctcctgcctcagcctcttgagtagctgggactacaggcacacgccaccatgcttggctaatttttgtatttttagtagagacagggtttcaccaggtggccaggcttgtctggaactcctgacctcaggtgattcgcctgccccggcctcccaaagtgctgggattacaggcgtgagccactgcgcccggctacagggagacttttaagaggcgtctcccaaggagaacaggggttcgccagcatggcaagaggagggcaaagcgaattaaggttggaggtgaagaacagttaatccaatcaaatggaagacgtcgagtggcgcgagcactggggtgtgagcgcgagggtcagggttgcagcgccaggcagggttgcagcgccaggcagggttgcagcgccaggcagggttgcagcgccaggcagggttgcagcacgttggaagcgcactggagtttggaatgtctctcccagtcaaccgggaaagacgcagcgctgccctaatgcactggccaccccagaccgtatgcacaacgttgggttggcagcttctacaccagggaaggcacccgaaaccccggcgcggcagctggggagggkctgcccccagccagggacccgcgagtgctggggcagccgcggctttgggcagaaccattctccggagatggagagggcagaaaaaatctttcgctcccatcccaactcggagccatccggaacttgcactcgcccttcttgccctgcttttcttactgtgctctgttccgtcaccactagctcccctcccgcgyggctctgagtcccgcttgccactagttgcttctcggcmgcccccacccctacgcgtggtccggcccggcggctggcgcaggttayaaaggtcccgccgcagcagcgsacggcwgactcgagatgcgcccgargaggttgggccggtgctgcgcggggagccggctcggacccggggacccagcagcactcacctrtgcaccttcgccctcagccagtcccgctccggagccctctgcgcagccgcaggcacggggcactggacagagagtaggatcccgagccacctctggawcccagttcctctcggaagcccgcaccggagctcgcccggcctcggaggctggagccaaggcaggagcccggcgcccgtccgcattctcggccatccaaggggatgtccggtctatgcccgacaattcggacgcgccgtggacccgcttcgtattccaagggccgtttggttcccgggccactggccgggggactggaaaggcagcgggcatctggaagacgccagccgcctacgttggccggcgacccggggtgtccggccctgagcgcgccgcctttattcgggagctggaggaaggtaaatcgggcccccggggtcctggaccgggtggggactggggcaactccagggaggaagtggccccatcgggtccaggcaccccgccccctctagcactcagtgtcacccgtccaccacccccgcgatgtcactgcggtgtctgtctggtcgccccttctccatctcctcctctgctcttgtcccctggtttgtgcccgtgagtcaggttctggggcctgcacgctcgcccacccacctccacgcgcctcttgctgcggcagatctgcaccccytcagcgcccctctcctgggtctaccgcagtgccaggagaggggcggggggctgcgggagggcgctgtcccgcgcgctctgagyctgcgctggccgaccgggcttgcgtgcgatggaggggtgggtgggcgggcggagggggaagttttgcccactttttggttgcgggtatgggggcaaagtcgcgctcttttcctgccccttgtctctcctatcctcctgcgggtcgggggagatctctggattgggcctagaggctcgagtgtctcctaatctggtgaagtcttcctcctgtcctctgcacacgcaacaggtgcagggtgagtggctgcgtctgtttgtatgacccaggagactccattgcactgcctcctgggtagggggtgatragccagtctgaggctgtacttcccctggctgtctccattctaggcgccagggacccaggtgtccggagagcccagtttctgagcctggaggactgtgacccccttacctcaggctcctccrggggtaaaaaaaaaaaaaaaaaaaaaaaaaagccgggcgcggtggctgacgcctgtaatcccagccagcactttggcaggccgaggcgggcggatcactaggtcaggagttcgagaccagcctggccaacatggtgaaaccccgtctctactaaaaatacaaaaataagctgggcgtggtggcgggcgtgtataaccccagctactcgggaggttgaggcaggagaattgcttgaatctgggaggcagacgttgcagtgagctgagatctcgccatcgcactccagcctggaggacaagagcaaggctttgtctaaaaaaaaaaaaaaaaaccaaaaaaaaaaaaaaaaccaaaaaaaaccccaaaaacctaaaaaccctgtccacttggccctgggagcagggaagggagtgttgagtgccgaggggtaaggggaggatgtggggggcaggaggggagcccagtcttctctcccgatgacccttgttggagaactgacgataggacgggaaacagctgtttgctggtagcatctgctcctttttcctgacctggctgggccttttctccccacctgccgcctcctgcagcactgtgtcctaacctacctccgccagtcaaaaagatcacccaggaagacgtcaaagtgatgttatatttgctggaggaggtgtgtactgccttcctgatccagkcaagcccttattctagttttgtcctgtaggggtgggggtcttgtttatttcctgattggcagtctctctggggccccaggttagggtccttcttatggaagacaggtcgatgtgggatgttcaggctggaagagctctcagagccaatctggtctgatcttctttttccatgaggggaaactgagccaggttccacagtgggttaatggcagactctggtctggtaccctagagaactaggggatggggaaggttctcttaggggcctagcctctctctgacccctgtgtcccccccagcttctcccacctgtctgggagagcgttacctatgggatggtcctgcagagagagagggacctgaacactgcagctcgcatcggccagtccctggtgaaacagaacagtgttttgatggaggagaacagcaagctggaagccctgctgggctcagccaaggaggaggtaaccgggtggggaggagaggatagsgggccaatctacacctgcctcatgccaggaccctctcctgtccctgcccactcccaacccatggctcctctctcttcctgccagattttatacctcagacaccaggtgaacttgcgggatgagctcctccagctctactcagattctgatgaggaggatgaggatgaagaagaggaggaggaagaaaaggaggcagaagaggaacaggaagaagaagaagcagaggaagacctgcagtgtgctcatccctgtgatgcccctaagctgtgagttcctgcctttgcacctgcaagtcctttctctgagcctcaatttcctcatttgttaagagggacacaggtgatgtgcttgcyggcagggttgctggaactaattgagaacactgcccttagccctggtgggctgggaactgggaagccccactccctgcaccctgactcccattsctccctcccctaggatttcgcaggaggcattgctgcaccagcaccactgcccacagctggaagccttgcaggagaagctgaggctgctggaggaggagaatcatcagctgagagaagaggtgagaatgggggaggagggcgtccctgctagcagggggtgttgacttccctgtcccttcctctttgtctccctccaggcctctcaactcgacactcttgaggatgaggaacagatgctcattctggagtgtgtggagcagttttgtacgtaatgttgtcactcggggtggggggttgtcccaaggagcagagaaaagaactcaagatgtggagtatggagatccaagttcaagtcccagatctggcactcctagctgtgtgaacttggatacattccttgacctctctgaacctttgtctttagaatggggattaattttctcagccccactgatctctccagggtttatgaagattaagagtgtcaacagctgaggaagtactttgtgcaaactataaagagctatacagaaattgtgggtctcaggccaggcacggtggctcatgcctgtaatcccaacagtttgggaggctgaggccggcggatcacctgaggtcaggagtttgagaccagcctaaccaacttagagaaaccctatctctactaaaaatacaaaaattagccagatgcagtggcacaagcctgtagtcccagctccttgggaggctgaggtgggagaattgcttgaacctgggagacagagtttgcagtgagcctagatcacgccactgcaccccagcctgggcgacagagcaagactccatctcaaaaaaaaaaaaggtgggtctcctccaagcctgtcttctcttatttggggcaggcaagagggagccatgagctgccagagaccaggcacccagggctgggacagttcagagtcatgcacggggcagtggctgtgcctggcatcgtcctaggcactgtgtgtttatgaagatgagtgaggagcagtgtttgtgcctgaggagttcaagtgtagctggtgagatgcaaacgcaaagtggcaacagctgaactcctgctgttccctttaccccagaactgaccttccttcctgctgggttctgcaactccctgaatggccccactggtccccaggctactggagtaggaaccagtccccaagctctgctgcttttacctcctaggaatggcttaagtctttttccccctccccactcgggctgcctctagcccaagatacctcttaactggtcgcactgcctctactcgcgccctaccaggaacttctgcacacagccttaatgagttttctaaaaccaaacctggccaggtgcaggggctcccacctgtggtcccagctactcaggaggctgaggtgggaggattgcttgagcctgtgaattctgggctgtagtacactatgccgacagggtcagtatggtccagggagtggagtaccactgggttgcctgaggaggggtgaactggctcaggtcagaaacagagcaggtcaaaactcccatgctgatcagtaataggatcgcacctatgaatagccactgtactccagccccagcctgggaacctggcaagacctcattttctttctttctttctttctttctttctttctttctttctttctttctttctttctttctttctttcttttctttctttctttctttcttyctttcttttctttctttcttcttttctttcttttctttcttttctttcttttctttctttctttcttttctttctttccttctctctctctctctctctctctctctctctctttctttctttctttttttttttgagatggagtacagtgttgcagtcttggctcactgcaacccctgcctcctgggttcaagtgattctcctgcctcagcttcctgagtagctgggactactggtgtgtgccatcacgcctggcaaattttttttttttttttttttgacggagtctcactgtcgcccagctagagcaatgtcatgatctcagctcactgcaacctccgcctcccaggttcaagtgattctcctgcctcagcctcctgagtagctgggattacaggcctgtgctaccgtgcccagctaatttttgtatttttagtagagatggggtttcaccatgttggccaggttggtcttgaattcctgacctcaagtgatcctcccgccttggcctcccacaagtgctaggattacaggtgtgagccaccacgcccggccaagaccgcatttcctttttttttttttttttttgagatggaggctcgctctgtaacccaggctggagtgcagtggtgtggtctttgctcactgcaacctccacctcccgagtttaagcgattctcctgcctcagcctcccgagtagctgggattacaggcatgggccaccatgcacagctaattttggtatttttagtagagatggggtttcaccatgttggccaggctggtgttgaactcctgacctcaagcgatccatccccctcggcctcccaaagtgctgagattacaggcatgagccactgtgcctgtcccaagacctcatttcttaaaaaacaagtagccgggtgcagtggctcacccctgtaatcccagcactttgggaggcagaggcaggtggatctcttgaggtcaggagtttgagaccagcctggccaacatggtgaaaccccgtctctactaaaaatacaaaaattaactgggcgtggtggcgcatgcctgtaatcccaagtactcgggaggctgaggcaggaaaatcgcttggactcgggcggcagttacagtgagccaagattgcaccattgcactcctgcctggacgacagagattcggtctcaaataaataaataaaccaacaaacccaagtctgaccacgtcattactgtgcctaaaactcccaaatagctttccattggccaaaggataaaccccacccccttgcccactactgtggtctggcctgtgtgcactgttctgggccctccccstcccagtgtcttatgatggcctctgggcctttccagtcagcttggacccatgtttttccttctttgcctgggtgagcttcacttgccctgtggtcttagcttagtggttcctttttccaggaatccttccttaccttgcaggtcgggttgggtgctgtagctgtgatgcccctgccctgtacacccttgacatttgcccatcatggcctgtatgatgtgtgactgtggtctgtctccccaccaactttacctcagtgtggcggctgggtcttactgaccactcaccctggtgccctgctcagtatcagtcaatgaacatttcttgaatggaagacctgagtgaggaatgcaaagccctgcaggacccactggcacagcrcagcagccgagggtgggggagacagaggcatctgggagggccagagctggtccctgaaggccaggggagccagggctgacctgtcctctgccctccccagyggaggccagccaacagatggctgagctgtcggaggtgctggtgctcaggctggaaaactatgaacggcagcagcaggaggtcgctcggctgcaggcccaggtgctgaagctgcagcagcgctgccggatggtgagtcgggtgtgtgtggaaccctcttgtcgtrgccccatgggaccctagcttccttcttcctgcctccactcggctccaccaggcctgaggtccctttctgtgtcagagtcagagacctcagagagccccttatcttgaccccttgttatcttgaggagaccaaggcccagagagggtcctggagtcttctaggaaccaggctgygtgactcccctgccttctttgccctccttccgtgtgacttgtcatttcatgggctgccaaggactcactgatgtgcctgggaagacttgctggaagcagggggtgccctgagtgggtaggcctcagatgggggttcactggttttgggtccttcsagtatggggctgagactgaaaagttkcagaagcagctggcttcggagaaggaaatccagatgcagctccaggaagaggtgagtctcgctgccggcttctgcccccaccctggagagccrctggcccagagtggggaccccaggcccttggcagctacctgactctggagaggactagcaggaactgagtcttgtccgtttccaccccctccatgcctggcacagcccagcaggtgacagttccatcaaggtctgagtggtgtggagtgcagggacctgccctgggtcccccacatgacactyggagtccagaacctgggcctctggcctcagcctgagagcagataggcaggagtgctggactgggtgtrcctgggtcccagcagagcgtgtgggtgggttcccagctgcaggacctgygggagaagtacatggattgtgggggcatgctgattgagatgcaggaggaggtgaagaccctccgccagcaacccccrgtgtccactgggtctgccacccattacccatacagygtgcctctggtgaggaccctcccctggctgcccactttcctacgtcygtgcctgtgtctcagccttggtggctgattgagatcccagttcccttctgtgcctgagcctatgggtgggggttctgtgggggtcctctggtaacgtctgttctctccaccataggagactcttcctggtttccaggagacgctggctgaggagctcagaaygtctctaaggaggatgatctcagaccctgtgtattttatggagaggtgcgtggctggggccctcccttgccccrtaggccatggcctttcctgtagtggggagggggtttgccctcacactctgaccttccacgcttccctatacccgcctcgttcactgcatcagcccctccactcattgcttctctatgaatatggacccatcacttccccctgaggtattttttttttttttgagatggagtcttgctctgtcacccaagctggagtgcaatggtatgatcttggctcactgcaacctctgcctcccaggttcaagcaattctcctgcttcagccttccgagtagctgggattacaggcatgtgccatcacgcccggctactttttgtatttttagtagagacacagtttcaccctgttggccaggctggtctcaagctcctgacctcaggtgatctgcccgcctcagcctcccaaagtgctgggattacaggcgtgagccatcatgcccagcctgaggtttttttttttttttgagacgagtctcactctgtcacctggactggagtgcagtggcgagatcttggctcactgcaacctccatctcctgggttcaagcgagtctcctgcctcagccttccaagtagttgggactacaggcacgagcctggctaattttttttttktttttttgagatggagtcttgttttgttgtccaggttggcgtgatctcggcttactgcaacctccgcctcctgggttcaagcgattctcctacctcagcctcctgagtagctgggactacaggtggccatcaccacgcccggctaatttttgtatttttagtagagatgggccagtagagatgttggccaggctagtcttgaactcctgaccttgtgatccacccgcctgggcctctcaaagtgttgggattataggcgtgagccactgcacctggccaagcccagctaatttttgtagttttagtagagacggggttttaccatgttggctaggctggtcttgaactcctgacctcaggtgacctgcccacctcggcctcccaaagtgctgggattacaggcgtgagccactgctcatggccactacctaaggttcttcagcttgaccaagccccagggactgcagtttcggcttccattgtctcataatgaaggtccttttctctttgaaggaattatgagatgcccagaggggacacatccagcctaaggtaagcctgccaggggctcccctacaacctgccctcagctttcagcagscagacagcccacctgcctctggttctgccaccctgcaactccggagaaggccctgctatctcggctggctgarctgagaactgttctgggaaggagctgccccacttttccttcaaatcttgccccctgggtggccgtctgattccaggcagctctgagtggggactgaagctttcttttcaactgactatgggctgagaggtgacaggcactggcttaggagctgggaacacctgggactaaggcccagcgtggtccctttcctgactgtgtgtccttgggcaagtcatttgacctgtctgagcctgtctagaatggatttgttcctatgkcaagtagctgtggggtgggctatgaaggttaaatcatgcaggagggaggcagaagtgggtgttaaccctgttggtgtattccgtgcagggtcagggacataaaagaagatggggcctatgcagtgttggtgaccattcttcctccctcccaccagggggatgggctgggtatttgaagccttggagctggtacctagctcccctctcccctggctgggacagaaccaggaggaaccatcagggtctrtgtggagacgggtgggggtgggcctggggggttggactttccagcccctcaaaagatgtcgctatctcccgcccaggtatgattttcgctacagtgaggatcgagagcaggtgcgggggtttgaggctgaggaagggttgatgctggcagcggatatcatgcggggggaagatttcacgcctgyggaggagttsgtgccccaggaggagctgggggctgccaagaaggtgccrgctgaggaaggggtgatggaagaggcagagctggtgtcagaggagaccgagggctgggaggaggtggaactggagctggatgaggcaacgcggatgaacgtggtgacatcagccctggaggccagcggcttgggcccttcacacctggacatgaattatgtcctccagcagctggccaactggcaagatgcccattacaggcggcagctgaggtggaagatgctccagaaaggtgagtgcccccacrgggccctccctgccgccagccggacaagctgcagatmgtcgtgccgatgaaaagagagggtggataagctccccgagtgctcacctgccccagcctggctctacctgctgtgcttatttgcatggactttgcatatcatttgcatagacacctctgatccccttcagtgggaaccgtagtgtcagtgctcatttatgtggcatttgcttaggattccagatctccatccacttttctcctgggggctgggctgggggttagggctgggactgtgcccccacactgcgcctcagcttcccatctctgcccgcttgcttcccctrcccccaacccctgcctcctctatmccccaggctctccaactctgcagcagtggcagcagcagtcaaaacaaacacggggggcggtgggtgggatggtggagcagcctgggggctgacccaggctggaggacaggaccagccaccctcccacggcctgggaggaagagaggccttctgggactgcccaggctatggggacaaaggccttcaccagcaagggccacagttggaacagtcccctgggtgtcagaaggtgggctagggcctcctgcagggttgtggggtggaacagggtctcctctccccagccagaaaccccaaagtctgggagctgcacctkccgagtgcaggccatgtgagccctgcctctttaaggagccgcaggacatgaaagatgaccttgtgacactcatgcacagcagccattgcacgtgcatcagctcccatcagcctcattccgtggcaggtgatgtgtccccattggttaggtgaggagggtgaggctcagagagctaaggacacttgtttggggccacacagccggggtagatctgagcccgtcctctctactcctgtgctgtagcaccttcactggcccatccctcccctctagtgctgtcctggtacccgtcccagcctgtccccattctcatggccctttggtcactgccgggtggaatagcactggcttcagcaggcgtgtcatgtaagcttgtgcaggttataaactgaaccatgacctttatggcgcatgcagggggcaacctgcataattatcaatggcgactttccgtgtccttctgatacagttgatcagacccctgcccaccgcccaggccaggcctgtggtcatcaatgccccagttcacatccacctgcttctcttccaggctttgctgttccccagcagcctgcagaggccccacagacagcttgaggcccctcctgctgcctggccaagccccacacccgcagaccctccttcccatcctctgaaatgggaccctgtgtctgtcaccagcccaccctctgtgttcatgaacctgggctggagcttggggacccctccctgcccctggcttcctcttccatgttctgccctttcccacatgttggaggcttttccaacgtcttcagggacaggcggtaggaaccccggccctcgctctgcagctggtgcaaaagctgtggctgccaggyctgggccacatggcagcccagggggcaggagaagcccgggagaggcccrctggctaccagactcagccctgagcagggaacagggcccagcttccaccggcagggagttgtgagcgccttcccaacaatgtgcccctcaccccttgatgcccatgctaatggtagccaccctggttcttgttgacttgagggacctggctgtcttccctgttcttcatcctttcttctcagtccctacctactgtttgtaaccacaagtgtctctgtgtgtgggtgggtgagggcccctctgcccagtggtgtgtctcctctccctccctccctcttctgccagtggcctgggggtgtccaggctcccatccrtggcccagcccctctcccctctgtcttgatccccccctccctgcccctggcttcctcttccatgttctgccctttcccacacctttgttcctcaatagctgggggctgggactgaggcctcctgcaggtacctgccccccttcacacagcacctctcaatctcctattgcttgtcagcctgtgtgcgtgtggtgcaggaaataaaggatctataccctcctggcccagcctccagctgtctctctagggagtgtgtgtgtgcacttggcagggcgaagttgtagagaaagggtggatgctaatattgaagtatgtgccgaggactcctattaaatacgccgtttaatcatagcagcagctcctagagggcggtgggtgatgtcataagtgtctgttggatggagaaactcaggccagagtaggttaagtgatgccctcaccagcagatcatggctagtgtggagctgggatttgagctcatgcttccctgatcctttcaccccagagactgactcagtggcctggctgtgaaagataggatgggagagagtcacccactgtcttagggtgaagtccccagagcagacctggaacagggtttaggaacaagtatagtcgccctccgtatcctcaggctctgcatccgtggagtcaactaaccacagatagaaaatatttgggggaggctgggtgcagtggctcatgcctgtaatcctagcactttgggaggccgaggtgggtggatcatttgaggtcaggagttcgagaccagcctggccaacatggtgaaaccccgtctccactaaaaatacaaaaattagctgggcgtggtggtgggtgcctgtaatcccagctacttgggaggctgaggcaggaggatcacttgaacccaggaggcagaggttgcagtgagcggagatcatgccactgcactccagtctgggcaacaacagcgagactccatttgaaaacacaagaaaatatctgggggaggccaggcgcggtggctcatgcctgtaatcccagcactttgggaggctgaggtgggtggatcacttgaggtcaggagttcgagaccagcctggtcaacatggtgaaaccccgtctctactaaaaatacaaaaaaaattagctgggcatggtggcagcccctgtaatcccagctacttgggaggctgaggtgagaggatcacttgagcttggaaggttgaggttgcagtgagctgaggttgcaccactgtactccaacctgggtgacagagtaagaccctgtctcaaaaaaagagaaaagaaaatgacagacaaaccagacatgggggaaattgccagctttgataaagctttgaaggaaacggagatgcaggagaacaccttgtggaccagagaccactgagcaggagaagcagtgaaatttcctaaaatctggaggattccctgcccctgttatcttcaagtccccagtggtgatgtggaagaaaagcaacctgcaaggtggatgcaagccacaagctgctctgtgaacctgggcacctcacacagatgccactggcctgtgggtctctgaggggacccgcraatgggactgccaaattctctggtttgctccaggttattatagaaaattatttatatgaatagtaaaaataaaacacactttgtggcccccctgccaaaagaatatcattgagaagattattgctgtggctaaccgggtctcagtcctgctgggaactctgggggacagtagaatatatctcagagtagcctgggtgaggtggctcacacctgtaatcccagcacattgggagggcgaggcaggtggatcacctgaggtcaggagttcgagaccagcctgaccaatggagaaaccccgtctccactaaagatacaaaattaactgggcatggtggcacacatgcctgtaatcccagctactcgggaggctgagacaggagaatcgcttgaatccaggaggtggaggttgcggtgagctgagattgcaccattacaccccagcctgggcaataagagtgaaactccgtctcaaggaaaaaaaaaaaaaagaatatatctcagagttatcccaccccttgggtgggggagctggggtatttatcctctaactgtcatctgacactgtctgagagatgcttctggaggcatttaactgccctgcacttggccctgaaggaaattagaatgtgttacctccaaatatgccactttggcataaggactattttgagctgaaggcaattgagaagaagcagatacaagaaaagctccctaccctcctatttgcataaaaacaggacatacattttcaactgtgtccatctaccaggaaggataaaagttaaatctctgggctgggcacggtggctcatgcctgtaatcctaacactttgggaggccgaggtgggtggatcacctgaggtcaggagttcaagaccagcctgagcaacatggagaaaccctgtctctactgaaaatacaaaattagccaggtgtggtggcacatgcctgtaatcccagctacttgggaggctgaggcaaaagaattgcttgcacctgggaggcggaggttgcagtgagccgagattgccccattgcactccagcctgggcaacaacagcgaaactctgtgtcaaaaataaataaataaataaataaagctgggcgcggtggctcatgcctgtaatcccagcactttgggaggccaaggtgggtggatcatgaggtcaggagatcgagaccatcctggctaacacggtgaaaccccgcctctactaaaaatacaaaaaattagccaggcgtggtggtgggcgcctgtaatcccagctacttgggacgctgaggcaggagaatggcgtgaacccgggaggcagagcttgtagtgagctaagatcgtgccactgcactccagcctgggcaacagagtgagactctgtctcaaaaaaaaaaaaaaaaaagttaaatatctggagacaactttattttttattatttttttggtttccataatttggacttattttattgatactcattagtgaataaaatgttgatttttgatgcattacaatacactttttggtagtggttgcacaatgttgatcatttatttgtttactaaatactgcaatctccaaattgcctttttttttttgagacagagtctcgccctgtctcccaggctggagtgcaatggcgtgatctcagctcactgcaagctctgcctcctgggctcaagcaattctcctgtctcagcctcctgagtagctgggattacagatgcataacaccatgcccagctaatttttgtatttttagtagagacagggtttcaccgtattggtcaggctggtctcgaactcctgacctcaggtgatctgcctgccttggcttcccaaagtgctgggatgacagacgtgagccactgtggctggccaaattgccaatttttacatggtatttctggcaatgatggtggctcgtctctctgaatacataaaatggtccattcaatccatggttttcatattcctttgttattctatctactgctttaaaatacattcaggctgagtgcagcggctcacacctagagaatcccagcactttgggaggctgaggcgggtggatcacggggtcaggagttcaggaccagcctagacaacatggtgaaaccccacctctactaaaaagtacaaaaattagcctggcatggtggtgcccgcctataatcccagctacttgagrggctgaggcaggagaatcgcttgaacctgggaggtggaggttgcagtgagctgagatggcactactgcaatccagcctgggtggcagagcaagactctgtctcaaaaaaataaaatacattcaaataaaaaaatataagttactttcaacaagtgcacacttagaacagcgaggagagctgagaacataattaaccagtactcttgtgttcagagcataaatagtctgaaaccgtgggactgaagcttgctcctcatagactttctccaagtatccttggtggacgtaaggttaccctcactcaacggaaggacacatctgctgctgtggtgggaggacacagaatgacaatttcatttacgtaggacgttttccttccataatgtctggaacaagtcggagacaactttagacccctttcagcctggagtggcaccagtgcaatctaataacaaacttgactcactagcctttatctaccattcgttttccatatagctgctttcccatgcacagttagccacccttggaagtccaacctaggctggagcttgggggcctggacctcagccctcttctgggacaggcggtaggatccccagcccttgttctgcagctggcacaagagctgtgactgccggatgtgggtcacatggcagcccaggggggcaggagaagccgggggaggcccactggctaccagacccagccctgagaggggacagggctcagctcccacgggcagaaagctgtttcccacacacagttagccacccttggaagtctaaaaattgctgtcctttatcttgcctacaaatgtattgttctttgttgaagatgctctgtgagcctgaattctcccatctgagtactaaccaggccccaccgtgcttagtttccaagatcagacaagatcgggcgcgttcagggtggtatggccgtagacagtgtgagcctgaattctaagctacctctctgagttactcaactctgggtactctgtgtgttaaatgtgtgatacacatgttaataaacttgtttgcttttctcttgtaatctgtcttttattacagagccccagccgwggacctaagatgggtagagaaaacactttccctcctctacagccctcaggtggcgggtagctcaaggtaatggtgtcaacaggcacaagaacaatgatggaatggagtgagacaccagcaatgcctgcatcagccactcatgagcaattatttacaaatatttattgggttcctcctattcttgccaccggtgatacagaagggaggagggacttgtcacgctcccagtttcctgttttgcccgagaggcagacaataaactggcaaacaaaacaactacagattgtgaaatgtgttctaaagaaaatattctgctattgtgagacaaagcaacaaacattaagaagctgtgtttgctcctttctgcttgtcggcacagtttcacaaagcacctgactctgtgactagagacagacgtgcagccctccggaaagatgctttgaagacagcacaggagagagcctgaggccctcccatgtctcttggctgagtcactacttttcttttcttcttctttttttttttctttgaaagagagtcttgttctgttgcccaggctggagtgtcatggcgcaatcttggctcactgcaacctctgcctcccgggttcaagcaattctcctgcctcagcctcccgagtagccaggactacaggcacatgcctggctaaattttgtatttttagtagagacggggtttcaccttgttggccaggctggtctcgagcacctgacctaaagtgatccaccctcctcggcctcccaaactgctgggattacagatgtgagccactgcgcccggcttgagtcttcacgtttcttaaaagagaaataatcctagtccctggcttttctgacacagaacatttccaagatgacatctgacgaggttagtgatgatgcctctgtgatctaggacccaaatcttgctgtgattctgctgtcatgtaattctgagcaagtctgatgggattttgcacatacggaacctccacctttagcccccagatgtatataagcaatgggctgaaacattgtgccagagcctgctcctgggctggaggcctcaatctatagtcctctgtaagacttctgaatacaactagcattcattctttaaaaagcttaattttttctcttttatttgaccctgtggtagagaataactgggtctatgtgtgaagggtgaggagcagaaagggtaggtctctcaggaagaggcatttcacccaagagctaaggaggaaaggggagcccaccatatttgtgcctggggaagagcgttgcaggcacagggaatggcaaggtcggaggctctgagcaagagagaacatggcgtgtctgtgtaagggaaaggaccgagaggacaaagagaa

SEQ ID NO: 12242 - DNA, 21608 bp, Homo sapiens
atcattatcaatctgtctttcaagaagacataggtagtgagaataaaagtgagaactcccactaatgagtgagattctcaaagggggtgaataagtgaggcgaccacccctcatattgtcttatgcccaatttctgcctccaaagaaagaaaaagtaaaagctaaaaggcagaaatgaaatccacaggcagacagcctggtgttgcaccctgggtctggttaaagattgacccccgacctaaccggttatgttatctatagattccagacattgtgtggaaaaacactgtgaaaatccctgttctgttctgattactggtgcatgcagctgccagtcacatacccccacttgctcagtcgatcatgaccctctcacacagacccccttagagttgcaagcccttaaaagggacaggaattgctcactcagggagctcggtttttggagatgtgagtcttgccaaagctcccagctgaataaagcccttccttctttaactcagtgtctgaggggttttgtctgtagcttgtcctgctacaaaaataagtgttaaacatgagttttatattacctcataggtggaagaagacaggccaaaaaagctgttttaacaacaacaaaatgcacaaatatttatactaacaagacagatatccattgcagtatgacacgagaaacaaataaatgagacaagcagtcaattcagacattttaggaagtgatttttacagaacatagtgacaattgctgagatctggtagccttgcaagattcctttgttataataaaaataacattggcaaagaccattttatgatgcagacttctgcttttttaaagtttggggggaaggggaaacatttttattctataatgctgaaatttcatttttcttttctcttttttaagaccaagtcttgctctctcaccaaggctagagtgcagtggcgtgatctcagttcactgcaacctccacctcccgggttcaagcaattctcctgcctcagcctcctgagtagctgggactacaggcaccatgcccggctaggataacattttttgtttttagtagagatggggtttcaccatgttggccagagtagtctagaactcctgacctcaagtgatctgcccgcctcatcctcccgaagtgctgagattacaggtgtgaggtacagcatctggcctcatgctgagatttctttcattaccagttcaaacacctttcacttttcaaggcacaaggagaggaattccatgtgttgacactgggaggaagggtacagacctacttaaaagattcaaaacttctatgacagtaaaagaaatgtatatcaagttccttagggctgccgtaacaaagtactatcaactgggtggcttagaacaaaagaaatttattctctcacagttacgtaggccagttgagatcaaggtattatcagggccaagatccctctgtagcctctggggaaggattctttcttgcctgtttccacttctagcagcttcctgtgtttggtttgtggcagcataactccaatctctgcctccatctctacctggccatcatccctctgtgtctgtgaggaccccagtcattggttggaggactcaccctattccactataatctcttcttaaccagtgaactcaccgtattccagataaggtcaggttcacagctactgagggttaggacagagtatcttttggggagatgcaattcatcccataagtgggtggaaaaggatgattaacaagtggtatgtggggatgtattgttttgcatctacgtagctctcaccccatttctttccacaacacacatttgtcactctattctttattaggtttacagagaaaagtagatcttcaaccactttcctgggatgtggatacagctctttttttggagacagggtctcattctgtcacctagactggtgtgcagtagcactatcatggctgactacagcctcaatgtcccaggcttaagtgatcttcccaacctcctgagtggctgggaccacaagtgtgtgccaccacacctgactaattttatttttyaattgttttgtgaagacagcatctccctatgtttcccaggctggtcttgaattcctgggctcaagccatcctcctgcctcggcctcccaaagtgctgggattacaggcaagagcctccatgcctggccttcaactcttgaccttatgaacacagccctataccagttcccttcatgcatgtgcctataagctaaaccctttcccaagtgtacatgaaaatctgaaccccaacaaatatggcctaattctaaatctgactttcccaggagtaatttttgtcatttccagcttaccagcctttgtgagtgttgaatttcagcatttctgtttgcttgcagcagaaggtggagccaggatagggtggctcaagattagagtttcttccttaacagttcagtcaactttttaatcttggatttatagcttcctacctgctctcttaaaggtgaaatgatctattcaccttcagaccatttgccctcggggtctcactgagcaatctatggcttaagtcttctaagtctcttaatggccaaatacaatggacaattttcaggtatatctgacaccatttctctgcagcctttggcacctataaccactccatggcttccacaatgtgattggtcatttcttttttgtttatatgacaagtttttattcttcttctgcctgttaaatgcgcctgacccccagtgttctgattttcactatttttcttaaaaaaaaaagtttaaatgaaaaaagtttcttatgaaaatattaaaacatatacaaaaatagaatagacattgataatagatcctaaaattcctagggaaattcagcagactgagaatagctaatatagtcttccaaaaaaagatcaaatttgaagttgagaaacttcttgaattcaatttactaaaaagctatagtaatcaagacagtgtagtcctgacataaagataggattatagtctgggtgtggtggctcatgcctgtaatcccagcactttgggaggctgaggtgggcagatcacctgaggtcaggagttccagaccagcctgaccaacatggtgaaaccccgtctctactaaaaatacaaaaattaaccaggcatggtggcaggtacctgtaatcccagctgcttgggaggctgaggcaggagaattgcttgaacctgggaggaggagccagtggccgggattgggccactgcactccaacctgggcaatagagtgaggctctgtcaaaaaaaaaaaaagataggattatagattatagcataatgggataaaattgagactccagaaataaactctcacatttatggtagattgatttttgataagggtgccaaaacacttcaatgaaaaaagagtcttctcaacaagtgatggtggaacaactgaataaccacatttttgttctatctggggccctgattcaaaaacccaggcaaagatggagagaaatcagaactctcatacactgctgataggaggataaaatgcttactttggaaaagaatgtggcaattcctcaaaaggttaaacagtgttaccatatgacccagcaaacccacttctagatatataaccaaaagaaatcaaaacataagtctacaaaaaaacttgtacataaatgtttataacagcactattcccaatagccataaagtagaaacaaaccaatgtccatcggctgatgaatgaataaataaaatatgttgtggtatgtccttataatagatattattggtccatgaaaaacatacataaaaacattatgctaaatgaaagaagccagtcacggcaaagcaatatattatatgcctctatgtatactaaatgttccaaatagaaagaaagtagattaaagattgtctagggctgggaggggaggaggaggagaatggaggaatctgggaggcgatgaattaagggtactgaattaggggaacatggtttctttttggggagatagaaatgtaaaattttggtaatggttgcacatctctgtaaatatactaaaatccattaatttttgcattttattttatttattttatttttgagacggagtttcgctcttgttgcccaggctggagtgcaatggcatgatctcggctcaccacaacctccgcctcccaggttcaagcgattctcctgtctcagcttcccgagtagctggaattacaggtgcatgccaccacacccagctaattttttttttttgagatgaagtcttgctcttgtctcccatgctggagtgtgatggcacgatcttagctcactgcaacctacgcctcccgggttcaagcgattctcctgcctcagcctctaatgtagctgggattacagttgcctgctatcacgcccggctaatttttgtatttttagtaaagacggggtttcaccatgttggccaggctggtctcgaacccctgatctcaggtgatctgccttcctcggccgcccaaagtgctgggattacaagcgtgagccactgagcygggccaatttttgcattttacatagatgaattatatggtatgctaattatatcttaccaaaaattgaaaaaaaggaatagtactatcagccccaatgtgcccatcatcaatattctacatgtttccaatgttattgtatctgtttgcctacagtcgaggccctgatatcctgtttgattttcttgaattgccaaaatttgcatacatgcttacaaaaataatgcctgttgaatttgctagatatgtaaaggtttggagcaaatcaggtgtattaaatttattaatattgtttgaaatgtctaaggcaataattcccaaacttcgttgagggagaaggaaagcttttaaaatcccattgcccaggtggcatcccatactgttactgggaattatgcattgggatggatcctttaaccgaggagattattatagccggagctctgaaccagcaatctcagttcttgtgatagtgagcaaagaactacaaactaacaccaaaatgcaagcttaaagcaaagtttattgaagcacaataatacactctgagggacagcgggcttatttctgcgaagtgaactcagcacttctttacagagctcaaggtgcttttatggggtttgtggggaggagttgaggtttgggctgtatctgagtgacaggatgatgttatttgattgaagtgtatagctatacaatctaaaattaaactgtgcatggtcttacctataatttgttaagaaaagcctcccagggatgggggggcaaaactgtatgtaaattctattataatgatggcatgatgaacttggggtgaacttgaagacaggcttttgtgttgttgggcatgtgccaccttagggaatttccacctgtaccctcctttctctttctccaggatattttggccacagactttatcataaactccatcccttagggtggcattagggtagtcttgggcctgaatttaggtgggccagtggctgtcttagtgacagcctttccgctctcttctgtcatcccctcccaactgctaatgtctaactacctaacaattacccattaaatcagtgtgtctggggttaggagcaggcctcaatatgtttaatcattctccagataatcccaatactgtaaagtttgtgaaacacttgtcagataattcaattatgaaggctgtggaaggtgtttcagtaggatctaattggttaatgttatgacttaattaatttgaatcaaaaaacaaaatgaaaaagctttatatttctaagtcaaataagacataagttggtctaaggttgagataaaatttttaaatgtatgattgaattttgaaaatcataaatatttaaatatctaaagttcagatcagaacattgcgaagctactttccccaatcaacaacaccccttcaggatttaaaaaccaagggggacactggatcacctagtgtttcacaagcaggtaccttctgctgtaggagagagagaactaaagttctgaaagacctgttgcttttcaccaggaagttttactgggcatctcctgagcctaggcaatagctgtagggtgacttctggagccatccccgtttccccgccccccaaaagaagcggagatttaacggggacgtgcggccagagctggggaaatgggcccgcgagccaggccggcgcttctcctcctgatgcttttgcagaccgcggtcctgcaggggcgcttgctgcgtgagtccgagggctgcgggcgaactaggggcgcggcgggggtggaaaaatcgaaactagctttttctttgcgcttgggagtttgctaactttggaggacctgctcaaccctatccgcaagcccctctccctactttctgcgtccagaccccgtgagggagtgcctaccactgaactgcagataggggtccctcgccccaggacctgccccctcccccggctgtcccggctctgcggagtgacttttggaaccgcccactcccttcccccaactagaatgcttttaaataaatctcgtagttcctcacttgagctgagctaagcctggggctccttgaacctggaactcgggtttatttccaatgtcagctgtgcagttttttccccagtcatctccaaacaggaagttcttccctgagtgcttgccgagaaggctgagcaaacccacagcaggatccgcacggggtttccacctcagaacgaatgcgttgggcggtgggggcgcgaaagagtggcgttggggatctgaattcttcaccattccwcccacttttggtgagacctggggtggaggtctctagggtgggaggctcctgagagaggcctacctcgggcctttccccactcttggcaattgttcttttgcctggaaaattaagtatrtgttagttttgaacgtttgaactgaacaattctcttttcggctaggctttattgatttgcaatgtgctgtgtaattaagaggcctctctacaaagtactgataatgaacatgtaagcaatgcactcacttctaagttacattcatatctgatcttatttgattttcactaggcatagggaggtaggagctaataatacgtttattttactagaagttaactggaattcagattatataactcttttcaggttacaaagaacataaataatctggttttctgatgttatttcaagtactacagctgcttctaatcttagttgacagtgattttgccctgtagtgtagcacagtgttctgtgggtcacacgccggcctcagcacagcactttgagttttggtactacgtgtatccacattttacacatgacaagaatgaggcatggcacggcctgcttcctggcaaatttattcaatggtacackgggctttggtggcagagctcatgtctccacttcatagctatgattcttaaacatcacactgcattagaggttgaataataaaatttcatgttgagcagaaatattcattgtttacaagtgtaaatgagtcccagccatgtgttgcactgttcaagccccaagggagagagcagggaaacaagtctttaccctttgatattttgcattctagtgggagagatgacaataagcaaatgagcagaaagatatacaacatcaggaaatcatgggtgttgtgagaagcagagaagtcagggcaagtcactctggggctgacacttgagcagagacatgaaggaaataagaatgatattgactgggagcagtatttcccaggcaaactgagtgggcctggcaagttggattaaaaagcgggttttctcagcactactcatgtgtgtgtgtgtggsggggggggcggcgtgggggtgggaagggggactaccatctgcatgtaggatgtctagcagtatcctgtcctccctactcactaggtgctaggagcactcccccagtcttgacaaccaaaaatgtctctaaactttgccacatgtcacctagtagacaaactcctggttaagaagctcgggttgaaaaaaataaacaagtagtgctggggagtagaggccaagaagtaggtaatgggctcagaagaggagccacaaacaaggttgtgcaggcgcctgtaggctgtggtgtgaattctagccaaggagtaacagtgatctgtcacaggcttttaaaagattgctctggctgctatgtggaaagcagaatgaagggagcaacagtaaaagcagggagcccagccaggaagctgttacacagtccaggcaagaggtagtggagtgggctgggtgggaacagaaaagggagtgacaaaccattgtctcctgaatatattctgaaggaagttgctgaaggattctatgttgtgtgagagaaagagaagaattggctgggtgtagtagctcatgccaaggaggaggccaaggagagcagattcctgagctcaggagttcaagaccagcctgggcaacacagcaaaaccccttctctacaaaaaatacaaaaattagctgggtgtggtggcatgcacctgtgatcctagctactcgggaggctgaggtggagggtattgcttgagcccaggaagttgaggctgcagtgagccatgactgtgccactgtacttcagcctaggtgacagagcaagaccctgtctcccctgaccccctgaaaaagagaagagttaaagttgactttgttctttattttaattttattggcctgagcagtggggtaattggcaatgccatttctgagatggtgaaggcagakgaaagagcagtttggggtaaatcaaggatctgcatttggacatgttaagtttgagattccagtcaggcttccaagtggtgaggccacataggcagttcagtgtaagaattcaggaccaaggcwgggcacggtggctcacttctgtaatcccagcactttggtggctgaggcaggtagatcayttgaggtcaggagtttgagacaagcttggccaacatggtgaaaccccatgtctactaaaaatacaaaaattagcctggtgtggtggcgcacgcctatagtcccaggttttcaggaggcttaggtaggagaatcccttgaacccaggaggtgcaggttgcagtgagctgagattgtgccactgcactccagcctgggtgatagagtgagactctgtctcaaaaaaaaaaaaaaaaaaaaaaaaaaaaactgaaggaattattcctcaggatttgggtctaatttgccctgagcaccaactcctgagttcaactaccatggctagacacaccttaacattttctagaatccaccagctttagtggagtctgtctaatcatgagtattggaataggatctgggggcagtgagggggtggcagccacgtgtggcagagaaaagcacacaaggaaagagcacccaggactgtcatatggaagaaagacaggactgcaactcacccttcacaaaatgaggaccagacacagctgatggtatgagttgatgcaggtgygtggagcctcaacatcctgctcccctcctactacacatggttaaggcctgttgctctgtctccaggttcacactctctgcactacctcttcaygggtgcctcagagcaggaccttggtctttccttgtttgaagctttgggctacrtggatgaccagctgttcrtgttctatgatsaygagwgtcgccgtgtggagcccygaactccatgggtttccagtagaatttcaagccagatgtggctgcagctgagtcagagtctgaaasggtgggatcacatgttcactgttgacttctggactattatggaaaatcacaaccacagcaagggtaygtggagagggggcctcaccttcctgaggttgtcagagcttttcatcttttcatgcatcttgaaggaaacagctggaagtctgaggtcttgtgggagcagggaagagggaaggaatttgcttcctgagatcatttggtccttggggatggtggaaatagggacctattcctttggttgcagttaacaaggctggggatttttccagagtcccacaccctgcaggtcatcctgggctgtgaaatgcamgaagacaacagtaccgagggctactggaagtacgggtatgatgggcaggaccaccttgaattctgccctgacacactggattggagagcagcagaacccagggcctggcccaccaagctgkagtrggaaaggcacaagattcgggccaggcagaacagggcctacctggagagggactgccctgcacagctgcagcagttgctggagctggggagaggtgttttggaccaacaaggtatggtggaaacacacttctgcccctataytctagtggcagagtggaggaggttgcagggcacggaatccctggttggagtttcagaggtggctgaggctgtgtgcctctccaaattctgggaagggactttctcaatcctagagtctctaccttataattgagatgtatgagacagccacaagtcatgggtttaatttcttttctccatgcatatggctcaaagggaagtgtctatggcccttgctttttatttaaccaataatcttttgtatatttatacctgttaaaaattcagaaatgtcaaggccgggcacggtggctcacccrtgtaatcccagcactttgggagkccgaggcgggtggtcacaaggtcaggagtttgagaccagcctgaccaacatggtgaaacccgtctctaaaaaaatacaaaaattagctggtcacagtcatgcgcacctgtagtcccagctaattggaaggctgaggcaggagcatcgcttgaacctgggaagcggaagttgcactgagccaagatcgcgccactgcactccagcctaggcagcagagtgagactccatcttaaaaaaaaaaaaaaaaaaaaaagagaattcagagatctcagctatcatatgaataccaggacaaaatatcaagtgaggccacttatcagagtagaagaatcctttaggttaaaagtttctttcatagaacatagcaataatcactgaagctacctatcttacaagtccgcttcttataacaatgcctcctaggttgacccaggtgaaactgaccatctgtattcaatcattttcaatgcacataaagggcaattttatctatcagaacaaagaacatgggtaacagatatgtatatttacatgtgaggagaacaagctgatctgactgctctccaagtgacactgtgttagagtccaatcttaggacacaaaatggtgtctctcctgtagcttgttttyttctgaaaagggtatttccttcctccaacctatagaaggaagtgaaagttccagtcttcctggsaagggtaaacagatcccctctcctcatccttcctctttcctgtcaagtgcctcctttggtgaaggtgacacatcatgtgacctcttcagtgaccactctacggtgtcgggccttgaactactacccccagaacatcaccatgaagtggctgaaggataagcagccaatggatgccaaggagttcgaacctaaagacgtattgcccaatggggatgggacctaccagggctggataaccttggctgtaccccctggggaagagcagagatataygtvccaggtggagcacccaggcctggatcagcccctcattgtgatctggggtatgtgactgatgagagccaggagctgagaaaatctattgggggttragaggagtgcctgaggaggtaattatggcagtgagatgaggatctgctctttgttaggggrtgggcygagggtggcaatcaaaggctttaacttgctttttctgttttagagccctcaccgtctggcaccctagtcattggagtcatcagtggaattgctgtttttgtcgtcatcttgttcattggaattttgttcataatattaakgaagaggcagggttcaagtgagtaggaacaagggggaagtctcttagtacctctgccccagggcacagtgggaagaggggcagaggggatctggcatccatgggaagcatttttctcatttatattctttggggacaccagcagctccctgggagacagaaaataatggttctccccagaatgaaagtctctaattcaacaaacatcttcagagcacctactattttgcaagagctgtttaaggtagtacaggggctttgaggttgagaagtcactgtggctattctcagaacccaaatctggtagggaatgaaattgatagcaagtaaatgtagttaaagaagaccccatgaggtcctaaagcaggcaggaagcaaatgcttagggtgtcaaaggaaagaatgatcacattcagctggggatcaagatagccttctggatcttgaaggagaagctggattccattaggtgaggttgaagatgatgggaggtctacacagacggagcaaccatgccaagtaggagagtataaggcatactgggagattagaaataattactgtaccttaaccctgagtttgcktagctatcactcaccaattatgcatttctaccccctgaacatctgtggtgtagggaaaagagaatcagaaagaagccagctcatacagagtccaagggtctttygggatattgggttatgatcactggggtgtcattgaaggatcctaagaaaggaggaccacgatctcccttatatggtgaatgtgttgttaagaagttagatgagaggtgaggagaccagttagaaagccaataagcatttccagatgagagataatggttcttgaaatccaatagtgcccaggtctaaattgagatgggtgaatgaggaaaataaggaagagagaagaggcaagatgrtgcctaggtttgtgatgcctctttcctgggtctcttgtctccacaggaggagccatggggcactaygtcttagctgaacgtgagtgacacgcagcctgcagactcactgtgggaaggagacaaaactagagactcaaagagggagtgcatttatgagctcttcatgtttcaggagagagttgaacctaaacatagaaattgcctgacgaactccttgattttagccttctctgttcatttcctcaaaaagatttccccatttaggtttctgagttcctgcatgccggtgatccctagctgtgacctctcccctggaactgtctctcatgaacctcaagctgcatctagaggcttccttcatttcctccgtcacctcagagacatacacctatgtcatttcatttcctatttttggaagaggactccttaaatttgggggacttacatgattcattttaacatctgagaaaagctttgaaccctgggacgtggctagtcataaccttaccagatttttacacatgtatctatgcattttctggacccgttcaacttttcctttgaatcctctctctgtgttacccagtaactcatctgtcacyaagccttggggattcttccatctgattgtgatgtgagttgcacagctatgaaggctgtrcactgcacgaatggaagaggcacctgtcccagaaaaagcatcatggctatctgtgggtagtatgatgggtgtttttagcaggtaggaggcaaatatcttgaaaggggttgtgaagaggtgttttttctaattggcatgaaggtgtcatacagatttgcaaagtttaatggtgccttcatttgggatgctactctagtattccagacctgaagaatcacaataattttctacctggtctctccttgttctgataatgaaaattatgataaggatgataaaagcacttacttcgtgtccgactcttctgagcacctacttacatgcattactgcatgcacttcttacaataattctatgagataggtactattatccccatttcttttttaaatgaagaaagtgaagtaggccgggcacggtggctcacgcctgtaatcccagcactttgggaggccaaagcgggtggatcacgaggtcaggagatcgagaccatcctggctaacatggtgaaaccccatctctaataaaaatacaaaaaattagctgggcgtggtggcagacgcctgtagtcccagctactcggaaggctgaggcaggagaatggcatgaacccargaggcagagcttgcagtgagccgagtttgcgccactgcactccagcctaggtgacagagtgagactccatctcaaaaaaataaaaataaaaataaaaaaatgaaaaaaaaaagaaagtgaagtatagagtatctcatagtttgtcagtgatagaaacaggtttcaaactcagtcaatctgaccgtttgatacatctcagacaccactacattcagtagtttagatgcctagaataaatagagaaggaaggagatggctcttctcttgtctcattgtgtttcttctgaytgagcttgaatcacatgaaggggaacagcagaaaacaaccaactgatcctcagctgtcatgtttcctttaaaagtccctgaaggaaggtcctggaatgtgactcccttgctcctctgttgctctctttggcattcatttctttggaccctacgcaaggactgtaattggtggggacagctagtggccctgctgggcttcacacacggtgtcctccctaggccagtgcctctggagtcagaactctggtggtatttccctcaatgaagtggagtaagctctctcattttgagatggtataatggaagccaccaagtggcttagaggatgcccaggtccttccatggagccactggggttccggtgcacattaaaaaaaaaatctaaccaggacattcaggaattgctagattctgggaaatcagttcaccatgttcaaaagagtcttttttttttttttgagactctattgcccaggctggagtgcaatggcatgatctcggctcactgtaacctctgcctcccaggttcaagcgattctcctgtctcagcctcccaagtagctgggattacaggcgtgcaccaccatgcccggctaatttttgtatttttagtagagacagggtttcaccatgttggccaggctggtctcgaactctcctgacctcgtgatccgcctgcctcggcctcccaaagtgctgagattacaggtgtgagccaccctgcccagccgtcaaaagagtcttaatatatatatccagatggcatgtgtttactttatgttactacatgcacttggctgcataaatgtggtacaascattctgtcttgaagggcaggtgcttcaggataccatatacagctcagaagtttcttctttaggcattaaattttagcaaagatatctcatctcttcttttaaaccattttctttttttgtggttagaaaagttatgtagaaaaaagtaaatgtgatttacgctcattgtagaaaagctataaaatgaatacaattaaagctgttatttaattagccagtgaaaaactattaacaacttgtctattacctgttagtattattgttgcattaaaaatgcatatactttaataaatgtayattgtattgtatactgcatgattttattgaagttcttgttcatcttgtgtatatacttaatcgctttgtcattttggagacatttattttgcttctaatttctttacattttgtcttacggaatattttcattcaactgtggtagccgaattaatcgtgtttcttcactctagggacattgtcgtctaagttgtaagacattggttattttaccagcaaaccattctgaaagcatatgacaaattatttctctcttaatatcttactatactgaaagcagactgctataaggcttcacttactcttctacctcataaggaatatgttacaattaatttattaggtaagcatttgttttatattggttttatttcacctgggctgagatttcaagaaacaccccagtcttcacagtaacacatttcactaacacatttactaaacatcagcaactgtggcctgttaatttttttaatagaaattttaagtcctcattttctttcggtgttttttaagcttaatttttctggctttattcataaattcttaaggtcaactacatttgaaaaatcaaagacctgcattttaaattcttattcacctctggcaaaaccattcacaaaccatggtagtaaagagaagggtgacacctggtggccataggtaaatgtaccacggtggtccggtgaccagagatgcagcgctgagggttttcctgaaggtaaaggaataaagaatgggtggaggggcgtgcactggaaatcacttgtagagaaaagcccctgaaaatttgagaaaacaaacaagaaactacttaccagctatttgaattgctggaatcacaggccattgctgagctgcctgaactgggaacacaacagaaggaaaacaaaccactctgataatcattgagtcaagtacagcaggtgattgaggactgctgagaggtacaggccaaaattcttatgttgtattataataatgtcatcttataatactgtcagtattttataaaacattcttcacaaactcacacacatttaaaaacaaaacactgtctctaaaatccccaaatttttcataaactcagttttaaactaactttttttcaaaccacaatctgatttaacaatgactatcatttaaatatttctgactttcaaattaaagattttcacatgcaggctgatatttgtaattgtgattctctctgtaggctttgggtataatgtgttcttttccttttttgcatcagcgattaacttctacactctaacatgtagaatgttactacaatattaaagtattttgtatgacaattttatttgaaagcctaggatgcgttgacatcctgcatgcatttattacttgatatgcatgcattctggtatctcaagcattctatttctgagtaattgtttaaggtgtagaagagatagatatggtggatttggagttgatacttatatattttctatttcttggatggatgaatttgtacattaaaagttttccatggcagaaatcttttcaaaaactttttttttccgggatggattgaaggccctgatttcaccacaatgcaatatattaatgtagcaaaattgtacttgtaccccatgaatatatataatcttaagaaaatttttttagccaattattattacttactagatattaggctgtgttctgaatcttaatttaattcctccaaagaatcttatgaggtaggtaggagctattgctgctattctgttatgcttatgttgctgttatgaaaccaaggcacagagaggttagttaacttgctgaagaaaatgatgtgctggatttttattctagctattctggaataacaactacacaaccttatgtctgagccaaggaaacatacggtgtggcaacagttaccatgtttttaggaacagcagcactcctaatgtttgctgcagggaaaaaggaatctcagaatttgcctgatccctataatttttttcctaaatattttgaaatatctttcagatgtattttaaaatttaaggatattttgttcagttcatacagaatttttttttttttctcgagatggagtctcactctatcacccaggctggaatgcagtggcatgatctcggctcactgcaacctctgcctcctgggttcaagcaattttcctgcctcagcctcccaagtggctgagactacaggcgcatgccaccatgcacggctaagtttttttgtatttttagtagagatggagtttcaccatgttggccaggctggtctcgaactcctgacctcaaatgatccgccctttttggcctcccaaagtgctgggattacaggcgtgagctaccgcgcccagccaaatttctaacttgttttgttgttgttgagacagggtctcagtctgacaccaaggctggtgtgcagtactgcgatcacggctcactgcagtctcgacctcctgagctcaagtgatcctcccacctcagcctactgagtagctgggaccaccacgcctggctcatttttttctattatttattgaaacgggttctggctatgttgcccaggttggtcttgaactccggagctcatgcgatccacccacctcagcgtccgaaaggattatcaggagtgagccaccgtgcccggccaaatttctaacttttgaattgacatattcatttattctctttatcattcagggagaaatttggggatggatagccttgaagcatcatccaccaagttattttatacaccagatttagatacaaagtatttttttattatttaaaaaaatcaaattctagcttttactctgaagattctaaaaagaattttggagtctttaattcatacttcaggggcaggggaataagtaccaatattcgtataactttcagtgcaagtcacgttagctaactgtagtctattgagttaaatatccttgatttattccttaaaactgagtcactatgacggcacttttttgtttttttttttcgagacggagctcgccctgtctcccaggctggagtgcggtggtgcgatctcggctcactgcaatctccgcctcccaggttcaagcgattctcctgccccagcctcctgagtagctgggactacaggcacacaccaccacgcccagctaatgtttgtatttttagtagagacagggtttcatcattttggtcaggctggtcttgaactcctgacctcgtgatcagcctgcctcgacctcccaaagtgctgggattacagtcatgagccactgcacccggctgaatggcactttcataaaacagtaaataaccaacttcactactgcccccaagagttttactatgtatatgagggcatctgttttaagtatgggtataatgttacgggtttttctttgtgtaagtttgggttcacaatttcatcattaaaacaaatgtaaaatactttgtgctttctgtgtgctattaagaaagtattcaagggaattttgaaaatcaaatttaattactctcatgtttgtaaaatttttgaaacaaatgtttaagagaggataatgttagaaattatctttccagccagacctggtggctcacgccagtaatcctagcattttgggaggacaaggtgggcagatcacttaagcccaggaattcaagaccagcctggacaacacagggaaagcccatctctacaaaatatacaaaattagtggccgagcgtggtggctcacgcctgtaatcccagcactttgggaggccgaggcgggcagatcacctgaggtcaggagttccagaccagcctcaacatggagaaaccccgtctctactaaaaatacaaaattagctgggcgtggtgatgcatgcctgtaatcccagctactcgggaggctgaggcaggagaattgcttgaacctgggaggtagaggttgcggtgagccgagatcccgccattgcactccagcctgggcaacaagagcgaaactccatctcaaaaaacaaaacaaacaaataaacaaaattagtcaggtgtggttgtgcacacctgtagtcccagctacttgggaggctgaggtgggaggatcacttgagcccggggaagtgtaggctaccatgagccatcatggtgccactgtactccagtctaggaaaaaaataaacattaaaaattttaaaatcttaaaaaaagaaaagaaattttctgtccagatatctttatttttaacaaatcgaagtgtattaatagtgtttatgggagcgtgcccacacaaggacagcaagcctaggaagtgcaagtcaagaaaactttttgtgaaataatttaaactgaaaagaaaaagcagagatttttttctagaaaagtaaggagtggaggtaaaaaaaaaacacagcagagacacaggtatgctacggaaccaaaggtgtgccaatggtactgacagtttaattcagaaaaaaatgaatcagaaaatggatatttttaaataagttaggttgctgaaaaagagaaatgcagtgaagccttagatgggagtgagataaatcagccattggctagaggagtttcttgcccaagaccagtggtgatgtccccaaatgcctggaaacaactgttgtgacattataaagcccccatagtctaagttgggtgagactatacttatgcattttctcacctgtaatatagcttaaaagtatttctactctgggatttctttacattttactaaagcgcaattatatacttaaaactgatagtgtatgctgggctgctagtcattctcaaccctggccaattatcagaattgtttgttgaatatataggtgccatatataggtgcatacacacacacacacacacacatacacacacacacacacacacacacaccatatttcattcctcatatcgaatattctgagagagttagtttgtggagggtagttctggacaatttatattttcataacacctctggttatttttttttaagtagagatgaagacttgctatgttgcccaaaatggtcttgaactcctgagctcaagcgattctcccaactcagcctcctgaagtgctgggattacagccgtgagccactgcattaacctctgattaatatcatagattaacctctgattaatatcatagatttatttgtttgaatgcttcatgtatcctctcaaccacaacttgtttgcagagttttaatctgaagggcttaggtctcttgttcaatgaatgagtttgatctgatgggtgagaggaaggtgaaatggaaagcgaacgagaagccatacagattaggcgagtgagcctaatctctccctaaccataagattgagtatgcctgaattcttcccagagtggaagaatccattttaaatatatatatctacatgtacagatcctttaaatatttgttctgacattcattgtttttgagtcactgtcattgagaaaagtttagaaaggagatattaggagcaggaaatagaaagtaaataaaatatcaaaataaaaatggggttttataaatgatataataggcaaaataaaggaaaggcatcctagacctctggttaaaatgaagatggcacttggcgagatgtgttccagggtagttcacatgatgtatgttttcagagaattgtcatattgcatatgctgctatattttttattttcatgaattaaaaggcatgttgagatttcagagttttacttatgatctcagactctgcattttttctctgtaatgtttgacatttcttcctagctaagtctctagttataaggtctgtgttgtggcatgtggacagtgagtggaagaacctaagaactcaatttggggcagaagaatgtaatcaattatttcagaagtgatacaaacaatatgacatgtagagcattctggcctttcctgggtcttttttctccattcctggatttcttctcttcatgtgagcaagtctgaggttactatataatgtctctcacaggc

SEQ ID NO: 12243 - DNA, 18656 bp, Homo sapiens
gttcaagaccagcccggccaacatggtaaaaccccgtctctactaaaaatacaaaaatgagctgggtatggtggcacgcgtctgtaatcccagctactcaggaggctgaggcaggagattcgcttgaacccgggaggcagaagttgcaataaggggaaatcgcaccactgaactccagcctgggcaatagagtgagactctgtctcaaaaaaaaaaaaaaaaaaaagaggaggaagaacttgggggagaatgggaggcagaagataatcatctcccaggaagcacagggacttgggcagggacccccaccccgcaacaatgcacacaccccacacctctctccttggaagggaggggccaggagggcctgagagactctacttgattttccagaagttacaggagagagtcgctgcaaaacagcccagcccatccaggtcagagttctcacccaaagtccaaagcctgcaatttaccagctgatgaaacgaaacaacctctgtatgattacctgtatgttaatgcctctgggcatcagtttcagtttcccagctgttaaattgtactaaaaatagcctgggtgtggtggcttatgctcataatctcagcactttgggaggccaaggcaggtggatcagctgaggtcaggagttggagaccagcctggccaacagggtgaaaccccgttactactcaaaatgcaaaaattagctgggcgtgatggcaggcgcctgtaatcccagctactcaggaggctgagacaggagaatcgcttgaacccaggaggtagtgagccgagatcacaccattgtactccagcctgggtgacagagtgagactctatctcaaaaaaaaaaaaacaaattgtaatgaaaatacagcctacccactggggctgggcgcagtggctcacgcccgtaatcccaacactttgggaggccgaggcgggcggatcacctgaggtcaggagttcgagaccagcctggccaacatggtgaaaccccgtctctacttaaaatacaaaaaattagccgggcgtggtggtatgcacctataatcccagctactcgggaggctgaggcaggagaatcacttgaacccgggaggcagaggttgcagtgagccaagatcatgccattgcactccagcctgggcaacaaaagcgagacttcgtctaaaaaaaaaaaaaaaaaaggcaaagaaaatacagcctaccccatttgaatgctacaagtgagaattaaatgaaatgatatttagcaaagcattcaggaagcggctggcaaacaagctcttcttccccatacatgctactgtgaaagcaacattggatctgggctactcttccactccaccctgttgtccccagtgttgtggacatttaagggatccagctgaccactgggccaacctcacagccagcctgcactgtccccaagccaggtggcagaatcccaaaccagtcctcctcacttctgcaccaatcttgtgttaaatactcagtgtccctggaaaccccagccaaggtcatctatggaacctgtgcttccggcacagctctcacttggccacttgatacctgcagggcagccaggagtgaccaggagctctctgggtgtcaaacatctatagcacctagtgtaacctcaccagctatttccaagaagccattcaagatgcactgctaacatttaaactgaaaaccgagtcagggttggctggaacctgtgagaccaggaactgacagccagttggaccagcatgccagggaccatgtcagatggatgtcaggtcataccagggaagatgagtggcaacatggcgttcaatgtactactggtgaattaaattgcatatttcactcctttcagaagcactcaagttcatgggcaaaaaggaatgccaagaaaagtactgatcagttctgatggccgggcgcagtggctcacacctataatcccagcactttgggaggcagaggtgggaggatcgcttgagcccaggagttcaagaccagcctgggcaacatagcaagaccccgtctctacaaattaataaaatatttaaaaattagctgggcatggtggtgccacctgtggtcccagctattcagaaggctgaaggagggttactgcttgagcccaggacttcaaggctgcaatgagatatgatcacaccatttcactccaaccccgggtgacagaatgagaccaaaaaaaaaaaaattctgagcacaagggtatgccacccgcactccactctacccccggccagaaaagaggctaaactaagcaaaaggttatttggcgaattgcatgggaaatactgtatactcgttaaataaataacaaaattgtgaaaataaagtaagactttgtagagacaagctataaaaaatgtgtgaaatgctcataactagcaagagagaaaagggtaaaaaggatggataagccgcaaagagaaatcatcctatcctgtgtaggatgacgtaacttggatccagcaggaaggctggcccaacattaagtaggggacataggaaggggtgggtagagggaggaaagtcctttgtgtggcctcaggctcccaattctgccaggttacaatctcgattaatggggggttgggcaaaggctcatcattaaaggaagagttcggccggatatggttgctcaggcctgtaatcccagcactttgggaggctgaggcaggtggatcacttaaggccaggagtttgagaccagcctggccaacatggtgcaatctcatctctactaaaaatacaaaaaattaaccaggcatggtggtgcgcacctgtaatcccagctactcaggaggctgaggtgggagaatcacttgaacctgggaagtggaggttgcagtgagccgagtgccactgcactccagcctggggcgacagagtgagactctgtcaaataaataaataaataggagatactgttcttcagcccctcctccttcctgctggctggaatgtagatgtgatggctgatgttccagcagccattctatgccatgcggtagaagtcacatgctgaagatggtgcagtaacaagatactgtgcaaggagcaacagggttccgtgtaaagaagcctggaccctgacattgagggcaccatgccaaccctgcaagactcatttctaggtctctttttttttttttttaagacagagtctccctctgtcacccaagctggagtgcagtggcgagatcttggcccactgcaatctccgcctcccaggttcaagcaattcttgtgcctcagcctcccaagtagctaggagtacacgcacgcaccaccataccaagctaatttttgtatttttagtacagacaaggttttaccatgctgcccaggctggtctcaaactcctggcctcaagtgatcctcctgcctcagcctcccaagtagctagaactataagtatgcaccaccacacccagctaattatttttattttttgtagagacagggtctcaccacattggccatgctggcctcatactcctggcctcaagtgatcctctctccttgtcctcccaaagttctgggacgacagtcactgcacctggcccaagaaatacatttctattatttttttttttttttgagacagagtttcgctcttgttgcccaggctggagtacaatggcatgatttccgctcactgcaccctccacctcctgggttcaagcgattctcctgcctcagcctcctgagtagctgggattacaagcatgggccaccatgcccagctaatttttttgtatttttagtagagacagggtttctccatgttggtcaggctggtcttgaactcccaacctcaggtgatctgcctgcctcagcctcccaaaatactgggattacaacaggcatgagccaccatgcccggcctctattatatcttgttaaagccattatttggtttttggtctcatacagctgaattgaatattaaccaataaatagaggaaataagaatcttttgtgttagaagatgtggatcaaggtctgtaatagaagtggggttccctgccaggcatggcagctcatgcctgtaatcccaacactttgggaggctgaggcaggaggatcacctgaggtcaggagttcgagaccagcctggccaacatggtgaaaccccacctctgctaaatatacaaaaattagccaggtgtggtggcaggcgcctctagtcccagctactcaggaggctgggaaaggagaatccttgagcccaggaggcagaggttgcagcgagctgagatggcatcatctctacactctagcctgggcgacagagcgagactctgtctaaaaaaaaaaaatggcgcttccttccaaggtgggagacagagataaaagaggggtagggaaattctctgaattggcagaactggtagtagaagcaaggctcattcctggataaacagaaatggtgagagaagaaatgggaaaaatcaaggacatccctgcagtgacagctgtggagggtggggagtttactatgctagactatgtagggaaacgcctcctggcttgacaggttaggtgcctgtgttgacaacggttgctgagagctcaaggtgaaaagagggatagttccaggaaatgataaccctggtgataaactatccctgccctccctatcttcattgtacaggcctagaaactcgtgacgacagaggttaggtgacacctgcgtggcacagttcgtctggagggtgacaggggcaagccttcatcactagcagggccaaaaatccctaaagcctcaggactggggcaggcctcagagcactcgttcacagtttgtttccatcattttatttttttgcggagaagggagtctcgctatgttgcccaggctagtctccaactcctggactgaagcgatcctcctgtctcggcctcccagagtgctgggattacaggcaccgcactaggggccacacgcggccccatcattttaataattcataattaccacgcttagaaacctgcctcagattcattccccccgcagcaacacccaccatccaccctcctgtcccctcccccatgcacagcccttacatctgctcttcagggatctcaactagggcacatggtctggccagtgaggagccttcaactagtgcggccagaacgctgaaggccggatacaaggagcctcggtgtccaggcaggggatttggggttgcctgagattggggcggggaaagccggagacagtgggcacagatggcgaggggttcacctccccaacacccccaacccagcccagtctccgaggcccgagtggctgctttttgcgccacctggcggccgtctccagcgagcggagcgcgggtgaccgtgcctgcgggacccggttcccgtggggcgagcgggcgtggggcccgcccagcttggagagccgggaaccgcgcggcccagggactggcaagactccggattcaacccctgcgaggccccgcaacccggtgcccgcggtccctggcggcggcgcccgcgtgcccgaggcgctgcggggcgctgcggggcgcgcggcggttagagcgagcgtgtgcgcacgcgcccaccccacgccgcgccccgcaccgccgcgcgcgcgcacgcacgcccgacgctggcctgcgccggccgctctcccacgcggggtctcgggggctcctgagccggccgcctccaggaagcaggcgccgcgcggtattgccgcatgcacctcggtcgtggggaccccgctgcagcagccctgtccacacgggtgaactcctggagggcggggcggggggcaatctgcgcgggtcaggcccctcggagcaggctgggggcgcccgagccaggccgctcccacctgccagccgcgtggccaatgaatgctaggcctggtgatgtcatgccccgaccggaccctggtgacgaaagtccgaagtcacccgtcagggaaccagcacagacccacccgcgggggttccagaagtttccactgccgccgcggagtgcggcctcgcccagcagccttgcgcgtgctaccacgctgtcctgccttctcaggtgtcccaagtcaccccttcctcccccaggggtctcctgtctccatgccctcccacctcatttccactagcgatcccattttacatctccattcccacaggtgtcctttcatccccaggagtgtcccacgtcaccttttctgcacccgtgccacctggacccctaaggggacggtmctctgccacactcccacatgcctctcctcccatgccacccgtctgtgtcgtggccggggatgcatgaccccttggccttgcgctaacttcaccagcctcgagcgagaccgacagggtgtccaagtgtgtccgtccgtctgtgaaagtcgtccctgcgtttgtctgtgcctgtcactgcatgaggtcgtccgtctgcgcgtgtctgtctccacgggcttctgtccgtctgtctgtcacgtgggtgtctactccgccgctgcaggtctttgggtcgcgtctgtcactgcgctctgtcgtcggtcggcgtctggcactggagtgcgtctgggccccggggtctccgggtctcggctccaagggagggagagagaggggaggtggccacccgggagagcggggaggggcgggggcggagacagtgggcgggggcgggcgggggcgctgtgaggcccggagggggtgtgtgcggggggccggaggcggcggctgtcagagtcggctcagcctgcgccggggaacatcggccgcctccagctcccggcgcggcccggcccggcccggctcggccgcctcaggtgagtctccctccccgcccgggactctccttaaggcccgggtccggggcaccgtgcgctccccgaggggtccaggcccccctaacgggacggctcccgcttccccgggcctgccccgcgccgccctccgctgccccgcactcgtccggaactcttccccggccgcctcacactcaccgacgcccacgcaggagcccgagcccgcgggaacggccgccgcctctgcgctccgattcccgcggggacccccgagcaccccttccccgatcgctccctagtccggggccactggaagacaccccctaattggggcggtacccgagctgcgcaggttcccggcgccgggctgggcacccccatccccagggccacaagcccagcgcccctgcgcagcgccccgcagaggccccctccgaggcccaggacgccccctcccgcggagactccatctctattttttgggaaggggaggctcggcggaagccccgagttataattagcgccactcgggtttcctagttaatctccagcagcaccaccacccmccgctcagggcggcgggggctgggctaggagtgaccggcgggagaggggggagttcccacccggggaattttgatcctttggctggagatgccggaaccgtagcagctgctgcccccaaaatagcgcccccgcccctgcagccggggatctccggagtcccgggaacgcaggmgtcccggctcgcccttcaggcggctctgcaaggccctcgagcccccaggccccctccccaagttcccggctcctggctcggggcggggagcgccgaccttttctcggtctctactgccctccgccggcggcggcgtgyacggcagcttcagacggatggggggctctcgagtcctgggggacgcgggctggcgagcctgtttgctggggctgsgctgggagcgtgcgcagctgatgggaacccgcgggcatcagcgctcggtgccagacattggatgagaaggggcagggttgggtggggagtggactaggcaggatttgggggaccccgggacctgaggcttccacaccctgaatgcccagcccaccgccccccagggccccrggtctggccgacccaggagagcgrggmtgcgccttcaggccgccgcaagctcccccagcggcgctgcccgtccgtgaggccgcgcccctgtcgggtggcctgttcgtggactgaggcttctggtgccctcactgcacgagctgggcccggcccagttccgggaagaggtgagggcagtggacccctgcggagcagaragggtgctcctctctgttccctgcatttgtctggatatgggtgtctgcctgatctctttcccctcctgcccgctggcctgtgtccttgtctctgcctgtctccttccctccctccctctctcccctcatctttgccaacctgccccacctcctctgcagctgagcgataacccttgggccgacagtgccctaatctcctccctcctggcttctcgaccgacccttcaccctttccctttctttctcccagcagacgccgcctgccctgcagccatgaggcccccgcagtgtctgctgcacacgccttccctggcttccccactccttctcctcctcctctggctcctgggtggaggagtgggggctgagggccgggaggatgcagagctgctggtgacggtgcgtgggggccggctgcggggcattcgcctgaagacccccgggggccctgtctctgctttcctgggcatcccctttgcggagccacccatgggaccccgtcgctttctgccaccggagcccaagcagccttggtcaggggtggtagacgctacaaccttccagagtgtctgctacyaatatgtggacaccctatacccaggttttsagggcaccgagatgtggaaccccaaccgtgagctgagcgaggactgcctgtacctcaacgtgtggacaccatacccccggcctacatcccccacccctgtcctcgtctggatctatgggggtggcttctacagtggggcctcctccttggacgtgtacgatggccgcttcttggtacaggccgagaggactgtgctggtgtccatgaactaccgggtgggagcctttggcttcctggccctgccggggagccgagaggccccgggcaatgtgggtctcctggatcagaggctggccctgcagtgggtgcaggagaacgtggcagccttcgggggtgacccgacatcagtgacgctgtttggggagagcgcgggagccgcctcggtgggcatgcacctgctgtccccgcccagccggggcctgttccacagggccgtgctgcagagcggtgcccccaatggaccctgggccacrgtgggcatgggagaggcccgtcgcagggccacgcagctggcccaccttgtgggctgtcctccaggcggcactggtgggaatgacacagagctggtagcctgccttcggacacgaccagcgcaggtcctggtgaaccacgaatggcacgtgctgcctcaagaaagcgtcttccggttctccttcgtgcctgwggtagatggagacttcctcagtgacaccccagaggccctcatcaacgcgggagacttcmacggcctgcaggtaactagtggctagctggcrtgaagctggctcctctgggtcccaacggtccctcccctccctgcagggacccaggcatgagggcttctccaggcccattcccagaagtcccagaagtcctccctgagggctcagatcccagggtggtcagcagggcagacaggaaagccaccatgggtctattttctctttctctgcatccctcccctgatctcgtcctctctctgtccatggttccgggtctgtaactgttcatctctctggctctttstctgtccatctgtttctgtctacttgtctgtctgtgcctgtcgctccatcccacccccctctccctcacccccaggtgctggtgggtgtggtgaaggatgagggctcgtattttctggtttacggggccccaggcttcagcaaagacaacgagtctctcatcagccgggccgagttcctggccggggtgcgggtcggggttccccaggtaagtgacctggcagccgaggctgtggtcctgcattacacagactggctgcatcccgaggacccggcacgcctgagggaggccctgagcgatgtggtgggcgaccacaatgtcgtgtgccccgtggcccagctggstgggcgactggctgcccagggtgcccgggtctacgcctacgtctttgaacaccgtgcttccacgctctcctggcccctgtggatgggggtgccycacggctacgagatcgagttcatctttgggatccccctggacccctctcgaaactacacggcagaggagaaaatcttcgcccagcgactgatgcgatactgggccaactttgcccgcacagggtcagcagtgcagagggagagaaggctggggaggacaggagtcgggggcgggaggacacacaaaggcagacacacggagacagaaaggacgggtgggacaggggcaggatagaacagccagagagggatatgctcacaaagtagataaaaggggagagaaaaagaaaggagacagagaaggcagagggggtcttgcagagacagaggcaaaggaaagtgaggaggagacgaggtagacatggagggggcggggcacagtggctcacccctgtaattccagccctttgggaggccaaggtgggaggatcccctgagrccaggagtttgagaccagactggacaacataacaagaccccgactcttaaaaagaaaaaaaatacaaaacttagccaggcacggtggctcgtgcctctagtcccagctacttgggaaggtgaggcaggaggattgcttgagcctgggaggttgaggctgcagtgagctatgatggcaccactgcactccagcctgagtggccctatctctggaaaaaaaaaaaaaaaaaaaaaagggagaccaagacaaaggagttggagctggattaagtcaaaccagtgatgattcactagcagtgacacattctctcacacacacaycagtttacctggatcgagaagaggacaatgaaatctagcattggatgggtgttgttaaaaaatgtgatgtttgtagacataggacccgtcctggttatttaggaaagtctcaagacatcctagccatttttttagtgagagaaacaaagatggaacagaaaagctgagggaaacggaaggagacggagcgcttgaggaagggaagaccccaatgaccgcgcacattggagaaagtggtgggagggaggggacgggttctctggggctctccgctgagctgaagagtccgggatcccgtggagttgggggccacctcctcccactgcccgtctggactgagccttcccttccttccgcagggatcccaatgagccccgagaccccaaggccccacaatggcccccgtacacggcgggggctcagcagtacgttagtctggacctgcggccgctggaggtgcggcgggggctgcgcgcccaggcctgcgccttctggaaccgcttcctccccaaattgctcagcgccaccggtatgcaggggccagcgggcagcggctgggaggaggggagtgggagcccgccaggtgtaacccctctcttctccccctagcctcggaggctcccagcacctgcccaggcttcacccatggggaggctgctcsgaggcccggcctccccctgcccctcctcctcctccaccagcttctcctcctcttcctctcccacctccggcggctgtgaacacggcctcttcccctacggccacaggggcccctcctctaatgagtggtcggaccgtggggaagggccccactcagggatctcagacctagtgctcccttcctcctcaaaccgagagactcacactggacagggcaggaggagggggccgtgcctcccacccttctcagggacccccacgcctttgttgtttgaatggaaatggaaaagccagtattcttttataaaattatcttttggaacctgagcctgacattggggggaagtgggaggccccggacggggtagcaccccccattggggctataacggtcaaccatttctgtctcttctttttcccccaacctccccctcctgtcccctctgttcccgtcttccggtcattcttttctcctcctctctccttcctgctgtccttctccggccccgcctctgccctcatcctccctctcgtctttcgcacattctcctgatcctcttgccaccgtcccacgtggtcgcctgcatttctccgtgcgtcctccctgcactcatacccccccttcaacccgcccaaatgtccgatccccgaccttcctcgtgccgtcctcccctcccgcctcgctgggcgccctggccgcagacacgctcgacgaggcggagcgccagtggaaggccgagttccaccgctggagctcctacatggtgcactggaagaaccagttcgaccactacagcaagcaggatcgctgctcagacctgtgaccccggcgggacccccatgtcctccgctccgcccggccccctagctgtatatactatttatttcagggctgggctataacacagacgagccccagactctgcccatccccaccccaccccgacgtcccccggggctcccggtcctctgcatgtctcaggctgagctccctcccccgcggtgccttcgcccctctgggctgccaataaactgttacagccacgggagtgtgcgcgactagggagccaggggtagaggcagaacgccggaatcacgggggccgagtctatgcaggagcggggctggagggcaagaaacaggcgagctccgaggcgggcgcaaggcaaaggccaacccctagccctgccctgccgggcggagctcgcgcctgcgtaatgaggcccgcaggcaggctagctggcacggcggaggggaggagaggggaggggaggggaggggaggggaggggmggggcggggcggggcgcggcggagcattgtgggagctcctcggtcggtgccggtcggtggctgcctattgcggcctgcggtgatcaacgaggcccggggagcgcgtccccagtctgcgcgccggtcctgcggcagctggcccaagacccggagccgaaaggaagtgttggagcctgaggtcgctccgcgccgctaggaggacgctgtgcctggcctgggacctccgctcccgcccaccgccctggagccgctgagggacgtccacgtgggcctgtccccgccgagccgcggccctgtccgcctggcgctgctctcgggccactacctctactaccactacggctgcgacggcctggacgaccgcggctggggctgcggctaccgcactctgcagacgctgtgctcgtggccagagggccagcccgcgggcgtacctggactggccgccgtacaggcggccctggaggacatgggcgacaagccccccggcttccggggctcccgggactggatcggctgcgtggaggccagcctctgcctcgctcacttcggagggccccagggacgcctctgccacgtaccccggggagtggggctgcacggggagctggagaggctttactcgcacttcgcagggggtgggggcccagtcatggttgggggggacgcagatgccaggtccaaggccttgctgggagtctgcgtagggtcaggcacggaagcctatgtcctggtattggaccctcactactggggcactccaaaaagccccagtgaactacaggctgctgggtgggtgggctggcaagaggtgagtgcagcctttgaccccaactccttctacaacctgtgcttgaccagccttagctcccaacagcagcagcgcaccttggactgaggacgaagttacagaactgagattctcgggtcccagacacgcacctatgtacctcccactggtgtccctgcaaagcctggcgcttttgacatcaataataaaagtggcagggctgagcaacacctcaggagttactctggaaggatggaggagttatgtaacacacgagagtcaggagccctgtggaagtgcttttattagcagtaaggctgatcgtacaaaaaattctcagagcttcataggacaaggtagtacaagtatggatgatacaggactgaggaacgggggacggctcaaaagaaatcwacatcgtctggggcatccaggtcccgatattccacaatggcccttggrtctccacgaaccatcctgtgaagtgagaggtacaggatgagagctgagggctcccaaaagggagtctgcaggcggcaacaaagcttgggcgtctgccctcctcacctgttgcgaggtttcccaggataacctccctggcctcggaaggcatcatagttccctcgaccagcaccatacggggcatgggggtatggagggcctcctgtggggactgcagggcggacagcaccagctatgacagagatcagtgttgagttgcaaaactatgtcctcaattccatcctctgttttcttctcccaaagccacacactcaccaagccccttcatctccctcctgtacttacctccatagcccaagatcgggggccggggctgaccatagggcatcaggccctggggagtctggtgtgggtaggggagtcctggggtcaaacctggggggagtacaacacggacagggacatgaattactgcgggggcggggagggggatacgggtacaattgacttctagggctatggcctgaggatggggcagaaacttctcggggtgacacgttaaagagaaacaggagtccctgggtagtcaaggaagagggcacatgcgaccttcatggatcgtatcttactctgggcggggccaggtggctgggctggcttgatctcaggcagagctgggcgcttagcatcagtgaggaagttgttaaaaaacgcgacttcctttttcacttcctcaattttctctgcatgcttgttgaagatatgtttgcgcacaaactcaggaccctgggtggagagaggagaggggtcaggacagccacataagggttgcctcgctcccaggcccgagctggaaggattcccagctcccgcctgccagtgcagtaagcagttcccccacccctgcccagggggcttcctgtctcaaccccacctcccaccaccgtagcacggccattctccaacatcccacaccttgaatttcttgccactgagaggacacagccacttatccttgcccagttcctgcgtgttggaggtgacgaacttctccacttcctgctctgggtctttgcgccccatcttctgggcctcttcctctgagagtgactcccgcacactcagcaacggcgtgagcttctcctcaaaagtcttctgccactccagcactgtggtttgggaacagaggaaggaaggttggcaagggagccagaaggaaggatggtggcaaggggctggaggaccaaggccaggggcagccgggaacaaaggggaacctggagctcaccttccccgtgactgatgcggttgggtggcatgggcccccgaacgtggatgatcccacagcgattgggcatctcgtcctcgttggggtactcacaggtgttgtaataatccaaggaatgcacgatgcgcaggtaaaggaggagcttgtccaagacctaagggaagtgaatgcgagcgttcagctcctgccctcaccgcccgagcccccacgtgccccgcgctgccactggcaccttaatcaacttctcatcccgctccacgttgatctctgccgggttcccttccttaggaggctcctcaggaggagcgcccccgctgctccccagcagctcctcctcctcggcgcttacttcctcgatcaggtagtcggtgatattcttcaagatcgggttttgcgagggcaggctctgatgggaggaagagaagcaagtaaggcagagaagaccttcagaggaggtaacctgagactttccacaagtgaaagagcagcgaggggacaggagttcaccggacataaatggcaccttttgcccccttgagatttgtctttattttagcttttgttccaccccagccacaaatgatcactagcatccccccagttctgctggaatctggaggtgctgctacccacacacgaaggggcaaatgagtgagcaggcgagtgggtgcaagggttcaaggctacagataggtaaggtcagaggtgcccacagcagaggcactaccagttgcttctgacaaagtcctttggggagtcactgaccgtgggcaggggaggcgtccctggttctgaggcccaaagctgtgtcctgtcatccagcgtgtggatcagcttggccgccagcttgatgtcgttgcgcacaatctgcttgtgctgggtgatgccgttgatgttgcgaacgcgccgggtcaggtccctgttcacaccagggctcagctcacactcccggagctggagggcagacatcatcagcagcttaccccacttaccccgcttgccagagaaacagcagctctaagacccttccctcttgagcaccagcgattgatcagactgcgagctccctggggacggggaccacataggttccgtccatgctaacgccctagagccttgcccagagacaacgtagccagacaaaacggtcaaagagtgtgcagaacaaccaaactatcagatgaacaaagtcacacagaggtcccgtgtggcacagagtctcccttcctcttccccacagtcccacccccagcactcacacggatgttctgcaggttccaacagatctctttaatgttaacactgcggtcgaaggtcacccagccacgacggaaaaacctacacaagaaagaaaatgttagcatagtcaagcgagggagttggtgttggccattaacgttcccctgcacttttccctccaacgcaccgagttactcacctcctctctggctggggctctgagagcgccacccgcataaagcctgggtaccttttacaaagctgcaagaagcagaaaagcagccccacagtgactcaaggattcattcgcttcttcctccaatcccccactgccctcagaaccctagggactaactgccttatcactcttcccatccttgggcagggaaaaaccactaaagggcttcagaacaccagcacctgaaagccaatggcgctatcaggactagtcctcggaggccatggaacctggggaaggggcctccctagcaggtgaaacgggggcatctgtcacaggcagggccccactgccttccctctaccctccacttctccatcagccctgccctgactccacgggtccccactcacggagatgatctcggcccgggagatgttgggcgcgatgttgcgcatgaagagggagcaggtcttatgcagcggccgcggcttgcactccagccccgcggcgtccttgggcttctcccattcttcttccttgggcttctccttctccttgagcgcttcttctaggcaggaaggggggtaggaaggagttggtgcatttttattactgattgtggtggggaggatacagaagctttcccctaaaagccacccaccctcccgtcaatgtcgccaacctctcacctccccacccgcattaggagaacgcactttaaagcagaaaagaaaccctaccggcctcctccttctcctcctcagcctggccgctctctgactccgactcagactctgacacgctgccctcgtcaaagctgtcgtcaccactgtgcttccggttccgcttcttgctactctgtgtgagccacagcagaggggacaagtcagcgtgccagaaccccagccccaacactctgaccccaggccacagacacctcacctttttggcttccttctcggagtcttctttcttctcttccttgtccccatcaccctccgacttctttgttttgtcatcattagaactgtcattctcagcctatggtaagagacaaccactggggatgtcaaacctcccctcccacctttatcagagggcccccacccccacagctgaggccacaggttcattttccccagccccctacttctagctcctatggacccctacccgcccccctcccccaggctgccagggacaacactaggagacccagggctcggacctgcttgccgtcttccttcttctcatccttgtcgttggttttgcgctccccgtcccctaggcctgctccagcccgtccttcttctttcttgctgggctccccaggctttcctgcctgctcctcctcctcctcctgctccaggatgcgragatcattctccgtgcctccttccatcttaatcacggctaccaacaaagggaacagaggtcatgaccccagggccctggctcctgtcaaccggcttctacctgatccccagacacccccacccccatggggcccagatgcctgccacccctccaaatccgcacacctgcatccagcatcttgacaatggcatcagctttgtctatgtccaggagaaggttatcaaaccagccagtctccatgagggacaggaagaccctcagtcggttttgcagggccccccgggcctcctgccgacgcttccccacctcatctgggtggtacttagaccgaaacctgggaacgaagcgggggagggaaagacaaaacagttattggaagccaaggccaggatgtgggaaggggcccaggaaagacagggca

SEQ ID NO: 12244 - DNA, 53328 bp, Homo sapiens
acatgggacaattgataaaaagctaaattgtaaacagtccttgccccagaggacccatggtcttagggcagatgtttacatatatgacagtaatgtaatgtagaatgtgaagagtaccatgacagagttttggagaacaatgtgctgtagaaattcagaaaagggacagctcatttctagttggtgaaagccttcatgaaagtggcaaagttgaacctgagaggcatatttagagggcaaagattgaggtgagggcattctagccagaagtgctagggaactttaattgagcacatactctgtgccaagaactgtaccaagaactttacacatacatgactcatttaatcttcataactctgtaaggtaggtactgtcatcccgatttaccagtgtggaaaatgaggctctagagcagtgcccggtagacttttcacaacgatggaaatgctcaaatatctgcactgtccaatacagttgtgactagccacttgtggccactgagtgctgaaatgtggctaatgtgactgaggaactaaatttttgattttatttaattaattagaatttaaatttaaatagccatacctggctaatggttaccccactggatagcaggctgtagagagcttaggtagcttgtcctagtcacacagtggtaggttcaaacccaggcctgttggacctcaaaacttgaggtcttaacctcagtgttctacagtatggtaaaggcctagaggaggcttcagttctgttcctcgtatcaggcaaaacatgactgcaaaaccatagagggagtaacataacttaagcaaagattgaagatgggaagttgctggcaagaagatacagtttgaaggggagtggaaaatgtgtagaacagagtatctgatgctggtgtctgtgatttgcagctgttttttctcccctagttaaaaatgggctttgagtgagccttgaacctgtcttggactaattcagaaagcctccaagagattgcccccttagataagtccagtaaatgtagttgtctacatttttcaaaaagataaatgggaacaagtgtgctacgagattcagacatctgacgtgatgttttcgttgttgcctcagcaacagatgcggttatgaacattgacaacataagcacacgattgcagatacacataggcgtataaagcacacaaaaagaagattctctgaatggttttgtgcttatgatgtattttcaatattgagtaattatcaagatactaatttatagttatatagcattttatagttaacaaaatatttgaaatggcatatttttttcagctgtacaagaaaggtagttctattttccttttatatttgaaataggctcaaagtttgcccagggagcttaggttctttgacttatagagaattcatgatttgtttctaactcttctatttactgtaacttcaaagtggaaaatgaaccatataaatgtgtaatagaattatttctaatatatcaaaataagtaaaaataaaaatataaagcaatggcgattagaaggcagcttgtgtgtgagtgtgtctgtatgtagttattctttagtcctaagagccaagatagttgttttgttgacattgggcttgtgctgctgttacgtgggcctgagtcccctagaaggagaggcagaggaattttaaatcagagtgggtatgactaggctcctgactctgcaaactcatgtctagttgaggtgacaaaactacagtttaaggcaggttgtaatcacagctaatatggcactttgactgtgttatctctgtacctcacaaaaaccctgtatggtgggtgttcttatttgcatttcataggtgaggaaatcaagactcagagatgaaatcatctgtctagatcatagatagcaagtggcaaagctggaaatgggatccagtctctgatctttctcacaccagggcctgccctttttctatgtggtgttgcttctctaagtaccaataatatagttccaagttttttaagagagggagaagcaagtggggtttgaaggatcaggaaatatatagtacctgagctggtcatttaaaacgggtatgattttgatcaatagtatggcagagatggcactcagggcaggagagcaaagtcagagaaatttgcatacctcctttgggtgatgttgaggagagctcaggctgatagtttccattttgacttctttgtgctatttctgcagggaggtcctggccagtgaagccatccttaatgttcctgataagtctgactggaggcagtgtcagatcagcaaggaagacgaggagaccctggctcrccgcttccrgaaagactttgagccctatgactttactctggatgactaaaacaaagggaagaactttttatgaactccacaggaagtagtaaagcttttttttttttttaattaaaagaattttttttgagacaaagtctcgctctgtcacccaagcaggattgcagtggcataactgtggctcactgtagcctcaacctcctgggctctagagttcctcccacctcagcctcatgagtagctgggaccacaggcgcatgctaccatgcctggcaaacttttttgattttttatagagacaggagggtctccctgtgttgcccaggctggtctgtaatgcctaggctcaagggatcctctgccttggcttcttaacctgctgggattacaagcatgagacaccattcctggcctagaagcctatttttaaagaaactacaatctcccatggggactgtttccctgcctcttttgtgcagtcccatggaacttgcctacagcaagaggcctaagattgaatctttttggggaaaagtcattctaggatgaaaatcctatgttaaggccgggcgcagtggctcacgcctgtaatcccagtactttgggaagccgaggcaggtggatcacctgaggtgaggagtttgagaccagcctggccaacatggtgaaaccccgtctttactaaagctacaaaaattagctgggcgtggtgccaggcacttgtaatcccagctactcaggaggctgaggcaggagaattgcttgagcctgggaggtggaggttgcagtgagccaagatcgctccattgcactccagcctgggtgacagtgaaactccatctcaaaaataaaagaataaaagtatgtctgtcatccagctcctatgtctgttatccagctccaagtacagcttgtgtatatcaacattttcaaaaacctttaaactaccaaatgaaatccagatgtttttccatggttgagaagtgtcttgtgttcatgttgcctgtgaccgttgaaatgaagtagtatgtgtaatagcaggggctagagctttaggcccagctgttactccaaaatcacacagggcagtttctccctgaacaacccaaagtggaaaagggatccaaggcttttgctatttttctcttaaagcattcatcttattcatagataagagcccatttagtccttcggatatttaactcctatgtgccaggcatttttctaagctccaggaccatagtcatgtcccaatatggtccctgttgtcccagagattacagtttaatggggaatagaagggacagatttaagaaaaaaaagataattctcctttggatattgttttaggtgcttgatatatctaatatgtgtctgttgtgctgctgggcagttctaaactcatcagtacctgggttggttacagggctttggggatcatcagggtataggccataggtgaaattaagatagggtaaatacagtcctgagctgaagatgattacctgagaaatatcagtatttaaggagtgcttgaaaatagtgatctaacatttacatagagaaggagcaaagagaatgctacatattaggcgcaaaaagaaaaatatttttacctttatattgggcacttatggtccagacactgtttcatttaatcttcacaaaatctctgtgaggtaggtattacctctattttactcatgaaaaaaaaactgagactcggaaaattgaagattgtggagcctggggtcaacaggcttaggctttttaaaaaacaggccaggtggctcatgcctgtgattgcagcactttgggaggctgaggcaggcagatgacctgagatcaggagtttgagaccagcctagccaacacggtgaaaccccgtctctactaaaaatgcaaaaaattagctgggcgtggttgcatgcgcctgtaatgccagctactcgggaggctgaggcagtagaattgcttgaaccctggaggtggaggttgcagtgagctgagatcacaccattgcactccagcctgggtgacaagagtgaaactccatctcaaacaataacaacaacaacaacaaaaaacaactcaaattactcatggccctgggaatgggggcatttaaaaagttaaccaagggaaccaacctggtttccacaaagatggccacttctgggtcagcccaatcatcagtatccctgggtcctcagcatcccttcctacctcttttgactgggaattacgagattacagccccacctacggaaattgagcacattagcactggccatgctgtacatacagcaaatgagagggcttcatactgttacaacaatctgtaccacaattctctgtgcggtctgcccagctctaaatgacatgtcctcagaggcatcatcatctccaagtccatggaaaccatgcacttacagaaaccagaacctcccataccacatgttactaatgacctacaacatcgacttcgtctgtatcatgcagtgctcaacattctggttgcagcatcacatttatcaataatttgattccatgctgattcctttacttggagtattgagatcccccaggtacagtgaaggtatgaccctcttaaatggaagaccaggagttgtttcccctatgctatggcaatccgccacccggaagcacttgctgcaccaacagcattcccaaagcttgcctctgcagccctgtagcacccattagaaacacttctcacaatgaactactgtgctggcaaacccataactggactgccggacagcaagctctgtgaggcatctaggaaaaaagctcgcgaaatcccgagaaacactcttcactccggaatagcgtcacattcttgagtcatttgggatgacaggggatatcctggagcaggtgtattgggaagtcagtgaacaagaaggctaattcattagtgggcctgctagcgtagtattttaacgatttcgcagcctttaaatcattggtggtctttagcgtgccggatcagctggtggtggagttggaggatagatggcagggatctgaagaaaggtgaagtgtagataggagtagagacaatatgaagtttagaaaagactaattgctggacgcggtggctcatgtctataatcccagcactctgggatgccaaggtgggaggactacttgagaccaggagttcgggaccagcctgggcaacgtagcaagaccatgtctctacaaaaaataaaaaattagccaagcgaggtggtgcgcgcctgcaatcccagctactcgggaggtgagaagatcgcttaattccgggaggtcgaggctgcagtgagccgtgatcgtgccattgcactccagcctgggcaacggagcgagaccccatcttaattaaaaagaaaaaaatacaggagagactgggctgctttgaaaagtggatttgacgggaatgtggggtttggagagatcttatgttttccaagactagaaaaacattgtggttccgttcagccctcccggaaaatacgtaggggacttaaagagcggaccgagtacctgtttgtttccccatcccttagccggcagggctctggcagcgccctgggagaacttagggaagggccttctcgcagcggttaccggaagtgacgcattcattctcgcgagaacaaagacgcgcgagcatcggcggcccggaaccggccttggaacaactgtggaacctgaggccgcttgccctcccgccccatggagcggcccccggggctgcggccgggcgcgggcgggccctgggagatgcgggagcggctgggcaccggcggcttcgggaacgtctgtctgtaccagcatcgggtgaggcggggcrtgagagggagcggcggtgggttggagcggcggtgggtttgagcgtctgtggaacacagggctgacagtgtgggatagatggttggtgggaccttgggcagtatttgggggccagtgggcttgtgtgtgtgtattagagagaaagatactatgcctgygtgtccaaagttgtatttgaggtactgggcatagatagagctgttgcggggaacttgggtatgactgtcaggctgtgaccaggtgtttagtgagtgtgacagtgcgtgtgtgtctctgtgaatgtggagtgtcagggtgtgtgaggcagatgcacgtcacagtgtgtatgtaggagcacgaatgtgtgagaagagggctgaaggggactgcctttgggaatgtgtgcgtccgtgtgtgtgtgtgtgtgtgtgtgtgtgtgtgtgygcgcgcgcgcgcgcgcttggaggccatatgatatcagtggggactggagtagacaaggaaggcttcatgatgggtccagagttaagcctttggaagcatggatgggctttggaattggggatgtattccaggtcgggacagtatgagggtgagttggtgcagagcatggcttcaaacgaaaggctatattagtagatggagatggggggcgctctagtaggtggaggacagttaacatcagactcaagaattttactttgatttaatagagaatgtttaaccattgtagtagcagttaaaaaatcatatttgggtcttgtttgtttgtttttgtttttgagacggagtctcactctgtcgcccaggctggaatgcagggcgcgatctcggctcactgcagcctcctcctcccgagttcaagcgattctcctgccacagcctcctgagtagctgggattacaggcgcccgccaccgtgcctggctaatttttttgtatttttagtagagacggggtttcaccatgttggccaggctggtctcgaactcctgacctcaggcgatccacctgtctcaggctcccaaagtgcagagattataggcgtgagccacggcaccaggcctgggacatgtattttttgatataccgataaaagctgtgaaccctttccccagaaaaatgcacagatgcacattcacacaaccatgcattgccatttgagaggttcgtgccttcctaaaggacattttaggtaaatagaccctggactaataattcctgtaatataggctttgttttgttgcctgtaaagtaagtatagtataataattacatgcatcatggatttgagagttaaataaaatagtaatgtgtgtaaagctaaatacggtacctgacccatgaaagccctcaactgttagcacctgctgctactttgttgttgttgctgctatgatcataatgctcctcattaattggccttaaggaaatgtcaagataaaaagtgttgttctaggaaaatggttttgtaaaggataaatttgagtggaacaacatatgggacaagatgaacaggtaagatcttactaaaatgcctgggcttggcttgtgaatagagaagttaattcaagaggaaaagtaataatttgttatctaaaggaacatgggtgtagtgagaaagctcgtaatttggggtgggagaaaggggagataggagtctaccttgggaaaataggcatatttagggtaattagaatgacaactgaaactgttagaactgaggaagttttgtgaaccaggtttctagatagggcataggagaaaatcttggagaaagagaatggaaggtgaaggactaaggcattaagtcctgtgatagcaggataagtagtaaatttaataattctcaccatcagagggaacataacacactaaaaaaaaaaaaaagtgggagccaagtgcttccagtggcatgttgcctgtgttacctaagcctgcctatccgcctggtcataaggaaaaaggatgcatgctggcagcttttgtgacttcttttcttggtccctgggtggggatggatgaattaatcactttttgttttattatggtaaagtatacatkacacaacatttatcactttatttttaagtgtacagttaggtggcattaagtacattgacgttgttgtacagccatmaccctatctccagaatattccgacttttttgttgttgttgtacatctataaacttcccatagaatattctttgtgaaaaggtagaatttcacagagttgatgaaatataaattaaggagttgaaggatcttacaaagtgggatttttgaaatagataacttattgctccattaacatgagcattcagggctcagtgttgttcatggttgtgcctgattctcatttccatggtggtaaaggcctgcatgggacatagatataactggtcacctgctcataacaaaaggaagattgaagggagtgagaacygtgggtaggctagcatgcagtctatcctagtttccttcttctctatgcaccaggtatcatcttatctctagcttcttttttcctctcaccctccaattcacactaccctatccaagctatgtcttscttccccacctataatatattttttctgtcctggcccctgggctcttctctctgtattcatacacagcctttattacaactctggtttgtgtcagagattacatatgttggaaattcttttgaactctccttgtgatatcagaaacatagtgtagcctgtttagccctgactgctatttctgagctgcattattaatgttgccagaatatgatggggtctggctatttcctgtaatatgcatcagaatgggtttaatttcagtcagaattggctaaattactagtcacaggcaagagatgttaggttcattatgtagctatggaagcagaagtacactcattggtaggattttttttcttcatgtcatttgaaatgcatacattaggattggagttttttgctttaggcttggttatattaaaactttctcttgctgtttggagtccaggaagccctgaattaccttcttcattttagttatgctagaagctggggcacatattagttgtcttgattaagctctgaaaggggtttgctgaggagacaggatctttttttttctaacattatatatgagagagagttctgaaaagacctgttataaaatcagtttcaggcacttttcccttgtatgctgttgtgtgtttgaaggtcagttttaaagcatkggtgtaatagtctcatggtttatctttttaaaaagcattgcctcaagagagctgtggataaatatatttaattagtaaagctaaaaagttttgttgtcttaagttatttctttggtagcaaataaatcttcacaagaacctaattttttttttctgttgattttctattttggcaggaacttgatctcaaaatagcaattaagtcttgtcgcctagagctaagtaccaaaaacagagaacgatggtgccatgaaatccagattatgaagaagtaagtgtattccttgacttacatttccctggttctacagcccaaccagatgtcatcatggggaaagaggccaggaatccactcttctcaggatctttttgggaacatatatttttttctctcattaaatatattctatttcaaataataatatcacattaagattaagaaggtttagttaaaatcagctaggacacttacacactgttggtgggaatgtaaaattgtgcaactgttacggaaaacagtacggtgattcctaaaaaattaaaaatagaattaccatatgatccagcaattccatttctgggtatatacaaaaatgaattgaaagcagggacttaaagagtaatttgtacactcatattcataacattattattcacaatagctgaaaggtaaaagcaacccagtatctaccagcagagacatgtataaacaaaatgtggtatattcatgaaacggaatatcatgcagccttaaaaaggaatgaaactctgacacatgccacagcatggatgaatcttgtggacattatgctaaatgaaataagccagtcacaaaaagacaaatactgtgtcattccacttatgtgtggtacctagagtagtcaaactcacagtgaaagaaagtagaatggtgtttgccagagggtgaagggaccagcaaatagagaataatttttaataggtgcggagtttcagctttgcagaattaaacagttttgtgcagtatagtgatagtagcaaaacattgtgaaagtatttgatgccaggctgggcatgttggctcacactgtaattccaacactttgagaggctgaggtgggtggattgcttgagctcaggagttcgagaccagcctgggcaacatggcaaaaccccatctctacaaaaaatataaaaactagctatgtgtggtggtgcatgcccgtagtcccagttacttgggaggctgaggtgggaagattgcttgagcccaggaggtcaaggctacagtgagctgagatcataccactgtactccagcctgggtgacaagagcaagaccctgtctgaaaaaaaaggaaagcatcttgatgccactaaactgtacacttaaaaatggttaaggtggtaaattttatgctatgtgtrttttaccacaatcaaaaaactatttcatttcagttaacaaaagtcagctagggccgggcgtggtggctcacacctataatcccagcactttgggaggccaaggcggatggattacctgaggtcaggagtttgagaccagcccggtcaacatggcaaaaccccatctctactaaaaatacaaaaattagccaggtgtggtggcgggtgcctgtaatcccagctacttgggaggccgarggaggagaattgcttgaacccgggaggcggaggttgcggtaagctgagatcataccactgcactccagcctgggcgactccgtctctaaataaataaataaataataaaaaataaattaccccaacatttagtggcttaaaatagcaaacatttagtatcttatagtttctgtgacttaggaatttgggagtggcttagctgggtgattctagcttagagtctttcctgagacatctcaggatattggtcggagctgcagtaatccaaaggcttgactggggctggagtatctgcttccatgctcacttatatgaatgttggccaaaagcatcagttcttcgccatgtgggcctcttcatggggaagcttgaatgttttcatgacatggaagctagctttccccagaaagatcttttcctcagaaagagtgagtgatctragagagagagagagagagagagagtgaacgagcgagcaagatgaaaaccgaygtatcttttatgatctttacttggaagtgagactccatccttttccaccacattctgtttgttacagtgagtcactaagtacagcctacattcaaggggaggagagttaagctcttaaaaagagaagtagacatattttaaaacttccacaggtagtgtgctaagtactttacagatcattcttccagttatcacagcaatcttatatttaggtattattttgcaaatgaggaagttgaagcttatagaatcacatagctggtggttggtraagtgtggatttgaaataaatactttctgactctaatatctgtgcttaattccattttgattctcaaacttggttatgtggcagaatcaccaggaaagcttaatagtataaattatcaggtcctacatgtacatggaaattctgtttgcttctttttctttttttctttttttttttaaaagagatgtggtcttgctatgttacccaggcttgacttgaactcctgggctcaagcagtcctcccacctcagcctctggagtagctgggactataggcatgcgccaccacacccggctaatttttaattttttgtagagatgaggtctcactgtgttacccatgctgatctcgaactcctggcctcaagcaatcctcccacctcagcctcccaaattgttgggattacagttacaactacacccagcctagaacgccagatttgacttactcactgtgtgatcttgttacttagccaatttgtgcttcaattttctcctgtgtggtgaaagtattaataaatctacctataataggattattgtgacaagtaactgagttaatatatttaaaatgtttactgcttggcacttagaaatgtaatagtagtaatagtgatggtatttttatgtgtgttttcttttaaaaaattactaatttttaattatacaaatcagaaattagaatattataaataatactgatctttccccctctgttcatccacccacaattaagtagcatttcaaatccagtccctttttattggaaataattttttttattgtaatgtttttctttcttattaggttgaaccatgccaatgttgtaaaggcctgtgatgttcctgaagaattgaatattttgattcatgatgtgcctcttctagcaatggaatactgttctggaggagatctccgaaaggtagtgtggatgttttgagatgagagagagtamatcacaaactttagcaatgtttgaatcatgttaaatataataaactagaataagaatcggaaaaactatggtctgcttcctgttttgtaaatmaagttttattggaacacagccacattcatttctttacacattgtctatggctgctttcttatggctgcagaagtgagtagttttaacagagactatgtgacttgcaaaacctaaagtatttaccatatggttccttacagaaaatgttgactcctgatttagaaaatgcatttttgttgttgctgtttgatgggactatagcaatggtgttagatgaaaatttcagtggttaaggtgcttataaaaagttgttttctgtattgcaatcttttttttctacctaattttaaatgtgcccatatgaccatttttatatatatccatgagatttgtcagccttttccagtttcaaatgctttttgcctctttttacttttatgagccttatcatgaaatttacatgccctcagtatggatttggwaattttattcccttgtattttattatgacttattttctcatttgaatattcttttagagtatartaattaatgtgtggtcactattgcagcccagcaatttgcagaacagatttttagatttctttctttttttagctgctcaacaaaccagaaaattgttgtggacttaaagaaagccagatactttctttactaagtgatataggtacgtatcagtattaaaataccattgtaatgtaatgtccctttggcccataaaagatctttttgggaattcaggagaattgttgatacactatacaaagtctatagaatttcaacatctataagaagttataaaaatctattactattgatgctaaattaaaactaggatattttggctaggtgcggtggctcacgcctgtaatcccagcactttgggaggccaaggtaggcggatcacaaggtcaggagttcaagaccagcctggccaacatagtgaaaccccatctctactaaaaatacaaaaattagctgggcacaatgccgcatgcctgtagtcccagctactcgggaggctgaggcaggagaatcgcttgaacccaggagatagaggttgcagtgagccgagattgcaccactgcactccagcttggacaacagagtgagactttgtcacacacacacaaaaagaaactaggatattttattatttatttgtggctaagagtcctttttttgtctaatagatgttccaatagctgacaaaaaaatcatgtgaaatgaccttactcaatttctctccccccctaccattgacatagtaattttgtttacagtggaattacatctccttgagggatgggtcctcaagtcaactcttttttgtttgtttgttttgagacggagtctagctctgttgcccaggctggagtgcagtggtgcgatctcagcttactgtaacctctgcctcccaggttcaagcgattctcctgcctcagcctcccgagtagctgggattacaggtgcccgccatcacacctggctaatttttgtatttttaacagagacggggtttcactgtgttggccaggctggtctcaaactcctgacctcgtgatctgcccgcctcggcctcccaaagtgctgggattacaagcgtgagccaccgcacccagccaagtcaactcttcagggtgaaaaatctctgcttaatcagaatgactccagaaaaattcctaaaataaccagtacctaaccttttggaggaacctcaaaaaccaaaaatttgtttccccatagattttggttttgcctcttttccaaggtcatgagggctaaagtccaattgaaatgagtgatttaggtgggagaaagaggcttataagagtttcagggattttcccaattgcttgttgcatttctatttggtgttaattctaatgagttaaatgaacatatagtataattttgtagtatttgtttaatgttacttttttttctgtgaagaaaacctggacactgtagtattagttgtgtagttacgatgatccatataaacttgagcatcagagtagatttgtacaaaatgtgaggtgaatttttcttttaactcaatgatttctgttacttyaaagtatattttaaactttatttaggrtctgggattcgatatttgcatgaaaacaaaattatacatcgagatctaaaacctgaaaacatagttcttcaggatgttggtggaaaggtaggtgaaacctgaagtaatgtttcatgcctattgaatatagtctctctgatatagttagtccttgagctttggtgtctttgctgtatgcccataacagtcttactttttccatttcagacctcaccacactgaactgtagttttgtgtttagtttttttgtcccttctgctaaacagtggttccatcagagaaggaacagcacctgctttttttttctttttcttttttttcatttttcatacttaacccagctcctagacttcacctgtcttgttcaagtctgtttttccatcatagtatctagcaaagatacaggctgtgaatacataatatgttaacacttattattttattcttatgaagcacatccaaaacacatacatgcacatcctgggtccactttaagaaaaaaaagaaagtatatatatttttaaaacttattttccttcccccaatttaaatgagtcatctggagaagaaccagaaattgtgaattgactcttaaaatgttcatttcattggtaacttaagcagttttcttgtttccagcatccaaatttcattccaataaagacttaaaggccaagagtctgaaccttgtgttgagttgtgtgtgccgtctctttagttagtgaaaatagttgttggcctcttggaggtgttggaaccttggtgatgcctcttctcttaggaacctttcacgtatgcttggcaccaaatatctctgctttttttttttttaatccaaagacttcaggacattcctgaagttagatctaagtatttactcacatttaatctactataaggaggtatgatgcttcttcaagtttggaagtcacccttgcctttactttccrgtttaatggattgagcttattttgaatatagtaaaataaaaattaatagcccacctgtattcaatttttaccatgtaccaagcactgtgttaccttctttactttcgttatttcattggatcctaataacaattctgtgaagcagggactgttagtcatccaattagattactgagagaggttaaataacttggtagatcacatgcctagttaagtggtggcactcagacttgaaatatttttgtgttattacagagcccaaggtcctcaccactaccctgtctacagcctcgtaaggatattgttgtctttcctttttaaatttctctaccatttaatacttaatctgtcttattattttgcagataatacataaaataattgatctgggatatgccaaagatgttgatcaaggaagtctgtgtacatcttttgtgggaacactgcagtatctggtgagacctgttttgtttctttgaatttaagtgtgtataggattctcttatttctgaagatcatgaatatagtaggtcaaaaataaagtagcttttcccatacagtgttggtgtttaaagcattttctcttttgaaggccccagagctctttgagaataagccttacacagccactgttgattattggagctttgggaccatggtatttgaatgtattgctggatataggccttttttgcatcatctgcagccatttacctggtaagaaatggatgagaacttgggcatgcttaatgggaatggaaattttttcatttgtctttttttttctttctttaaktgtttaattgcctttgaaatatacaattaaatataattaaatggcaagaaatcttaatttgtgagaatcactttgtcaactgaggtagcttttgattttataggcatgagaagattaagaagaaggatccaaagtgtatatttgcatgtgaagagatgtcaggagaagttcggtttagtagccatttacctcaaccaaatagcctttgtaggtaagtatattttagttaaggaagtttgcctcagtttctccagagttgtaaaggagcaggagagtagttgtctgtttcaagttgcattatccagtagaactttytgtgatgatgtagaaaccttctatatttctgttggccacatgaggttattgactacttgacatgtagctagtttggctagagaacgaattttgaataaatagtaaatataaatagccacttgggactagtggctaccattttggacagcacaggtctggtggaaacaagaactgccatttaactgtttgacatatgtcctaagaaggctcttaggataatgaagtaaatgggttatttgcagaatggatttggactcatccrtcagarttgtcagtaactaacatatgtggagttttgagtagtttttgatggaaaaaagtttgtcccctgtcatttcatgaatttgaaagtaatttatgaaatggtacagacaagtgatgtgggaaagaaaatggacaacctgcaaaattacctttctaacagtataaagggaaattggaacataatgatttgattttcaccctattttgtatgttttctagtttartagtagaacccatggaaaactggctacasttgatgttgaattgggaccctcagcagagaggaggacctgttgaccttactttgaagcagccaagatgttttgtattaatggatcacattttgaatttgaaggttagtcttaatgggtctactgcataagaccagcattgaaagtaacaagtttatttggaaaattagcataaatacagtttaataatcttttcctgttgcttatttatttatttattttgagacagggtctcactctgtcacctaggctggagtgcagtggcatgtttttggctcactgcmacctgcgcctcccaggttcaagcgattctcttgcctcagcctcccgagtagttgggactaaaggtgtgcaccaccatgcccagctaatttttgtatttttagtagaggtagggtttcgctatgttgtccaggctggtctcgcactcctgacctcaggtgatctgcccgcctccacctcccaaagtgggattacaggcgtgagccattgcrtccagccctgatgcttatttgaaaaagaaaattatattcttagagctgattttttaaaaagtttatttagcaagctgtctcagtttgcttctctgtggtctttgttaattactcctttgaagcaacttttttatttaccttttcccatgttgttgccattatcctcgattcatttatgtctagtcatactggatttgatttggtaaggaaggttcctatctgcctttcatggctctgcacttactccttaacctatagttcattcaatatgtactacctatctcatcttctgaaaatgcttttttattcttctgcccaagaaactaacatagttctttttttttttttttttaacaagtcaagtgtaaactgatctgcttggttttttgggggggctttccctaaccaagttttgccttgtacctgcttctcttaacctttacctcatacaagaccagcttgtcactgctccttatgcctcaaacccgttatctacctttgtgctttgacagatgctatccttctgcctggdtatccatttctgtgtatcttctcacctacactggcatatctttaagagcttttctttaaatggtctctgccacaaaatttgtcatttaaaggctatattctctttctcgtcttccattcatgcatcttcatatagactgttgtcttcttcaatgttgggattgttttacttcttttattaacaatcacccaccctacccttcctaaccatggcattctgtacagagcagggcatgtatcaggttcttagtaaattatttattgatatgaatgagagctatagatagttctattatgcagtgtacccagaaacaactctcatcaatagtstttacatttgtattgattgtttgtagtatacaggtttctaaaattgaaatgagaaattataatcatgtaatgttggagtacatggcgagatagctcactttagtctgcaacccctgagctcaagtgattctcctgcttcagcctccagagtaaatgggactacaggtgtgcgccacctctcctgcctaatttttaaatttttggtagaaatggggtctcactgtgttgagcaggttggttttgaactcctggcctcaagtaatcctcctacctcgacttcccaaagtgctgagattacagatgtgggctactgtgcccgaccttggcatactttattaaatagaaacttgaggccatgtggatgtcattcttggctaacactgaaaagatacctggcttcttcttgatttggtttccttctaatgtgccaaagaataaattatccctcagtgtgttaggaaagcagggctttagttctgtgttgcctctgaaacatttcagctgtgaatgaaccacatctcgcatttgtttcatacttgtcataggaatcatagcatagtttctgctctgaagggcatctgtgagcctcttgttatagggcacggggaaagagtmcacattatggagtttatagtttacagactttaattcagtttgcagcaccactatttacctatctgtgaacctgagcaaatgtctctctatctcaaggacagtaatatcttcctcaaagcatcaatattattatgaggttatgcagaataaggtatgtataaggtactagttatagtagttcaagaagcttcaaggatgcttgttagacatgataataggactgaattttgaagaatgagagtttttagggaaagggtgagggcgggagagatttataggcagcagagcatcatgagcaaaagtacagaagcatgaactgcaaaacagcttggtgttactgtaggacattttcccaaaatgtttatatatattgtacaagaaaggaatgatgtctgtttgattttcacttaaaaaaggaagcaacaaaacagttactgaaatatttcccttttgaaaaaatagcttagcaagtctgattgtatgcatattttccaaytgtttattatgaayatctttagatatgtagaagagttgaaagaagtgtactgaacctaccactaaaaataatgatgaaacagtagcatttaattattatttttttttgcctcctctttcaygcccctaaatgtaactatattctgagtctcttcttggttctctctttttccattacatttcctttcttttattaggcagcctcttcaactgtatagctttacttataaactacatatggctaactcctaaagttatttatctctgtagctgtgactcttctgccaaggacttataactgctgtataactgtataactacctggctgttccactggcacttacaacttaatttattaaaaactgaacatatttgttctatccattaaatctacttcttttttttttttttttttttttgatatggagcctcactctgtctcacgatctcaactcactgcaacctacacctcctgggttcaagtgattctcgtgcctcagcctcccgagtagctgggattacaggtgcctgccaccgtgtccagctaatttttatatttttggtagaaatggggtttcaccatgttggccaggctggtcttgacaccctgacctcaggtgatctgctcacctcggccttccaaagtgctgggattacaggcatgagccactgcacctggcccattaaatctacctctatagatttcctacacttcttatttgcactgtcacctttccagttacccaggtgggaaactttggatgtgttgactcttcctttctcttcaatcgatatatccaattattttatcaaatttatcttttgaatatcttaacaattttgagcttgccaggttctcaatttagaaaggcttgcatagttttctttcacttattgaataaagtccagascctttcattggtactcaaaacctatcttggtttcatatcaacttacactcctggacttatctcttactaatgccctgagaggccatcattttaggtacatttgaactggattaattgtattctctgattatgcccatccctttctacttttctgcttctgctcaccttgttttctgcctaaaggaactcttttcagtcttttcccatttcagtctttcatttcaaagtttagctcaagtagtgcctcctttatgaagtgcctgcttcctactgccaagtgtatgatactttacactgattataacacctatcacattttgcctggtaccttagttctcttagtatatcttaatatcttctgtttgactataactgtatggaaggcaaggatcataaggtactcagtttgtatacccactactaccaccacaacacacttaatagtatgtaccaatagtatgtacctaccaatagtaggtactcattaaatattatagtgagcaaaaagataaatttaggttgtatttcctcttctttcttttgcttccttctggcctggagctttggtagtgagatgccatgatgacatactctaatatcctgtgtaaaagtagatgtccattataggattttctattgctataagtggcagctgtcatagtgtgaaatctgcctaaattgggaaggcatggaaagtctcargtagtataattgtattgcaaatccgtatcagttttgaagatttccctactccccttttaaacataaagatttatattaaagaaaagtctcttaataagagaaatactggcaattgtgttatgacatttggaattcacatgaaaaggatcagcttcaggttataaaaacagtttggtatttcttttttaaaattttgttgatacaggtgtggtggctcatgcctgtaatcccagcactttgggaggtggaggcaggcagatcacttgaggtctggagttcgagaccagcctggccaacatggtgaaaccccatctctactaagaatacaaaaattagccagggatggtggtgcatgcctgtagtcccagctacacgggaggctgaggcagaagagttgcttgaacctgggaggtggaggctgcattgaaccaagatcgcaccactgcactccagcctgggtgacagagagagactctgtctcaaaaacaaacaaacaaaattgttaatacgcttttaatttttttttttttttttgagataagagtcttgttctatcacccaggctagagtaccatggtgcaatctccactcactgcaactttcacctcccagactcaagtgattctctcgtgcctcagcctcccgcgtagttggaattacaggtgtgcgccatcatggccaactaattttttgtgtgtttttagtagagacagggttttgccatgttggccaggatgttctcaaactcctgtcctcaagtgatctacctgtcttggcctcccaaagggctgggattacaggtgtgagccaccgcgcccagcctaattttttaaattgacaaataattatacaaattaatggggtaaatagtgatgtttcaatacatgcactgtgtagtgatcagattagggtaattagcatatccatcagctaaaacataatttctctgtgttgggaatattcagtatccctttcttttttctttttttttctttttcttctttctttttttttttttttgagacaaagtctcactctgtcgcctggagtgcagtggcgcgatcttggctcactgcagccttgatctcccaggttcaggcgattctcctgcctcagccttctgagtagctgggattataggcgttgtgccaccaagcccagctaatttttgtgtttttagtagagacaaggtttcaccatgttggccaggctggtcttgaactcctgaccttaagtgatctacttgtcttgtaatcccaaagtgctgggattacaggcgtgagccaccacgcccagcctcagtttagtatttctgtagcaccacttatttgggcatctgtgttaggatttgtaagtggaaataatagtgggccttcaaactaaaaagtgtacagtagaaaaaataatcaacaaaacgaaaaagcaacccaacccatggattgggaaaagatatttgcataccatacatccaataagaaattaatatcctaaatttataagaaactcatgcaactcaataccaaaaatgtaaataacccaatttaaaaatgtgcaaaggacctgaattagacacttctcaaaagaagaaattcagatggtcaacaaacatatgaaaaggtgctcaacaactcttagcatcagggcgatgcaaatcaaaaccacactaagatatcaccccccacctgttgggatggctattatccaaaagaaaaaagataagcgttagtgaggatgtgggagaaaagaaatcccttgtacactgttggtgggaatgtaaattattacagctattgtgggaaacagtacaaaggttcctcaaaattaaaaatagaactactggccgggcatggtggctcatgcctgtaatcccagcactttgggaggttgagacaggtggatcacatgaggccaggagttcgagaccagactgggcaacatgcagaaaccccatctcaactaaaattacaaaaattagctgggcatggtggtgcacatctgtaatcccagctactccgtaggctgaggcaggataattgcttgaattcaggaggtggaagttgtagtgagctgagagatcatgccactgcacatcagcctgcgtgacacagcaagactctgtctcaaaagaaaaaaaaaaaaaatagaactgtaagattcaacaatgtcatttcttggtatatatccaaaggattttaaagcaggcttgtgaagagatatttgcactcccatgttcattgcagcattattcacaatagtcaagatctggaaatagcctaaatgtcctttgacagatgaatggatagggaaaaagtggtatatatacacagtggaatagtattcaaccttaagaaaaagaaggaaattctgccatttaggacaatgtggatgaacctggaggacatgttaagtaaaataagcaagtcacagaaagagaaatactgcgtgatctcacttacatgtggaatctataatagttaaatttaatagaagcagaccatagcatcatagttgccaggggctgcagggatgcgggtgcgggggtgtatgtagagatgtttatcaaaaggtccaaaaattacggcagcaaaagaaaaaaaaggtacaaaaatgacaactatgaagaggtgacagatatattaattagctgaaatgtgataatttcacaacgtatatcaaaacatcaagttgtataactcaaatatataacatttttatatgtcaaattaaattgtcacaaaataaaatatgtaaaagataaagcaataaatcaggagagggggctatgatagatgaaacaagataggctctatgtaaatgatggttgaaactaggtgaggcattcacagggttgggagggggcttattgtactgttgtctatagttttgtgtctttgaaaacatcaattcagatttgtgttttaaagggaaaaaaataatagtggacttggattaatgccttacctttgtagtaaggattttcagcagagagaattttaatcatttgcatatactagtcaatgtaaggcatggagaatgtaggcattaatttcgtatggcttttctaaggatactggaaggaagagaatttaaaatcatgttcttttcaaaagactgaagtccaactctgtggctgtccgcgctgacaggtggggacagagccccacctgactcagcctcacactcacttggcatgtatcaggctacttttactggggctttaggtgagagtgataaaacggttcttacttgatttggggcccttaagcaggttgctgctctgggattaggttgtcttataaaaaggtaactcaccacscataacaatgctttttcctgtttaaagagagacctagttcttctatcagatgatttcttaaggcagcatgaagtagccagacacaaaaagagttaagatccaagctctaccagttattagctgtgtgatccctaacaagttatttaacttagaactctggtttctttctctgtttaaaatggagattaaaagatctaattattggggatgttatgtgaaagtggtttatgcctgtggttgtcttctgttaggcacttcatgaattggaatgtttccttttcggtctatgataatgtttttttcaaaataaataacttaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaataaataaataaataaataaataaataaataaataacttgttcttttaaattgggatttttcttaattttgaaaatttcttaactttgaaattttattgttggaactaacatctattgtagaaaaggaaattgttcagttttcagaatgtcattttataattataaaaggagatctcactttggagaatgagtgagccttgtttaatgtagaaataatgccttttgcccatattcaccttttagtatctggcagcgaatcttttatgtaacaaataatcaataactttacctttttttcttatttatacagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttgtaagaaaattaattataatatccctagagtatgtgaaatctagagggattgcgtgccctgcaatttttatgcatacttggaattccttgggaggccgcacattttgttttggttttgtccttctcccaactcttatcattgctttgcaaggtgaacaggatagaaatgaaacatttgttgttttgaactttgcaagactttttctttggtgccagttttctgctcctgttcccagaccaaactgagggtcaggctgcttactctcgcggcccaataacgagatgcagatgaattgggagagatgggagtttttatttctgtaaccagttacaggtagaaggcctggaaattaccgccagaccaactcaaaattacaaagtttttccgtagtttrtttatcttctaagctatatgtctatgtgtaagtttgcattcatctaaagacataagtgattaacttcttttaatctgtagctgaggtctgagtcttgaagacattcctctggagcctcagtaaatttacttactctaaatgggtccaggtgctggggtgattacccttatcttgtctcctattaaatcacagaggtttaaggagttccttcagacccccaataaacttgtttgtggaggcctggggtttcttcagacccccaataaaacttatttaattctgaacgggtcctgttaagaattcctttgttattttgcttttaggcctgggaaaggcctgggcagaactcttggtaggctttggctacatttcagcctttgtgtaagggcactggctcttccagttttttttttttttagacagtcttgctctgttgcccaggctgaagtgcaatggcacaatctcagctcactgcaacctccgcctcctgggttcaagtgattctccctgccacagcctcccaagtagctgggattataggtgcccaccaccatgcctagctaattttttgtatctttagtagagacggggttttgccactcctgaccgacctcaggcgatctgcctacctcggcctcctgaagtgttgggattacaggcgtgagccactgcacccggccactctttcagcttttaatatttaacttcaccactcagtcgtgctgaaacagttgttatttaggcctgcattagtgagacctggcctgccacactcccagttaatattccttcttggcttggtgcagtggcccatgcctgtaatcccgggactttgggaacccaaggtgggtggattgctgagttcaagagttcgagacctgcctgagcaacatgttgaagccctgtctctacaaaaactacaaaaattagcggggtttggtggtgcacccctgtagtcctagctacttgggagattgaggtgggagaatcacttgagcccagggaggttgaggctgcaatgagccatgatcacgccgctgcactccagcatgggtgacagagcaagaccctgtctcaaaaaaaaaaatttctttttgtatttgaagcccagtactctgaaactactgtgagaacagcagtctcataggtcctgccaaaggataaatgggtggtaaaatatgactgtggtcatgactttttcccccatttttctttttatgactttattgaggcatattatcatgttagttcccatttaaggtgtacaatatagtgattttttatttcttttttattaacttgtcactgacttgatgctcaattacagtgatttttttttaaagtaaatttaccaaattttgcagctgtcaccataaatcagcttaaaaacatttccattaacagtccattaactgttaatctccattctgtccaccccaggaaaccaggaatctattttttatctccacaagtttgccttttctgaacattccatataaatggaattatgtaatatatagtcttgtgtctgactttttttacttgcyttgtatttttgaagcccgtgcatgttgtagcatgtatcagtacttcattcgttttgattaccgattagttttttcactgtatatatctttttgcatttgttctttgggttttggtgattgttcactttagcccatacaaaagtttgggtcttttttcctcaacaaaagtttggactctgttatctgtaagagatatgstaatacacattgattttgttcatttgcatttcaaagtaggaaatctggtgcataagtatttagaaaacctaggattttcaaagatccttgaacaggattttaactgtttgtttctttttcagagaggctgtgatagctatatggtttatttgtttgataaaagtaaaactgtatatgaagggccatttgcttccagaagtttatctgattgtgtaaattatattggtaagtccagtccatttagtggctgagctttaaacatgaattaatataactttgactctcagtatgattagtagaaatggacttttggtgttgtgttctgtatctcatacttgaagtttctatatggagttatatgagaactctgaaaaatggatttatatartttggaaggtgaaaaggtagatattaaatctccatgagatcattcaagagaagatttactttcttgaggatagggctctcacaggagaatgaaacttcactattagttgaacctgctttttaattgtctcttcatagtctaagcatgttcaagtatttatttcatttttcctgtgaatactgcttgatgttcaaatgttttaatttatcctgtgaaaattattcttttcttttgaacaagttaagtgtttgatcactgtatatctgtccaaataaagtaaagcacaaaattgtaaaatcaagaacaaaattgagcagaggggctaaaatgtatgtaatcttacttttttaaaagtctttttattagttttcttttgaatttttcttttaaattgaggcagtttacatagagtgaaattcacagatcatatagtttgataacttttgacaaatttagatacttgtgtaatccacaccacagtcatcatgtagaacatttctttcaccttagaaagttccctcatgtctcttttcagtcaactccccttgccccagactttattactattttactaatggactttttttttttaagaatggttttagatttgccaaaaaattgggcagatagtacagagttctcatataactcccctcactcacgcatgtagtttttcctattgttaacattttacctgggaggcggaggttgcagtgagccaatgtcacaccactgcacttcagcctgggcaacagagtgagacctttctcaaaaaaataaataaaaaacataaaatatttaaaaatattaaaaagtaaaaaaaaatctattttacattagtatgatgtatttgttacatttaatgaacccatttattattaattgaagcccatactttattcacatttccttcatttttacctaatatcctttttctgttctaagatctcatcttagaacacattacatttggttgtcatgtctctttagctcctctttgctgtgacattttgtcagacttcaaatagtccttgtttttgatgaccttgacaatgacctgaggaatactagtcaagtattttgtaagatgtccctctgctgaaatttgtctttttgtttttgtttttgttttgtttttgagatggagtttcactcttgtcgcccaggctggagtgcaatggcacaatcttggctcactgcaacccccacctcccgggtacaagcgattctcctgtctcagtctcccgagtagctgggattataggygcacaccaccacgcccagctaatttttgcatttttagtagagacagggtttcaccgtgttggccaggctgctcttgaactcctgacctcaagggatctgcccgccttggcttcccaaagtgctgggattacaggcgtgagccatcacacctggctcttgtgtgtattcttaaacctggattgttggtccagaatatgaaatttattattcagaggtaggaaagactcagaggagatgggacttgatttagaacttgaaagaaataatttggattagcagagagaaaaagagtattccaggttgcagaaaagcaagcaaaaaagacagatacaggaataatctcaagctctgtgagtgtagcgattgtgtcatttttatttccccccttgtatgtggagcggggcttaagtattgcaggtgctctgtaaatgtatattgaactgaattaaatggaaacaagtggttcttttagcatcagtttctagcatctatgggaatcctgtttgtgtggacaggaaatcacaaagaatgataaatcaactctaaaatcctcaaaagtaactaacctcccttgccctttttctcatcttcttgtatatagtacaggacagcaaaatacagcttccaattatacagctgcgtaaagtgtgggctgaagcagtgcactatgtgtctggactaaaagaagactatagcaggctctttcagggrcaaagggcagcaatgtaagtggattctgttgtttataagcacaatgcaatgtgcatcatatactcaagaattaatcttgccggttttcactaatcaatattgcatgtaatagtaacatactgggccaatttgaagtgtaatgttctgataaacttgtagaattcttactaatggactgagaccattctattgtaatggcttgagggtaataattcccatacggtcctagtataaaaagattgtttatcacaaaatattataggcaggaagtctttagagatcagattctagagctcagttatttctcatagattgataatagaaacttaggctttggccttgtggcagtttatgtttttacattattgttcaatgtttctgaatgctgataatatcttttttctttttcttttttttcttgctgtggtttaggttaagtcttcttagatataatgctaacttaacaaaaatgaagaacactttgatctcagcatcacaacaactgaaagctaaattggagttttttcacaaaagyattcagcttgacttggagagatacagcgagcagatgacgtatggratatgtaagtgtctgtgtaatgtatttgaaaggagcatctggtttcttgaagccatctgttattttgccttcttaactcagccagttgttttacttaccttcacattagaacaagagacaggacaacttaaattaacataaaccatgtttgttttgaatgttacctctttttttaaatttgcttagttgagcaatttagcttcacaattgggctaaaattatttagctctaaaaaaatacaggtgcgatttaataatcttgaatttcaaacctgattttaaaataaatacaaaatctggacttcttagccagtgctgtggactgaatgtatcccccccaaaatacatatgttgaaattctgaccctgaaggtgaaggtgttggtaggtggagcctttgggaagtgattaggtcatgagagtagagccttcctgtttgggattaatgctcttacaaaagagacctgaatgagatccctcatcccttctgcatgtgaggacagagcaagaagatggtcatctaggaaccagaaagcaggccctcaaatctrccttgttcttggacttcccagcctccagaactataagaaataaatttctgttgtttttatggcacttagtctatggtattttgttatagtagtccaaatggactaagacaaccaggggagtcttaaactgcttacttttctgtaaataatgacacaaatattctaaggctatgtttttttcaaaccatctactgtggagtcctactattttttagtgtacacagtctccaaattttccatatttgactccaagcttatctccttcagatgtactaaggaagtgtaaaaaaacagagttaaaatatgagtaaattgaaggagtcatactaccagcatttctgttttcttttataaaacaaatcctttttaggaaacaaatacttgtttcctaaaaacatatacttgtcctgagcaaactmtgtgtatctcagagtaaacaatcaatagtgtccagttgggtgaatgaatttactctccagaactggttttattaatattattgatattttatttctatttatatattattgatattttatttctatttgtatattattgacattctggtgagtgataaaacattataattatttcattaaaatatcttagacttgtcaaaggcttattatacaattgttaaagaaaaatgaggtagatctatatgtgcttttattaaaagatcacctaagtctttagttgacagttttaaattgtgggaaaaaataaagagtatacagatgttttcacttgtgagggagcaggctatgtgtctatgtaacagataatcatagtaaggtcccttgaggtggatggtagaggggtagaagagagagtcttttctgtttatatccttttatagtatttaatttttaaaaatcatattcaagtattaaatttcttttctggccaggtggtgactcacgcctgtaatcccaacactttgggaggccaaagcaggtggatcccttgagctcaggaattcaagactaacctgggcaacatggggtagaacgccatctctacaaaaaatgtaaaaattagccgggcatggtggtgcacacctcagctattcaggaggctaaggtgggaggatcgcttgagccctggagatagaggttgcggtgagctgagatcatgccactgcactccagcctgggtgacagagtgagactctacctcaaaaaaaaawtttttttgttgttttttcctttatccacccatctgcacactggtataaatatatatatttttaagaaaaaagtcatctgtattcatttcctaagggttccataacaaaatcccataaactgagtggcttaagcaatggaaacttactgtctcacagccctggaggctaaaagtccaaaattgaggtgttggcagggccatgttttctctgaaatctgtagagaagaatctttccttgtttctctctagcttcttatggtctgctagccatcattggcattccttggcttacagctgcagcacctcaatctgtctccattgtcacagagcattctcccctgtgtatctgtatcctgtgtctcttctaagtacactggtcgtactggactaagggcccagaccattccagtatgagtattaatttatctgattacttctgtaatgaccttatttccaaataggtcacattctgaggtattaggggttaggaattccacatatcttttgggggaccacaattcaactcataacacatctttgatgttgatatggcaaggaggcaggcagccagtaattaaagatatggctatttctgagataaccaatttagacttttcttttagcttcagaaaaaatgctaaaagcatggaaagaaatggaagaaaaggccatccactatgctgaggtaaaatcattgacgtcattctgtatacttattaattcttgatgtctccattagaaactatctttggttttgatatataaagagcatttttcatgtcattcctgaaattcagacaaaattctagtagatgctttgtatataaagagggatgtatcatagtgattaaaaacaagggctttgggaaaattacctagtgcctcactgagcttcagtttcctttatttatttattttttgaaacagggtctcactctgttgcccaggttggagtgtagtggcatgatcaaagctcactgcagcctcgacttcccaggctcaagcagtcctcccatcttagcctcctgtgtagctgggacaagaggtgcaccaccatgcctggctaacttttacattttttgtagagamggggtctcactatgttgtccaggcttgtatcaaactcctgggcttaagcaatcctcccacctcagcctcccatagagctgggattataggcatgagccaccacatccagctagtttccatattatagggacaatttcttttctagtagggttatgaagattaaatgggagtcagtaatggtagttgtcactattatttttgtgactggtttagataggatggctgcacatcctggtttacctgggactgtcccagtttatacttaatgtcttgccataattatcagtagtagtccctttcactctcaaaattatgccggtttggacaataaattatatggtgtccctaggtatagctcattctctaggtggcagattttttccccttatcctgtacatttgtccacggtcctaagttattacactccttaatgtcagtacttaccctgaggatgtgggtggggatacccatggtrtcctggggtgggaaatccaagttctttatctttttgtgtccctattcaaggtagtggggaccagggggcagtcaaaatcatagagccaagatacaagtaataccaatggttttggtggtcctttttctttcttgttagttgatacctgttgtagctttttgcttctccggaggtaaaagcaaatactagtagtttactgttgtcaggagagaaaagagagaagactaagactaagtatgttcttatgtgaaagattaagtgtcagaatctgaagaatagaaaggctttaacaaaatcagtgtttcgtattatattatttagttctctaatgaagcagcaagtcattctgtatccttaagatctgaattttgtttcctatgatgtagtggtaagcctttcatttcctttgtattttcatcatattttaggttggtgtcattggatacctggaggatcagattatgtctttgcatgctgaaatcatggagctacagaagagcccctatggaagacgtcagggagacttgatggaatctctgtaaggatgcacttgtgttgttggtcttgacatctgtaatattttgtattctttctgcttacatctggcaaattaaacctctagtggttcttttctatagttttcctttccccaaatatattggcattatatttaaaatggaagctttttctcagtcacaggaaacttcggaaataattctttgggttggccttttttggtttttaataaaagcatttatttcataggagtgttaagaattttccaagtataactaagttacaaactatttccctactcattatayctctggtccaaggtattgactcttaaatgccctaaaacttgaaattttttctgaattaaagttctggattaaaaacttcagatattttctcgaattataggtcataatttttgtctttttaagtgtctgtggtgcagagatgtccccatgatagatcagaatagatatgaactatattaaactttgcattttaagaacttgtatagttcttattactcaatacaatgctctgtgaaatacttgttggcaatatgaacttgctttaaaatgggttcattattcaaataaaatattgtttcaagttgtagattaytgaagtcattaaattaccttcacttatcagagcgtgttttctcttttatagggaacagcgtgccattgatctatataagcagttaaaacacagaccttcaggtaagacacttctaccacagtgcttgaaggcattttaggtaactatcactagcctaacaaatgtgggggatctaatatttttaagttaaaaattttcttaaagctgcagaataaattccagttttggtattgccattgagacatggtataataagctttaagattgtgagaatttaggagatgataaagagaaagtaacagagaacgtgaggtagaaaaattttagaaggggacgtgaaaagaaagaatggaagacagaaaaaaggaactcagagaggaaaaagcagcaagaaaatgtttagaaagatggaaaaaataagtgttgcttaagattagagaggttgggccagttgtggtggctcatgcctgtaatcccagcactttgggaggccaaggtgggtggatcacctgaggtcaggagttcaaaaccagcttggccaacatggtgaaaccccatctctactaaaaatagaaaagttagctgggcatgttggcatgtgcctgtaatcccagctacttgggaggatgaggcaggagaatcgcttgaacctgggaagaggaggttgcagtgagccaagatcacaccactgcactccagcctgggtgacagagcgagattctgtctcaaaacaaaacaaaaaaatattatagaggttggaaagaatttgaggcagtgggttcaggtatggaatggttagagggaaggcctgtgctgttctaggccaaagcagattgctttgaaaataatgccttcatctgcactggtcactgatgacttgttttgttggcaaaataattccagttgaacatctgctaaatactgagcaaggtctgctggaaagagtactggatggggaatcagaggcttgaattctagattgagtaatttactgaccgttacctcaggcaaatctgcgtttcccatttcctycttctgcaaaatggggttgaaacctarctttcctactcagtgagtatattgtgacagtgtatttaagaggatgtttgtgaaaatgctttgaaaactataaactattatgtacttgcaagatattatcatttagttaaaaatttgttttgaagggtaacagaagaaataaagtctgtgccctaatgtgcattatacttaaatgcatgttaaaaaaagatatacttttacactttaaaatttgtagacacatagcaacacatgcaaattaatayacatgtgaaattgtatttcatatactattttcacatttaaaaaataacattatctcctcttatactgcttttattttactgaaatgtattcagtttagtctgaccagcagttctcaaaatgtggcatatggacctgtgagaatccttgaaactttgtcagagagtctgtgaggttagaaccattttcataataagatgttatttgcatttttcaccatgttgacattttcattgatggtgcaacataaaatggctttcaccttagtatgaatcaaggcactagcgccaaactrtgctagtagccgttatattttttaccaccatgcagtcacagtttttaaaaaatgacagtttcacttacaaatgtccttgataaagcagtaaaaatattattttatttaaatctcaacgcttgagtatgggtttttaatattttgtgtgatgaaatgggaagtactcataaagtgtttcttctatacagtgaagtatgatggttgtcttaaggaaaaccacttcagtaattgtttacgttgctagttgtctggcctctttcagggaagataccatttttacttggaagagcaactgtcaggcaaactatgattattcagatttgcatacgtgagataatttctaagaaattaaatgaaaataaaaagtatagcacacttattactttaagggaaaaaagcagtatttgttgtcaatgataaaattccatgtttcaagcaaaaagaattttagaaaacttgtatttaccagctggaatgacagcttctcagtacttaaaaacttttctgatgagattagtggtgatatcagaaaggtttgcaaaaatgtaaaacagtgcaagtgttctcactcaaatttttttgttttagaaaatatcgttttttggtttttgtttttagaggtgggctcttgctatgttgaccaggctggccttggactccctgggttcaagtgatccttccacttcaggcttccaagtatctcaagtagcagtaaccagtgaaaggaggtggctctcgtagatatgagtatactgtgtagacacatgtatgtatagcacttagcatgtctgaggaaatgcagtatgactggagtgtagagtttcaggagagagaaaacctaaatataggagagagagaaaacstaaatataggtttttttgtttgtttttaataaaaacatgttaatgggcaataggtttgttatttttaaatgaattaagacacgagtatttttaaatttctgtttaattcctgaaaaaccctttggggttctcaagaattttctagtgtaaaggkgtcctgagaccaaaaagtttgagaactgcttatctagactattctcagaagcttggctgctcaggaaagaagagaggtgggtgagtagctaaaagttgatgtagagtcaagggaggtcacttctcagaaggaagacttaaacatgaggtgccacatgatgatgttttggttaacaacaaattgtgtatactatggtagtcccataagattatactactrtatttttactatgtattttctatgtttacatgcacaaatacttaccattgtgttacagttgcctacagtattcagtacagtcacttgctgaacaggtatgtagcctattgtcaaaaggctataccatacagcttaagtgtatagcaggctgtaccatcagggtttgtataagtattcacacagtgacgaaagtgcccaatgatgcacttctcagaacatatgctcagggccaaaaaagcctgtggagagggaggtccctgaacaagttgagagattggctccaaagaacagtaggagggattagccttgatactattgatattggaaagagaatgagtgtggatacagatacttttttgggagtagaggttggaagatcagggtcttactgccttatggcctcttatcctgcagtggtaagtgaggttaactgaaatggaagaggtgacgacctcatagatttgaatagagtgctaaagacttctaaaagccactgtgtgcagtggaagatgttgttgacccaaaacattcattaagaatccaggccaggtggctcatacctgtgatactagcgctttgggaggctgagacaggaggatcgtttgaggccaacagtttgagaccagtctgggcaacatagtgagaccctgtctctacaaaaaaataaatcaataaaatttttaaaaagctgggtgtggtagtgtatgcctgtagtcccagctactcaggaggctgaagtagcaggatcgcttgaggcccaggaggtcgaggctgcagtgagccaagattacactactgcacttcagcctgggttgacagagcaagactttcttaaaaaaaaaaaaaaaaaaaacccagagcagaaatgaaaaacctgtgaattagcagtgacaaatagtgaacagtaatattaattttttgttgataatttagtagcttggatacaggaactgatagagcagatggttggattaatccaaggttaggattttgctgatggaataagaggataaaaaggttgaagatgttaacaaatagtgatttaagtgatagaagttgtagctagagtaaaatattaaaatctaagatttcaaatrgagcaagtccaattctttttctttaatcaatatttctgggccaggcgtcgtggcacatgcctgtaatcccagccactttggaggctgaggcaggagaattgcttgaaccagggaggcagaggttgcagtgaaccaagactgtgccactgcactctagcctgggtgacagagctagactccatttcaaaaaaaaaattctgactcccagttttctggctaatgaatcagataccacagatacacagtgatagcatttgtttaggttatattttttaaaactttgaggyagccctgtcaacataccatgaagctcagaaataaactgctacccaggtagcttctttgagtgtcaccttgagtgacaaactgtaacaagattgtgtctgtcattggggcctattatataatcacacttgatttgtggcctctattgtcttttctagcttagagttgacttgaatctcttgttcatctgaaatggttaaaaccagctttcttcattatcctggagaaggctaaagttctgagggctttcactgtcttaaggagctagttatatgagaaagctcttggcttggtccatggtatttaggaaggaatgctgtttggagaagaacctttttggagccttgcatttgattgttggtgaggaggagacaacagagatgtgtggggaataaagttgggctatgggggaagtatttggagtgatagataacaaaggacacaacgttttttaaacctcctttgatgctcatcatttcctttttggtaaaatgggggtaacaaaagtagtcttctcacatgactgctgtgaggattaaatgggaaaattataagcagagagtagcaaatattattattattgcatttaggcttaattattgtccaaagaawataccagcatgatgcataagcaactttcaactcctttagccattttctgaaatataacaattaatgatttttttttaaaatcgaggtcacattttaaactgtagaacccattgtgaccaacagccatcccatttgagggtatctggctgctgccagttggctttaagatgtcatactgccctcaaatggaactttcaggatgtctacaggtccctttactagttggtttcaatgagcttttttcaaagtttttctgggttgtaaacagacggataaacatgaaattccaagcaacctagttcaagggcctccttcctttaggtaatgaaagtttgatgaattgtcctactgtttctaaatatgtggttartcatccaagaaaaattgttcccttggccagaggctgcatttgtgtctagggcttgggttagtatgggttaaagatagccaagactattgttctcaagcacaggcaactaaggtctcttactgataaatttatatatacattatacacctgcaaactttattttttatatataactagattttatttataggtaatctttatatcttttatcttaacccaatttttaatttaaatggagatgtttattaattaaaattagtttcagagtttcagggatttttgagraattttttgttyggaggctgatatgttacagaagaaaggttatatccactgactgatgtcttttatagatcactcctacagtgacagcacagagatggtgaaaatcattgtgcacactgtgcagagtcaggaccgtgtgctcaaggagctgtttggtcatttgaggtaggaaaattgcttcatttcctactgaaaaaccaggatacgtttatcttgttcctctcaaagtacaaaagccctctttggtaaagtatacttacccaggaagaattctgaaggtaccttgggtagcttggccatagctatctgcatttatgtgtccttttgtatgcattactttggagataagtcattaaatctgatgctgattgtggttcatttcctcmgctgggttttgggaatatggtgtacagtcttggggcatgtgaaagtgtctgacactgatttaatctctccagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtgtaagtaattattaatgaattatttaatgtgacatkgagttgctattattccttgcaaaggggatttttatcagcatgaggtgggccctcttgaagacatgtatattttgcattgggatgacatccatgttccttgcttggtgtccagactagcaattgagatgcaggacttattatcatctctcctttccaatttctctgttgttatactcctcttagcccttgactactgtggtattccaacctaacttggggatagatgtacctgcctagataatgaaattgaccatctattcaactgggttttttttttctttcttcaactaaaatggtataagatgagtggatatatttggttttagtcaatgaagaaagggtccaaggacaggttactaatggtgtgtaaaggtgggaayagttttgtactgaaatactctggttgtgcatataagtagtaacrgaaatgtaagtcttaggaatatgataagaaattgtgtgaatcaacagagatgcttgcctgtaatcttttgatgtttttttcttttccttcagacacagagttctgcccggtcccttgtaggatccagtctagaaggtgcagtaacccctcagacatcagcatggctgcccccgacttcagcagaacatgatcattctctgtcatgtgtggtaactcctcaagatgggtgggtttactttgtaacaatagatagctgtgttttcatagcagtggtataggaatgaggcagtagttgttaaggtagtcttctgtgccttcagaccagggttgagtcctgactatccctttgtaataatcttaggcaacttacttgacttttttgatgttcatatttcctcacctgtaaaacaggaatgtctcatagaactkctgtggaaatttgattagacaatgtatataaagtgcttgggaaataaatgttcagcaaatgttgcgtattattagctcaaatgttgcttattattagctaagtccaagttctaagtcctttcttttattggcttattactttcttttactcaaaccttactccttcattaacagtttatgagaaattatgctatcattttgcatttatcattttggggatccttgattacccttctaataaatttttgagatctattttataactttgtatttctaagattagacttttttcagtgttttaaatcagttttgcaagaactcagattccaagccctrtattttattaattcctactcttttgctaaaagctgaatgactatccatttctgttattttctcagcttaagatgtgccgtatccaaagccagtggctctttgctagcttgtgtattgtcgcttttctcacaactcatggagacctctacagcaccagcatttcctggaagctctgcccataattagttttgcagaagtgcagccatgttacatcactgctcaggaggtcatgcagttgcacattctgtactctacttttatgagagaaaagcacatggcaggaaggcaagctgatatcaggtattttatttttttaaagaaagcaagttccagggtatatatcttggggtcattatacatgtggcccaatgcagtacacctacaactgtagcacaggctataattaaatatatagactttacaaaatactccagtaatcagagttgaaggaagtaaaatttaatactttacttacttttttgcctttattaaaggcatttaagttttttagcggatgttaatgtttacaratgtcaccacaatacaggtaatttccaatttgaagtgtagttgcttgcaaaagtatatctgacagacattttcaatgtattttctagaaggaacacattatattttgttttgagacggagtctcattctgtcgcccaggctggagtgcagtggcacagtcttggctcattgcaacctccgcctcccagattcaagcagttctcctgcttcagcttcccgagtagctgggatttcaggtgcgtgccaccatacctggctaatttttgtattttagtaaagacggagtttcaccatgttggccaggctggtctcgaactcctgacctcaagtaatccacctgcctcggcctccaaaagtgctggaattacaggcatgagccaccatgtccagccagaatacattgtataagaaaattgatttcaattataatgtacctgtggtacttaactaccaaggattgggaaccgtttgaccataatttttccatctgttggataagagctgaatcagaatgtcattctaagctaatagtggctatcatccatgacctaaaacggactcttgttaggggactgaagattggcaaagggagaagctagaggccatatagaagaggaaagcatgaaggtagaaaccacaatcaggactgccttcaaatatgaacttccagggatacttcttggttctgggtagctcccccaccacactgttttcttttgctgtcctcaggaatcagcttgcttgtttcgtttcattgctatcatctgtagtttctaatgagtttttcactttctgtgatctctacagaacagattttacttttctctcttctcccctacatttgtgtctgtgaagtatgcatgctggtgtttttactacttttaaggaaagagaagtatttagaaacaaaaacgtatttcatctgtctttgccacaaggattttttcctccctagttacattttcacgggaaaaacaagttgtacataagtgcatcttacatttcagaggaaagtcagactggagttatagtggacttcttatcattagttaggtagaggtagaggcagcagcctggtcttaacaggactctgcctctgtagggagggatgaggaaactaaagactacaggagtcaactgcactggggtactgggttacaggaaggctagtgatcttgctaacctagaagactagaaagtagaggaaattcatatgcccttttcctgagtttgaaaaggctttgttctttcatctcacagggagacttcagcacaaatgatagaagaaaatttgaactgccttggccatttaagcactattattcatgaggcaaatgaggaacagggcaatagtatgatggtaagttttgtgtggatatgggtgcctgctttggctatgttgggtgcaaaaggtttaactttccatgctagccttatctggcatttgggatgcatatgggaaatagaagaactcaagaggaaagagcatttggggaatatcctcaaccttaaatccttatctgccgttactcagggatatactaggattatgtcatcaattatcttcaataatagcatttttggtcaaattaaatgagtggtaagcttcttcacaatgtgaccattgaaattgaatggtttgttctgtacctttttgcttcagcaatcaattttctccattaagatgggacttgtactttaattcagatatggtacctcccgaatagaaaataaattatgttaatatagttgtaataataagtgtgtgttaagatttggttactataaactactgatttgttaaaacttgaggaaattaccataaaatgtctactgaatcaatttttcctgcatttagtcttaatgtcaattctgtayatttcctctttcattaagaaaaatagcagtggccaggcatggtggctcacgcctgtaatcctagcactttgggaggccaaggcaggtggattgcttgagcccaggagtttgagactagcctggccaacatgggaaaccctgtctttataaaaaatataaaaattggccaggtgtggtggcacacacctgtggtcccagctacttgggaggctgaggcaggaagatcgcttgagttcaagagtttcaggctgcagtgagccgtaatcctgccattgcactccagcctgtgacagagtgagactttgtctcggggaaaaaaaaaaaaaaaaaggataatggtggccagccatatgacatgtacctgtagtccgagttactagggaggctgaggcagaaggattgcatgagcccaggagttcaaggctgcagtgcattatgattggacttgtgaatagccactgtactccagcttggcaacatagcaagatcctgctctcttaagaaaaaaaaaaaaaaagaaaagaaaaggaaagaataattgtttacttcaaatatttatgaaaaaaactctgaaatttttttaaatcaggaaataaggtaaatgaaatgatttttcaacttttgattatgaaatgtccaaacagaaaacttgcaaaaatgaacacccatatacttataacttatagtcaacatctaattgtaactttttcatgcctggttttagaatcttgattggagttggttaacagaatgagttgtcacttgttcactgtccccaaacctatggaagttgttgctatacatgttggaaatgtgtttttcccccatgaaaccattcttcagacatcagtcaatggaagaaatggctatgaacagaaactacatttctactatgatcagaagaacatgattttacaagtataacagttttgagtaattcaagcctctaaacagacaggaatttagaaaaagtcaatgtacttgtttgaatatttgttttaataccacagctatttagaagcatcatcacgacacatttgccttcagtcttggtaaaacattacttatttaactgattaaaaataccttctatgtattagtgtcaacttttaacttttgggcgtaagaccaaatgtagttttgtatacagagaagaaaacctcaagtaataggcattttaagtaaaagtctacctgtgtttttttctaaaaaggctgctcacaagttctatttcttgaagaataaattctacctccttgtgttgcactgaacaggttctcttcctggcatcataaggagttggtgtaatcattttaaattccactgaaaatttaacagtatccccttctcatcgaagggattgtgtatctgtgcttctaatmttagttggctttcataaatcatgttgktgtgtgtatatgtatttaagatgtacatttaataatatcaaagagaagatgcctgttaatttataatgtatttgaaaattacatgttttttcatttgtaaaaatgagtcatttgtttaaacaatctttcatgtcttgtcatacaaatttataaaggtctgcactcctttatctgtaattgtaattccaaaatccaaaaagctctgaaaacaaggtttccataagcttggtgacaaaattcatttgcttgcaatctaatctgaactgaccttgaatctttttatcccatttagtgtgaatattcctttattttgctgcttgatgatgagagggagggctgctgccacakactgtggtgagggctggttaatgtagtatggtatatgcacaaaactacttttctaaaatctaaaatttcataattctgaaacaacttgccccaagggtttcagagaaaggactgtggacctctatcatctgctaagtaatttagaagatattatttgtcttaaaaaatgtgaaatgcttttatattctaatagtttttcactttgtgtattaaatggtttttaaattactttcttgatctctattcattataaaaatcagattataataaaacagttgaatatggcttaggaaaatatgaaggttccatgaagtggaattaagagcatagaataactgtactttccttaggaataataggacttatggtaaaggtagtattgggcaacttctttaagagtgttttcctctgaaatgtcctatcaccactatctacatctaaaaaacatgctcgattcttgccctataaactgatgtcacagccccaccatccccatttttgctagtggtatcattttcctagtcaaccaaattttttagtcatcacatatcactgttcgtcatctattataataggcagtctctctcttgtttccctggttttagaagattttagtaataaacatttattgggtacctgttacttggagggtattaagctagatggcaagatctgaaacaacataggcagtatagtaaaagtgcttatctgggagtctgaacattacaagccatccaagcattgcaattattgttaaggattattttcaatggtcatgcattttctaatattttaataattggttaaagatttgttatagcgtgggggccgctgctggtgtgtggctggggttatgtcagggcagcctgatctatataatttgggcagatggtgtgagtcagaacagactattatagtgggatccccaaacttgcttttgatgcatgagttggaccactattttttggtgggtaacaacttttcagaggggaatggcagttgtgaattgtatacatttcattctttaagcaatattatgaaaaacttcagagaatgtctacagaaaacagggtatggagcaagttattttccattctttttgctttttggaagttaaaatagctaagctctgcaaatatcatttatttggaacagataaggtcccagacattcctagataataaaaatcaaatgaatgatacaggtaagtgtatttattgaagggtgtgggtagagtggtctgggaagtcttgctttaatgaagacggattgattctatttacctcttcttacttccactactaagtaaccctgggcctgcagtttcctaaccacttgacttccttgccaacagtctgtctccactttcagccgttttatagattcattggccctaaagcactgctttcccatacttccctacccaagagggcaggggtccccaagccctgggccgcggaccggaaccagacagtggcctgttaggaaccaagccggatagcaggaggtgagcggcgggcgagtgagcattatcgccttgagctctgcctgctgtcagattagcgagtggcatcagattctcataggcacgcgaaccctattgtgaactgcacatgtgaggtttgccggctccctgtgagaatctaatgcctgatgatctgaagtggaacagtttcatccccaacccacacacacccccaccccgtccgctgggttagaggactttacaaccctagtccaccttgtccagttatagttccacctctagcctttcaaggcttaaaccattaatgtccttaatttctcttgtattcatctatctcccaactatacctttttccttcccttttttatttttggcaatatgtgcccatggttttttaatttaaaacgaacagaatatgtagtgacgcctaccatagcactccttcccatcacacaagccttcaaggaaactgaagtacttactttggtctccctggaggattccctccgcctcccgccccatgtgcttagcaattctgttcctgtagtctggatggccttcataaagccctcactggaccagcattctggcacataataggaacacttaaaaaacgagagaatgatgccgttatatctaatatcttcctcttctgaactttcacagcactttatttgcaacaagtttagttgctcctgaagggcaggatctctgccggaagcaagtgcgtgccacacagtggggctccgcatacactgcaaaaggacaaataaaccgaacagctaccgtttgagagtgagcgagtgggttctctgcacaagaacaaaccaaccagtcccttgtccgaaagggcgtctccttttctctgcttcgctgctcactccagactgcgggctgtcctcttccgaagcagttaaccagcagtgtacagaaagcgacttgcctccaaaggagcctgcgcggcccgcggctaggagaattttgtcccatgcgctccccgtctcactagccgcgggccggggctacgccgtgtgcgtccccgcgcagccgcagtgctgggcgagtgggcggggccggctgttggcggcggttggctcggcgcgggagtcggctgcacgtgcgggcgggggcgatgcgtcactgatcggtgaggcgcggccgaggggtcggctttcctcgcgagcctgcggctgggcttcttctcagttagtgccttccacccgggagcgacccttgggagagggagtttcaggaagctcaccgagcaggggcggcccactggcctccgggggcggaggagttggcaaggggtcagcgggctcagccagaagggaagaatgaggggacaggggtactggactccccggctcagcctgcgagagagcgccaagtttccggagggagagggtagaaactggagggggtggacctgtcactcacgggactgagggtccttttctcccgctcccaggaggaacgagaatgaatatgactcaagcccgggttctggtggctgcagtggtggggttggtggctgtcctgctctacgcctccatccacaagattgaggagggccatctggctgtgtactacaggtgagcggcatgtgcagtcagttagggctctagagcagattaaaagggtactccagagtggagtctgggaagttgttccctctgcaacgttcgggggcgcatgtcccatctctagggagagcacgggggtcgaagcgggcttttgcggagcaccctccagatgttggacagttttagtgctatgttcgttttgttgcagagattaagtctccctacggttattcctatacacagcaaactcaattatttgtagaaaaatgaagaaggaagaaaggaagtagtcactctacctctaactgaagagatggataaattatagttcgttcaactgtacaggctttagtttgccgctgtagatgctgtatgtttatggttgtttcttagactttttcatttaaaagcttccagtgtctggttacgtcttgtaacaccatgatgactgtgatggtgcttatgtccctggacctccagggacataagcacaacactgatgggccatgctcctccctccttactgttgctgttcaagttggggacaggagtggtgtgggagctgttgctctcttgttgagctcgcttagcttttccttcagcctaattaccacaagttccttttgatacagactagtaagagaggccagtttgtggagaaattgggataatggtgtattcaaaaagagcgtcaactttttgcttgtttccactatccctcaaaactgatatttctactttcaaatccatcctgaatcctagaaaaagagcaattttaatggtatatcttagcagatggagctctacataagaaattacagattagtccagatttccttccagtttaaaagcattgtctttctgacagtaaaaccagagaaaggacatttcaaggaatgactcaaagaattagtaatgaacctcaaacagttcatctttccttgttattatgaccttgcaaatgtgtttatattttcaagaccggtagctaagttctatgaatttacaaggtgcaaaataggactttgttttctttgctccccaaatgcctcctttttataatttccagggcttgctttcatagttttcacattccaggatttggttaacaagcccttatgctatttatttgtatagtcttgtcacccttcatcttttcatgctaattttttgtttttatatagaaattttatgttcccagtattttaattaccttgtagatagatcgaaagaattataagcctcagaaattttctctttacttcaaagtttgcattgtctttttttcaacctggtgattaaatgtattatatattttgatttggctcttgttatgtactattaatgtacctctactgaaagccattagaattttttaaacaaatatttctcagaaggttaaagaccgaggagaatcctttgaaccttagagcagtgctggagacccagaggtacggttggttgagcttatgaaacaaggtgtaacattggcagtttaatttgatctttttccctttttaggtgtggaggtattttaagcagttgttcattatgagcaattcatattagtgaggctttagtaggtcagcagcatgagcaagagtgagtatttattatagcattttagatttggaaagataatttttctttttataattttgtcaaattgaaacatctttttgcaggggaggagctttactaactagccccagtggaccaggctatcatatcatgttgcctttcattactacgttcagatctgtgcaggtgagtgattcctaggggaagcctccataccagatagacaggcatgacaggagttaccacacttgtgggtggagatagatttccttattgcttaagcagatggtggtatttacttaaatgcagaagttaacgttcagagtacagttgttacaacacaagttatgatgttaaaccacctcacttacttgaaatgaattaaaggtatgaaccaggaagcttggaaggactgacttctaccatctatatcgtggtatatagcaaattttctgttgctgctgtcacaataaaagtaagaattagaaacacaactagacatacaaaccagtgattatgtggtttagaacagtgtttagtttccatagaggcaggctcctgggctactgttaacatggaggatcaaaatttttatacacagcctttctgcctcatgtttttttgcctggtatattaagcacaattttatgtggaaccttagtgaatgttatattttgatggcatcccgggatatttgaaataagtgtctaatcctcgaaaagtgtcttggccatgggagacaataaaataagtatctttcaatgtaacaagatgacaaaaccaggattaggctgtgaccactttcgcaagcccagtgtgatcataaatctttggattcagaagtttgtctgccatctgctgctaatttttcaggactcaggaaaattctgtgttatttaatcttgtaatcttatgtctaggcttcctgctaagtgagagtttaattataaattcttaaatcccctaggttttcttcctgtccccttttagatggcttagggaaagaattgtgtctactgaagtgaaatgtattcttcccctaatcagactgatttccatatgttgttccatatttattttacccattctttccttagttcatgccatcacttctttatctgccatctcactctccattccttctctcctgtctaaatcttgccaggcttttaaaggctcatcccagattcttcctcttctgatctatagctcttaaagtctatattgtaaattttggccctttgtcttattttctttaatattgttgtcttgcattgtttgctaagtttttttatgtgttttctttccagaaaggctccagttttcttaaaggcaggagttgtaacacatttatatttctggctttctatttatggtggaagttgttaaattgagctgatttctcaggaagcaatgtggtgtaatgaacatggggacccagcgttaccgccagttggtggcatgactttggaaaaattgcttaactgtcatagacttcagttagtcttctgtgaaaggaggaattttaattacataacctcatcaacagccgaaacaatctataataatgttagcaatggcagcattagacccttaaaaatcaagactctaaggcccggcgcagtggctcatgcctgtaatccgagcact

SEQ ID NO: 12245 - DNA, 22851 bp, Homo sapiens
actaaaaatacaaaaaattagccaggtgtggcagcacacgcctgtagtcctagctactagggaggctgaggcaggagaatcacttgaacctgggaggcggaggttgcagtgagccaagatcacgccactccactctagcctgggagacagagcaagactctgtctcaaaaaaaagaaagaaacccagacacagctgtaagggcttggaggagggcacagtgaggaacattgtatggggagtcagaaagatggggttcccacccagctttactactcattagaagtgtggccttgagcaaatggtctaaccttgatggcctcagtttccccacttgtaaaaatgaatatgacattgccaacctcatagggctgtaatatggatcaagtaaaaaatgtgtttgttttgtaaagtgtaaaggaaagcgcacaggagaggcaggttgtgacccggaaaactcaccccagtagacctctctctcctttgtcggctgaatgatggacctataaggtactctgttttgcttcaaagagtgtcaattttttgtttgttttttgtttgtttgtttgtttgtttgtttgttttgtagggagggggttggttttgttattttttgtttatttatttttatttacttatttattttgagacagattttcgctctggcgtccaggctggagtgcaatggcgcaatctcactgcaacctccgccacctgggttcaagctactctcctgcctcagcctcccgattagctgggattacaggcatgagccaccacgcctggctaatttttttgtatttttaccagggacggggtttcaccatgtcagtcaggctggtctcgaactcctggcctcaggtgatccgcccacctcggcctcccaaagtgttgagattacagggtgagccaccgcgcctggcttgttttgttatttatttatttatttatttatttatttaaaaaattttatttatttacttaaattgactaataaaaatttatttacttaaattgattaataaaattattagtatttttattattgtttggtttttaattgtgggaaaatacttctacataaaatctgccatttaaactattttaaaatataaattcagtggcattaattacattcacagtgttgtgcaaccatcacaactatctatttccaaaacttttttttatcactccaaacagagactctgtacccattaagcagtaactacccattcccctctccctccagcccctgataacggctaacctttctgtctctattaatttgactattctagatatttcatgtaagtgagaatcatacaatatttgtcctttgtgtctggcttatttcacttagcataatgtcttcaaggttcatacctattgttgcatgtgtcagaacttcattgtttttatgactgaataatattcccttgtacgtatatatcacattttgttcatccattcatctgttgggttgtttctaccttttggctattgtgaataatgctgcaatgaacactggcatacaagtatctgtttgaagccctgttctgattattttgtgtatgtatctagagtgtcattgattttttttgggttttttttttgagacagagttttgctcttgtcacctaggctggagtgcaatggagtgttcttggctcattgcaacctccgcctcccaggttcaagcgattctcctgcctcagcctcctgagtagctgcaattacaggcttctgccaccatgcctgtctaatttttgtatttttagtagagacagggtttcaccatgttggccaggctggtctcagactcccgatcttaggtgatctgccagcctcggcctcccaaagtgctaggattacaggcgcccactaccacgcctggctaattttgtattttcagtagagacggggtttcaccatgttggccaggctggtttcgaacttctgatctcaagtgatccacctgcctcggcctcccaaagtgctaggattacaggcatgagccactgtgcctggcccaagtgtcattgatttttgacagactttttgaatacgcaccgtggcaatgggaaggacccttcggaacagggcccagtatctttgagtgagggagggagacgagcagagaaaggggaggtttcagtgtggctataattagaataacagctaccttgtgcctattgcaaaactcttcacaaaacactcaccagaaagcgtagccagaggttcagagatcatatttatttatttccttccttccttccttccttcctttcttcctttattctttctaggcaaggaaagtagctctgagctgcttcagtcatcatattcttattaatctacagcattttaggtaccacagaattagaattttgtagagcaattgtgcacttctacagctaaagttctggaaaaagcaaaactatggaaacagaagaaagatcagtggttgttaagggctggagtcaaggggaggaactgaccacagaggggttcaggggaatttctgggaggtgatggaactgatctatatcttgattgctgtggcagttgtgccattgtatgcatttttcaaaactcacaaaactgtacactaaaaagggtgaattttactataggtaaattataccttaattttttctttttaaaaaaagaatgaataaataaatggggagaaaactaaataatacttaatactcccagctactcgggaggctgaggtgggaggattccttgaacccaggaggcggaggctactgtgagccaagatcacatctctgcacttcagactgggtgacaaagtgagaccctgtctcaaacaacagcaacaacaacaacaacaacaaaaactaaataagaacctaggccaggcgcagtggctcacgcctgtaatcccagcactttgggaggtcgacgcaggcggatcattgaggtcaagagattgagaccatcctggccaacatggtgaaaccctgtctctactaaaaataaaaaaattagctgggcatggtggtgcacacctgcagtcccagctacttgggaggctgaggcagaactgcttgaacccgggaggcagaggttgcagcgagccgagatcgtgccactgcactccagcctggtgacaaagcgagactccatctcaaaaaaataaaataaaataaaataaaataaaataaataagaccctaggctctcatgtgtttgcgtatcttgagaactttgcaagtgacactaactctaattatttagcattagagcataaacttctattttttcattcattcattataaaatgaaagcccctgaatccactattcacaaaaaccagaacattgctaaaaattaaatctacctatgggtttctctcccacaggtagatttaataggaggatccctgcatcctcccccaggtaattttgtgtgtgtgtgtgtgtgtgtgtgtgtgtgtgtgtgtgtgtgtgtgtgtggtgtgttccaggctggagggcagggcagtggtgttaatatggttcactgcagccttgacctcctgggctcaagcaatcctcctgccacagcctcccaagtagctgggaccacagatgcatgaccagcctttttttttttttttttttccttccatagagacaggtccttctatgttgcccaggctggtcttgaagtcctgggctcaaccaaacctcccaaatccttggcttcccaaagtgctgggattataggcatgagccaccatgcctagccccccaggtattcattattctgaactttgtgtttctcattcccttgctcttttctttcttttcttttttgagatagggtcttgctatgttgcccaggctggtcttgaactccttggctcaagagattctcttgcctcagcctcccaagtagctgggattacaggcccaggctattgcacccaacgccttgctcttttcttagttttttttcacgtaaaaattaggctgaagcacatgaatctgccattacttttagatcaaaacaggtcaaataacagcaaattcatatggttcaaccaaatattatgcttagatgcagtagttctagttatttttgaatcatatataaaggatgtcattccatatgtagtcttctgagatttgccttttttcaatccaatattatattaccatgatccaaccatgttgctatttttcattcattttctactgctctataattaattcctttgcatgaatatcccacatttctctatctcctgtcagtagcatttccgtgttttcggtttggggctaccacaaacaatgtttctagtaacattcttgtatacattctctcctggtgcattgcacaagagcttactgtggctgtaccataggaatggacttgctaggttttagagtacacagatgttcaactgcacaagatgtgactgtgaagtgaggatgtgactcattctctgagctccaaataagaatacaatgtgcactttcctcaggagggaatgtggacaagatgtggtgggaggcgctgggatggagggtctctggtggaaattgaacacctatgcctaatgcatcccagtgatatcttcctgttgcatccatgatctcttttaatcctcccagttaaagagaggtactactatctccagagattaggtttagagaaggaaagtgccttgccaaaagtcagtttgtgccaactgcctgagcaaacaatgtcccctctctaagcttcagtttcctcttactgtaaaatggatatgataatacctgacccacttcacagattaacggcttcggcatgcatggctcctggagatgctccctaaaagtcacttgtttgtttgtttgttttgtttatttgagacagagtctcgctctgtcgcccaggctggagtgcaatggcgcgatctcggctcactgcaacctctgcctgctgggttcaagccattctcctgcctcagcctcccgagtagctgggattacaggcacttgctaccatgctaggctaattttttgtatttttagtagagactgggtttcactatgttggccaggctggtctcaaactcccacctcgcgatcctcccgcctcggcctcccaaagtgctgggattacaggcatgagccactgcgcccggccaagtcacttgtttattaatgctattgttaagttattgagttgttattaatattaaggggaacagtaacccagaatagtctgagccttgccttattgacattcaatggtgttgcctcttgcagagaccttttttggatgtagtgaccatggcccattttggccaccacttctgatcctggatgtatctttcagagctgcatatccggtcmccctcctctaccctactcggggcctcagagctgaggttcctgtctttacctgcagatttctctgaacaaaagaaaaggtaaactgatcagcggcccaggctcccagttctgcctcagggcaaagggagaaattggggcccagggcctcattcagtggaaaatatttgttgaacacctagtatgtgccaggacctgtgctgagcaccaggaacacaggggaacaagaccaaaccctgcaaggtaggaggctaaaggaggagacagaagacaacaaaacgacagtgtgctgagtacagggactgttctaaccaacagaaaaacagacaggatcagggaaagcttcccagaagagagcttccctttgagttggagctttacggccgggcagaagttccacaggtgctcagagactgacaggaccaccagcctgttgaacagaagaggagactgagccccagcgcctctcgacccctccccgccacacctcacctacccggactaggctgaacgggccgagcactcgagcggggacgcgcagctctgcagagccccggggcggggcctcggtccaggtgcgcggtagcgcttcgcggaggcaggaagtgtgtccctagcggcggcccgtgcagcgctcccgcgagacgctcacctgcgccccaggtgagcggcgagggggcgggggaggggctgagccggaggcggctcacctggcgggacaggtaagcccggcgcgggcccaggggggcgcaagccagggcggcgccggtgtcgggagccccccgaagctgagcccggacaggagagggtcccgggcccggttcctcgggggccaccctcctacttccggggtgcgcgggccgggctggggagcggcctgagcgggcgcccgggctgggcgcgcagaatggggtgaggggccgcgttcgcccttagggctgcactggctgggtgcgggggccgcactcaccggggggcagcgtcgggatgggacaaacgctggtgctcaccccgaggaacagcgtcgggacgggagggaggctgggtccgcccgcggggtagggcccttgcagctggagagggtagtgctcgccccgagggcagagttggtgtaggggctgtggtagcccgggggacagtgccaggatctggttcttccttgtccccaggactagctgcccgcggatatgggactctcgggctgcacctttggggcaggaggccgagggtgcactgagccgacggctgtttctcgagcaggactggggtggtcctccccggccgggtgtccgaggcttggcactgggctgggggcagaggctggtgcggccgggcctgtcctggggaccctcggaggaggggacggtacatagacccttgagtgtgtgtgtgtgttcgcgggactaagggggaagaggaaagcatcaacgagaaatccagggagggcgggccgggaccctctgacccccgggaacatccttgcggtgccttagatcgcctagtgacctagcccctcccatgggcaaggccactgcgggaagccccctgcactcaatatttcatttaaatctcacgggattggcggggcatgaagatactagtctctccttatttaaagatgaggaaagtgaggttaagaatcttgcctcaagccacaatagggacagggagtctcccctcactaaaccaagtgaccaggttcctaggattgggcggggtggtggcggggcggtggcagcagggtcggggagatacagcctggaagaaactgcctgagtttgacttcaggagggttcaatggctggagggaagtggggaactgaggcaggcattgtccttatcccaggtcttctcttctcatcccaccaccgctggagatgtgtggcacacacaaagtacgcaggcttcagagcctggcgggccacagtgcaaatcttactccagccctctcttgctaggtgtctctgggccagtcacttcacctttctgagcttcagattcctgatctgtgaaatggagatatactacttattttcagagcaattgtgagagtcaaataaggtgaaagtcctctggcccattcactgctgttttctcagcatttagcacaacgctgggcacctcgttgtattaatttaatcaataatagagagtcctaaagctttggaggttggggagaagacaatagccagtccatcctcaggagccccacgtacttccgagctcagcatggttaactgtagatctgtccactctcctgaaggcttgagcctggaagacagggctcccaacatgggctctctctgggcacacgctggtccatggagctggcagctttgactgcctcttttctcccaagtaatagatgggatggggtagtggataagagtctggggccaggccaattgtgtacagatagatgtatggctttggacaacttatttaacctgtctgtgctttagtataataatacaggtaataatattacaaagagggttgtgaaaattaattggttattatgtctgaagtacttagaacagtgtaagccatcaataatcaactctcactggattgtaaactcctgaggttgagggattttgtctgttttatcactttatccatagaatttagaacagctaggccgggcgcggtggctcacgcctgtaatcccagtactttgagaggccgaggtgggtggatcacgaggtcaggagatcagaccatcctgactaacatggtgaaaccccatctctactaaaaatacaaaaaattagccaggcgtggcacgcgcctgtagtcccagccactcaggaggctgaggcaggagaatcgcttgcacccgggaggcagaggttgcagtgagccaagaccacgccactgcactccactccagactgggcaacagagtgagactccatctcaaaaaaaaaaaaaaaaaaaagaatttagaacagctggctgggcgcggtggcttatgcctgtaatgtcagcactttgggaggctgaggcaggtggatacttgaggtcaggagttcgagaccagcctggccaacatggtgaaaccccatctctattaaaaatacaaaaaaattagctgggtgtggtggcatgcacctgtaattccagctactcaggaggctgaggcatgagaattgcctccacctgggaggcagaggttgcagtgagccaagatcgtgccatgcactccagcgttggtgacagagtaagactgtctcaaataataataataataataataaatccagcatgtggcacacagtgggccctcagtaaatatctgttaattgcgtgaatgtgtgaatccataccccacatttctcaaactaaagcaaagatttttaaccacttagctcagattgcaagggaatttaaaatcacctgttagaattttatttgggataccgttgcagatgggatttcactctctccctcacctcctatcccccatccatactctggtcaacgtagagcctaagtctttttttctttgtacccagtggcgctggttctaccctgaggcaacctgaaatctgtcagtcccctgaggcacctagtgtaccaaaccctgttccagaccctgaggcagaaaagaattacacacagtccctgcacttcagggtcatggtccttggggacatagacttatcctcaaacaatcagtacaaggctgacccagctgacagcccagcagaaggccatggggagagggcctcccatctgactagtggttccagaaggtccctggagaaggagtgctgagtaaggccaggagagtaggttaaagagttgtaggaatggttaaagaactgtatcctaggccaggcacagaggctcatgcctgtaatcccagcactttgggaggccagggcaggagatcacttgaggccaggaattcaagaccacctgagcaacatagcaagatcccatttctaccaaaaaacaaaacaaaacaaaaaactagtggggcagggtggtatgcacctatagtcctagctactcaagtggctgaggcaggaggatcacttgagccctgttgtttgaggcttcattgagctagggttgcaccactgcactccaatctgggtaacagagggagaccttatctctaaaaataaaataaaataaataaaagaactgtatccttcacatccccatttaccatgggcaacattccctctttccctttctctacacacacataacttttgttcttttgtgtttgaaccatttgagattaggttgcagataatcctgcccctttatccccaagtgcttcaatgtatgtttcctaagaatagaacattatcttatataaccacagtaatcaaattcagaaaatgtaacattgatataatactatcaaataacatatttcaccagttattcacattatccaatttccaattttttcctcccaatccaggatcctttctaggatcacactgcatttagttgtcatgtttctcaacttgggcttgtctattatttcctcattattacattcaggttatgcatttttgacaggaatacttcgtgagttgtatcctccttagtacatagtatcaggaggaacttgatgtcaattcatcccattatggtgatattatctttgatcatttgattaaagtggtgtctgccgtgttcctctaaacattttaaagtttttacttgctacagcaagtaagagggaatggaagtggccagaatggcggctgtgacagtatttgggtgagagataatgatggccctctttagggaggtggcattaattttcccaagtgccaaatctggggttagattagggccagaactggaactaaaacacagatatcccgatgcccagttccacattcctcacacaccccyggtttaagaccccagtgccattaattcaggaataaaaggataagggatcagtgtctcagaaaatccaagctaaggatagttactgcctggcaaacccctacatgagatcaaggaccttcccaaatacactactgcataatcttccttgactctgtcaggcagagttatttactcccatgatgcttcatatatcctacatgctccatcttacaaactttgtttgtttgtttgagatggagtctcactctgttgcataggctggagtgcagtggtgcgatctgggctcactgcaacctccgcctcccaagttcaagcgattctcctgcctcagcctcctgcatagctgggattacaggcacgctccaccacgcccagctaatttttgtatttttagtagagacagggtttcaccatgttggtcaggctggtctcgaaatcctgacctcgtgatccacccgcctcagcctcccaaagtgctgggattaccggcatgagccactgtgcccggccctcatcttacaaacttttaagcatctgttttccctgcaaaaccatatgtgaatcatcaagaacaggatctgtaattcattcatctttggttctacggtacccagcacagggccagcctcagtgtttatgaagtaaaggaagtcctagctctgagcttcctagcaaccaggtcagaatgggaaagaagacatattttgtggctcagcttttttatctaatcaaaggacaccaacagtggttggtgttaaatgttgctagcagggcaaatgtgagtaagactgaaatattgacagaccttgtaaattcccatatctgatttgaaggaccaggagagggaaaaaggtattaatgatcaggttccatagcaagtcttatggaaaggcatttgttgagcagccacagaggctctcaacaagaaaaacttaccaacagcaggaagaaactgggggaaaccacttcacagaaagtgagatccaggagatctttctgtaaaatagctataaaagttaccatagtaggctgggtgcagtggctcatgcctgtaatcccagcactttgggaggttgaggtgggcagatcacctgaggtcaggagttcgagaccagcctggccaacatggcgaaaccccatctctactaaaaatgcaaaaattagctgggcgtggtagcggacgtctgtaatcccagctactccgaggctgaggcaagagaatcacttgaacctgggaggcagaggttgcagtgagccgagaatgcgccattgcactccagcctgggtgacagagcgagactccatctcaaaaaaaaaaaaggtaacttattaactttttttttttttttgagacagagtcttgccactctgtcacccaggctggagtgcaatggcgccatctcggctcacttcaacttctgcctcctgagttcaagcgattctcctgcctcagcctcctcagtagctgagattacacgtgcccatcaccatacctagctaatttttgtatttttagtaaagacaggatttcaccatgttggccatactggtctagaactcctgacctcaaatcatccgcccacctcagccgcccaaagtgctgggattacaggcattagccactgcgcctggcctaacctttttttaaagaaaccacatttggccaggcgcagtggctcattcctgtaatttcagtactttgggaggctgaggtggggagatcacctgaggtcagcagtttgagaccagcctagccaacatggtgaaatcctgtctctactaaaaatacaaaacttagctgggcgtggtggcacgtgcctgtaatcccagctacttgggaggctgaggcaagagaatcacttgaacccaggaggcagaggttgtagtgagccgagatggtaccactgtactccagcctcagtaacggagtgagactccgtttcaaaaaaaaaaaaaaaaacatatttaagcatcattcccatatttaagcatcattcctgtggcattaaatacattcacattgttgtacaactattgccaccatccatctccagacctttttcatctaccccagctgaaactccctacccattcaacactaactccccagtcccctctgcccccagcaccaggcaactaccattctactttgtgtctctatgaatttgactattctagagatgtcatataagtggaatcttacaatatttgtctttttttttttttttttgagacagggtctggctttgttgcccaggctggagtgcaatggcacgatctcagctcactgcaacctccacctccaaggctcaagtggtcctcccacctcagtcccccaggtaactaggactacaggtgtgcaccaccacgcccagctaatttttgtattttcagtagggatgggctttcaccatgttggccaggctggtcttgaactcctgcgctcaagtgatccacccatcccagcctcccaaattgctgggatcacaggcatgagccaccgcacccgggctatttgtccttttgtgtctggcttatttcacttagcataagttcttcaaggttcatccatgttgcagcatgtataagaatttcctttcctttttaaggctgagtaatattccattgtatgtatataccacattttgtttagtcattcatccattggtagacactgggattgtttccaccttttggctattgtgaataatgctgctgtgaacattgtctaaacatctgagtccctgctctcaattagattgggtatgtacccagaagtggaattgctgggtcgtgtggtaattcgatgtttaatttttggaggaaccaccgtactgttttccatagcagctgcaccattttacattcccaccagaaatgcacaagggttccagtttttccacattattgccaacactcattattttctgggagaagggagattatttttaaatacagattgagagattgagtatccctaatccaaaaatccaaaacactccaaaatctgaaagttgagcaccagcatgatacttaaaggaatgctcattggagcatttcagatttttggatgaggaatgcttaacaggtaagtataatgtatacaatccacaattcagaatccaaaacatttctggacccaagcatttcagataagatgttcaacctttctttttttctttttctttcttttttttttttgagacacagtctcgccctgttgcccaggctggagtgcaatggcgtgatcttggctcactgcaacctctgccacccgggttcaagcgattctcctgcctcagcctcccaagtagctgggattacaggcacccaccactatacctggctaattttttttgtatttttagtagagacggagtttcaccatgttagtcaggttggtctcgaactcctgacctcaggtgatctgcctgcctcggcctcccaaagtgctgggattacaggcgtgagccaccacgcccggccaatgttcaacctttcatagccatcccaataggtctaagtcacagggaattttgaaatctgggttagaccacagagactttctctttgtggagggasggccacaagagataagggtttttgggcatacttgggtccatccacatcccaggcaagggtttttgggcatacttgggtccatccacatcccaggcctctcagaaactagaaatgtgaagctgctcaagtcagcccaggagtttgtccctcacctctgatcctgactccttcctggcctctccccacgcaggtgcctggctgctacaaaccatgcaatgagccatgccccgccctggacacccccgcccagcatctgggcctccacgcttgggaccgtgggagcggccaacagagctatgtctggagacatatgataaaccacctcagcccccaccaagccgccgcacccgtagaccagaccccaaggaccctggccaccatgggccagagagcattaccttcatctctggctctgctgagccggcccttgagtcccccacctgctgcctgctctggcgaccctgggtgtgggagtggtgccgggctgccttctgcttccgccgctgccgggattgcctccrgcgctgtggagcctgtgtgyggggatgcagcccctgcctgtctactgaggaytccactgaggggactgctgaagccaactgggccaaggagcacaatggagtgccccccagccctgatcgtgcaccccccagccggcgggatggccagcggctcaagtcaaccatgggcagcagcttcagctaccccgatgttaagctcaaaggcatccctgtgtatccctacccgagggccacctccccagcccctgatgcggactcctgctgcarggagccactggccgatcccccacccatgcgacacagcctgcccagcacctttgccagtagtcctcgtggctccgaggagtactattctttccatgagtcggacctggacctgccggagatgggcagtggctccatgtcgagccgagaaattgatgtgctcatcttcaagaagctgacagagctgttcagcgtacaccagatcgatgagctggccaagtgcacatcagacactgtgttcctggagaagaccagtaagatctcggaccttatcagcagcatcacgcaggactaccacctggatgagcaggatgctgagggccgcctggtacgcggcatcattcgcattagtacccgaaagagccgtgctcgcccacagacctcggagggtcgttcaactcgggctgctgccccaaccgctgctgcccctgacagtggccatgagaccatggtgggctcaggtctcagccaggatggtaggtgggggccccatggggctgaggggcagagtaggggaggctctggccaggggagggttggaatggggtctttagtcactgtgggtctacccctcagccagtccctgcctttcctcctcctttctgtcaactcttgcatcccctctccccagctcccactctggcccttcctggtgaggtccgagcaaggctgagagaagcatgcagaccctgggagagctctctggccatcgctgctgtccccagaaaggtcaaggttccctctgcattcaacaagtttacccaaaaggctcctctcctctgctgtctcctgccagagtagcttctaggcctggtctggtgaacaggacctagggacccacatgaatttgggcctctgacctgttctgggctaaccaaaactcccactcatccatcactctgcgcatgcacacgttgtctatgtctctgtctttaagcattatttttctagccctgcccaggagtgagtggctcctccctcatcgggctgggaacagaagtaggaaatagggttgaaagaacgtgctaatgaccactgcttgcctcacgttccctccctagagctgacagtgcagatctcccaggagacgactgcagatgccatcgcccggaagctgaggccttatggagctccaggtgtggtcttgacctaatgaggggtgtggagggtgggggactaccctaggggcccctcacctgctgctctcccagctttcttttggggtgatgaggatgacatcaaaaagggacggggacctaagcagccacagacctgtctccatctagcaagctggcttaaagtgggtgcaggtgcccagaacaggcaagctgaaagtgatcagaccccaaccttcaagcccagatgactaggaaagtagtgggtggggagccatccagcatggtgctggaaagacacccgtgtggttctgttgyggtcttcttgcccttgacaacaaccccctgggagtggaatcattatccttttacagaaagggaggctagggctcagagaggtcaataaactgagtgggtcatccagccaggatcagactgacccaggctcaagtcccactctgctccttctcarcaggcttctccctggtcatgggatctggatgagctccttcccctgagcctgtttcctcctctcctctccttcctaccagggtacccagcaagccatgactcatccttccagggcaccgacacagactcgtcgggggcacccttgctccaggtgtactgctaacccctgccaggcccagctgccacaccctttctgggagaagcatggcctacagaatgaagagggggaccaggaacccctgtgggagaggcttagacctgaagcagtgcccactctggctcctcctgccttggctgactgggttcctggaccatgtgcatttcactgggccatgggatctacatctccttgcatccccagctggtctgatccctgccagggccccttccttcctgctcatggtcttcaggtggcctgatcatggaaagtaaggagttaggcattaccttctgggagtgaaccctgactccatccccctattgccaccctaaccaatcatgcaaacttctccctccctggggtaattcaacagttaaaagaagcttatcttaaatgtattgtattggggggtgggcagggcccactctatgttatgttaaggagttggttctggttcttggctgatgttctgtatcttaacatgaccacagtttgtaagtacaaaggtaattggtatctgcctgctttcttggctgtcctttctctcccatctgcctcacttaactgctgcccagagcaggagacaggatatgtgtccagcctggcttagtgccctgcagttaaagtaggaaggataaaatgggagtaatgctgcccccatttcaggttcactgtgagttccaggagataaagaaccaagcacagagtctgtgcctgagaaaggttggataaatggtttctgacattgtttgagaggttcttctagggaggcctgtccgaactgcctctgctctcccagtccactgcctgcaggctggcctgcttctgcccagcccacagtttccccaaagccttgatcatttgttggccctacccagccttggacctgctgctccccttccactctctctgtggtagtaacagagcactgtggtttttttttttttttttttttttttgagatggagtttttgctcttgttgcccaagctgctggagtgcaatggcacaatcttggctcactgcaacctccgcctctcgggttcaagcgattcttctaacttagcctcccgagcagttgggattacaggcatgcgccaccacgcacaaataattttgtattttttagtagagacagggtttctccatgttggtcaggctggtctcgaactcctgacctcaggtgatccgcccgcctcggcctcccaaagtgccgggattagaggcgtgagccaccgcgcctggccagcactgtggttttcaccagtatcttcttggcctctccaataacgttggagaaaggacattattctttcacagagaggaaacgtggggctcacagtgaggtcaaggaacttagtgggacacgcagttagtaactgtggctctggccttgctggggcagatgcagaatcccttcattaggtagcagagcccagatgagttcagaaggatcctacttggctgctcctcacacacaggcttatctactggtcctctttcagcagagaggccggggcaggcccaccagcccattcttaattaacaaacaagctagaaagtgttgaggatccccccactccagctcccatctgacctgctgcccccaccgccctttttattgttccgaaaggcaccctttggaaagtaactactagacaaattgtacttgtttgtccagtttcctaagggaaacaggatgatctctcagggctatgaacatagggttcagttctaactccaggctctgctgtcgcatccgggtcaaggcctccaaaagattaaaatgaccacggggcagaacaggagtacagagcggtagagtgacaccacgaaccaagcctcagccctagagcaccattttccaaacctagccttttaaaccattatttgcattcccaggaaaaaaaaaaaggtttagcaagtttggaaaacagacaaagctatgtactgcatagcctctctgaaatctttaacaagctattctgaattttttttttccccgagacagagtctcgctctattgcccaggctggagtgcagtggcacgatcttggctcgccacaacctcagcctcccaggttcaagtgattcgcctgcctcagcctcccaagtagctgtgattacaggcacgtgccaccacacccagctttttcttttctttttggagacggagtctcactctgttgctcaggctggagtgcagtggcgcgatatctgctcactgcaagctccacctcctgggttcacaccattctcctgcctcagcctcccaagtagctgggactacaggcgcccgccaccacacccggctaattttttgtatttttagtagagacagggtttcaccatgttagccaggatggtctcgatctcctgaccttgtggtccacccaccttggcctcccaaagtgctgggattacaggcctgggccaccgcacccggccaacacccagctaactttttatatttttggcagaaatggagtttctccatgttggccaggctggtttcgaactcctgacgtcaagtgatctgcctgccttggcctcccaaagtgctgggattacaggcgtgagctactgtgcccagctattctcaaattctaaaaaaaacatctgtgttccagaaatttaggagccaaagaactaagcactcacagcaagtcaacctagacattcttgctataacctctgtggcccaagcattctgacctccactctctagccaaagtggggcaggggtcagctctgtgggctggatctgagcaaaggggagcacctcttcagccctgggagctggctttgagaaggcctagaatctgcagaggtccaggtctgagatacaaacaatggagcctcactggactttactctgtcctcctggtaaggtccctgtaccacacacaccagatctgaggcctgagctgtcctcctggtacccctcccctgagccaggcagtgtcaccttggcccttgctgctcttctgccctgggacacaatagtctctagtttcaagaatacttgattcacggctagagggcagacccgctgcagtgggaagtaaaaatcagatcaacaagtccagcggtcttaaaacttttttgggtcatgcgcccctttgagaatctgacatgtgttctggtctctgtagccagaaaaactcaacctttgctcagaaacatacatagactaaaagccttgttttatttatttatttttttgagatggagtctctgtcacccatgctggagtgaagtagtgcaatctcggctcactgcaacctccgccacccgggttcaagcgattctcctgcctcagcctcccgagtagctgggattacaggtgtgcaccaccacacccggctaatttttgtatttttagtagagactgggtttctccatgttggccaagctggtctcaaactcctgacatcaggtgatctgctcccctcagcctcccaaagtgctgggattacagacatgaaccatcacacccggccaagccttgttttaatctttaagtaatgagaaactgaggcccagagaggggcaaggatgtgccctaggtcacatggcagaatctgggctagaagccaaactcccagttcccagcagcagccgtaagaggcctgtgccccagagaaaggccagaggcaagagaggacacagaaggagctgggcaaatcgttttaatgtgtaacagtaggccaactggggaggacaaggtcccaagacccagcctttctcctgatgccccgggacctgtgtgcctgggccagtcccatgcctgccccaagccctgaggcccacaagtcccagagaagagtgggaaagaaagttgggtggttgcagctcagccccaagagttcagggaggaaaaaacaggggctagttgaatttagccttggaaaaatccatctccggatgttgatccatgaacctggagaaacggaagcaagatgaaacagctcatccttctcttctaaagctgtcccttctcccagcacccccgtgtcaagtctaatctctttagacctcagcaacaccaagccaggctgggcaggagcagggcccagggtatctgagacgcatttgagtcccgaggctggaagctgaggcaccaacactggcattgttttcctgtaggtggcaatgaccgcctgttaccccttccctcctatcatgcaccatgagccggccttgccctcaagatgacctcagcaaatgacaagagtaggcaagccaaagccataaagccataaacatggctggaaagggggcagggcagctcctgaggcagcgcagtgatccactcactgctgtcaccgaagtctaagcccccaggcacccacggtcccccaaccccgtctctgaattgctcacttcttcagaatctcctgtttcttctgttcgtctgaagttggcagccccatggacttctgtcgctggtcatacatcatyttttccaccatgctgcgagtctcactgtccaggtctgacagctgagggcaggcagtgacaggaatcggtgaagctctggaaacaacgaggcccctcaccttcctgctgaagctcccccaaccagccagggctcaccttggaattctcagggttaatcttcttggtgttgatctcagggtcactggacaccaagcggctccaccactccatcttattgatctgtgaagagaacaaccagagggtgggaggtggcctgctctgtgcaccaggaatcaccccttaaccctttcacaaccaaactctctcccatccacatcctgcacctgagacccttgcaggcctacactggatccagaggtacaagactgtgcccttcctgcagctaggggagacacagaggcaaagagttacaaatcagtgtgataagggaaagaagaaagcagaaagggagatattcatccagggtggagggagaaaagtttgaaagtgacactcgggctgagtcttaagacacaaagcagtattccagatttaaaatgggaagaaaataaatatatatattttttgagatggagtcttgttcttcttgtccaggctggagtgctgtggcaccatctcggctcactgcaacctctgcctcccgggttcaagcaattctccggcctcagcctcccgagtaactgggattataggcatgcaccaccacacctggctaatttttgtatttttagtagagacggggcttcaccatattgggccaggctggtctcaaactcctgacctcagatgatctgcctgcctcagtctcccaaagtgttgggattacaggtgtgagccaccatgtgcagtggtgcagtcagctcactgcaacctccacctcctgggttcaagcgattctcctgcctcagactcccaagtagctgggattacaggcgcccaccaccatgcccagctaattttttgtatttttattagagatggggtttgccatcttggccaggctggtctcaaactcctgacctcgtgatctgcccacctcagcctcccaaagcgctaggattacaggcatgagctaccacgcccagccagaaaaagtttttaagcagggaagtgccaggtgcagtggcgcctacctgtaatcccaacactttgggaagccaaggcaggaagatcccttgagcccaggagtttcagaccagcctgggcaacatgagaccctgtctttacaaaaaacatttaaaaattagccaggtagggtggcgctcgcagttactcaggaagctgaggtgggagggtcgtttgagcccgggaggtcaaggctgcagtaagccgtgattgcgccactgcattccagcctgggtgagaacaagaccctgtctcaaaaaataaaaaataaatttaaaaggcagggaaagggctgggcatggtggctcacacctgtaatcccagcactttgggaggccgaggtgggcggatcacaaggtcaggagatcgagaccatcctggctaacacggtgaaaccctgtctctactaaaaaatagaaaacaaaacagacaaaaaaaaaaatacaggcatggtggcgggcgcctgtagtcccagctacactggaggctgaagcaggagaatggcatgaacccaggaggcggagctcgcagtgagccgagatcgcgccactgcactccagcctgggcgacaaagcaagtgcagaggcatggaggggtgagtgagtgaaggcagccagtgccagtcggacaggctgttacagggtcttatgtgccctgggaagttctcctcagacccttggcccttttcagaccacctttatttactgatctctgtgtcctacctctctgtaaaggcagtgaggttgagaatgaaggcttcctgagggcacatattttcctatgttttgttcactgttctctttccagcacttagaacaagaacagtaccaggcacagagcaggtgttcaagtatttgatgaattgaatgcatgtacaaacctagtgaaaaagaagtggctttagaaactaagact

SEQ ID NO: 12246 - DNA, 20183 bp, Homo sapiens
gaggaagagcactgctggcaaacataaagagagaaacatggtgtcccctcaaggtacaaaaaggtcagaatggctgcagtgtgtgtggaaagctgggagaggcaggtaggggctagagtgtgtgggctgtgatgcttaggttgtggctatggggtcatgtcaaagaaagtgggtcttgtgctaaggaccacaggcagccaaggaaggaggctggaagagaaaaaacataaaccaggtacgcctgtcccagctactggagaggctgaggcaggaggatcgcttgaggccaggagttggagaaacatcctttgtgctgcattcctcaatttgtcctcccctagcttctcagagtccttgggaggctggctaggtgagaatagtgataatgctctttgcagatttagaaactgagacccagtgagatcatgacttgcccgaggtcacacagctgttgtatacatatggcaagactggaacccaagtctcactccagagcccctaaaactagggaggtagatagattctctccttcactcactcatttgttcattcattcaatatactgtacctgtctacaaccataccaccctgaatgcacccgatcttgtcaatatactataccttattctccgccagaaactcttcttaaaaaggatttcagcaacaaattagaccaaggaaatagatgagaccaggctatacagtctgggctttcttctgtcagcaacagggagaggatggcttctgagaaggcagattgcccctccccactgaggtaccccctgtcccccagggcagggagggtcattgttctcatttcagggagcattctgccacaggcagcagtttcttagaagcaaattggtgttgagtaaacctctaccttctgccatcatttgttctctccagcccacagtatctggaactcttggggaacaaggaagcagatttcctagtggcagaaagaacactccacccactgtagctgcaatccccctgcactgtgagctaagtgagagcagggagctctcctgttcaccctggatcctcactgagcctagcacagtgcctggccataggaggtgctcaattaagattggtagaatgaatgaatatttaaagagagagaaagggaaatatgaggaaacttatgtccaagatctgaaggccactctgtgacctcaatgaagaggagttggccatatacttgaatcctttcctacttattcagggtctcaaagggccttggcttactcaaatatcccggggaaaagaactggaaggaggaaaggagaaaggagttactattccttcaatattagtgcacggtaggctttccatttgttatctcttttaatcgtcctaacaaccctgagaagttgatggccttcctctatttgggagaaaacaagactcagaagggggaaagggagcttgttctaggtctctagctagtaaatgcaggcctggagtttagaatcagggctctttccaaagacactgcatctgaagatgtcagaggcattctaaccagagtgactccatcttgaatagaggctggataaaatgaagctgagacctggctgggatgcattcccacaaggtgaaacattcttagtcacaaaatgtttacagttaagagttaagggaacaggttaataatttactaaacagacatttctttacttctctaataaacttgcttttactttattctgcggatttgccccgaattctttcttgtgtgagatgcaagaactctctcttggggtctggattgggacccctttctggtaacaaagaccccatggaccaagggcataaaaagaagggatgtctaagacttgctggttctatggcaggcagaggcagaaagagccccaccatcattcccagcaaatgggaaaagttcccagttgcagatattaggggtgggatggggcgggggtagtcagcatccatagacttagaccctgaagaggcaaaaaaggagggccatgttcttgggtcagcagagcttctactcagcttcttcagcctctagctctttcctggtgctagtagcacattctctagtggaggcatccagatggcagggagggtccaggaaacagctgaacatgctgagcaggcctcccttgtccccgctccccatggccccatggatcatccggtgctgcagctcatctcattggctggcttctggttactcatctctcctcttctccatcttcccagcctgtggttgccgtggaaacatagaacagtgacctcaccataggatgagggctggggagatgctgttcttggcaggcgctggtcttgctgcctgccagatgttatatccacatctggatctgccaagggcaagacagaggagtacaaaaagggacagggctcacattcttccccaaatgtagtcagcataacagaggaagaggatgcaggtagatcagagggatgaggagagaactgtacatacttagaagggagaagggtgtaaaccaggaggaaaggagatggggtgtggcttatgggttaacctcggtgacccaggtctgagcaccatggcgaggtgagggaagggcagtgagggtagttggtctgaggtttgtcgagtagagctcctcaaagccccgtgctgctcaatttggacaggcccaagagagggagcaaatggattttctggcagtgaccccaccccaacccattctgaaaaacctctatagcccctttttcagttgaagccctttctaatcctgtcccagaaataataaaactgaggattaaagaagcaaagcaatctgcctcaggtaactaactcagtaggtagtggcagagctcagactaggtcttaggtgtctgcactatccctggagacaataacaatagcagcaggaggagcagcagcagtgaactttcgtaagtcaaccatgcttagcatttaaatgtattatctcgggccaggtgtcgtggctcacacctgtagtctcagcactttggaagccgaggcaagcagattgcttgaggccaggagtccaacaccagcctgggcaacacggcaaaaccctgtctctaccaaaaaaatgcacaaaaaattagccaggcgtggtgccatgcgcctgtagtcctaactactcaggaggctgaggtgggaggatcccttgagtctgggaggtcaagaatgccatgagctgagatcatgccactgcactccagcctgagtgacagagtgagactctctccaaataaataaataggccaggcgtggtggctcatgcctgtaatcccagcactttgggaggccaaggcaggcggatcacttgaggtcaggagttcaaggccagcctggccaatatggtgaaaccccgtctctactaaaaatataaaaattagcctggcgcggtggcccgcgcctatagtcccagctacttgggaggctgaggcaggagaatcacttgaacctgggaggctgaggcaggagaatcacttgaacctgggaggcagaggttgcagtgagctgagataacaccattgcactccagcctgggtgacagagtgcaagactccatctccaaaaaaaaatcccttcattttaaagatgaaactgaagctggcgtggtggctcatgcctgtaatcccagaactttaggaggtccaggtgggcagatcacctgaggtcaggagtttaagaccagcctggccaacatggcgaaaccccgtctctactaaaaatacaaaaattatccagatgtggtggcagttgcctgtaatcccagctacttgggaggctgaggcaggagaattgcttgaacccaggaggtggaggttgcagtgagccaagatcacaccactgcacttcagcctgggcaacgagactccttctcaaaaaaaaaaaaaaaaaaatggagactcagaatggcttaagtgaattgcccaaggccacacagctagtacccaacaaaattcagatcagaacgcagatctgccagcagccattagcccagccccagctctccatcattgcattacaagggccacataaggagtcagttctagttcctggccacacagtccttgagaggaggccctatgtgtgagggctgcgaccttgagtcagaaatcatcttttccccctcctcctctcctggcacctgttccaacagtgagatcaccaaggctccatgcccagccctgaagcctgtccctatagctttggcagaaatgagcctctgagtcttctggcaactggaccgtccaaaggaatcaagatcttagggtggggagagggctcttcytccctggccttgttctcagaacagtccagggaagggaggcagggtttgcacatggagaaacagagtcccaggaaggagggcctgccatactctacgcacgtggcaggcctctgggctcctgtgttggctcctgcaggcccaccctggacaggctgctgctggctgaaattcagttcggcactactccttggtgtgcagggcctcctgccatccctcagaaattcatttatacctcacttcctttgagaagtctacattgggccctcaggtcaggacaggacaggactccctttagaggcaccacgctagttttatgtctggctgcccagaggtgaatgtgtgtcttgttccctgttgtctctctccaaagcagggcctggcacaaagtaggtgctttattaactgctgaattaatgagtgagctcctcagagcttcaacttgttcacctttttaaaaagagaaaataatacagtaacacctacttcatggattttgctttaaaagtccaatgaggccaggtgtggtggcgtgtgcctatagtcccagctgctggggaggctaaggtaggaggatcccctgagccccggagtttgaggctgcagtgagctatgatggcgtcacagtactccagcctgggagacacagcgagagactttgtctctaaaaaataataataaaataaaaagttcaatgaaacaatacacccaaagccctcagcatgcaataaatagcaagacaaggcaggtcttatttttactgaaagtgcttagtaaactatacagtgacaaaccaccgcacaacaggctctcgaaaggaggcagcaaattacccaaaagtgcaggcggcttgctagtgtgcacaggccaaagaaagggcggcaggtggggaaggcagccatgggccttgaagagctgaccgaattggcagaatttctgcaggaggggagctgggaacgacctgagctaaagctcggagctgtgcgaagaaaccggaaaagcccagagcacttgcaggggcgggtggggagctagatggtggggtggggtggggacggaggagggccagcaggagacattccgcagggaggggcaagcacgtgtgaggcgggcggggcgcgaagggtcaggcttttgctcaaaacaggcagaggacaaggtcagctcagccgcagaccgagccgctggtgactgtctccgccaccaggcagtgagagtgaagggagagcgcgagctctgaagcccgctagactaagcttgcaatctgagctccattcaccccctcctatttcttgagaccttgtcagttcccctgtgagcctcggactcctcacttgtaaaacgaggacagatgcccgtgccagaagtcaaccagagctttccccggcgtgggcaccagcccaagggcgttttgcttttctagtctcatctctgctctgacgctaagctcaaagagggactgggggacgggaagatatccaccatggcatgcgccctagctctcgggctggtgttggctgcttccttctcagattccagagtgcctagaggccaggaaagggagaaggtcctaccagcctggggtagggactcgggggccaggcactggcgctgacgcaggctagcagggcgccactggctggtccccacccacctcggtgggttgggggatgggcgcaccagcccctcctgggtgagccctagcctggggcttcctatttcgggagccgggggcgtgggccacgtctcctcatgtgatgcgagggctatttaaagcggcagcccgggcagggagccgccgtcggagcccttgcacgcctgctctcttgtagcttctctcagcctagcccagcatcrctatggtggacgctttcctgggcacctggaagctagtggacagcaagaatttcgatgactacatgaagtcactcggtgagcaagccgcggggctcaggatgttggcttggggactggctggtggcgtgcctakccccacgcagcactcctgccgcatccctcctggttaagactgggsaataggggagcgcggagatggcagcctggcctagagcaggtggggcctgttcagagggggctttggtggtccaaatctggttagagaccacggtagggaggtggtggaaggaggcagctgtgtgggaggctctttccaggaagagggatatgtgatttggaggtaggaggagggtttggataaagaacactgatcacaggaaagggagtgtagccaggggagaaaaagaacaggggcatgggtagtttagaaattggaggagactgaacccagaaagggaatggggcagccagggagtgtacaatgatgtaaacaagtaggaaatacctaggaggaaaaagattagtggggaaaaaactgtggatcagtgaatcagatatgagaaggacgtaagacaggaacctgcagtaagcagcaatccccatctctgcttggttagggaagagaattcttgctggagaatgccctttctcaccagccagtctgaccttgtcctgcagtctatgtatccaggccttcatcactgtctgtgagcctcgtggtagggtggggcaagaggcccatgatcagctgggcctttcctgcaacccaaggctcacctatctgtgcgaggggtaggcagagaaagccattggacttctgatgtgcagtagagggtcccaaggcaaggtcaagacctgggagggaggatcactggtttaggaggatgtggagaactgctgtggtgttgggatggagaagaatcaggattcaaagaatctcacaggtgaggaacttggagattcccataccatctagttcaacagggaaactgaaaccaggagagtagaaatgtattataacaattccacagcagagccaatatgaaaatctaaggtttctagatctgtaacccagagctcttcccactaccctacaggccctgcgagtgggaagaaaagtagaaactgcttagctaatgattgacctcagcccttcttctactgctttgggcttagatggagaggtcaaagctctcaayggcctctaccctatcttgggcgctatgcccagtaattctaggcaggcagtcattcttagaggagcagcccccagcccccacgaacacagcccagcagctattgggaagttggaatgcccagatttagttcctccttccaaagctgggccagagctgagtcttgaattgagctgcaacaactttaccattcttgttcccttattctgccccgagttgggtcagcgggctggtctccctgaagtcctgttatctttcagcagcttatgttaaggcagccagcattctcatcgtaggaatggaaagcctgggaaaataccctcctcagctctcagtaagtagtgctggcttcatttctaagtagaacccagatctccctgagtctcctaaattctgtcagctcaatattcttagtttctcttggttcagaccctcactcatcccgcagtggtttccttttcaaacactccatacctctgggtagatcctaagtgaacagagctcccagtgccgtgacaaggtcctgctctgtgcaagggagtgtgattggcctgactcatcctgataccaaggggcaatgccaagttcctcactggccaagcaagggtgggctgacagcataacagcagaggcagcccctgcccctcctgctgtagacctagggctctcaaggggcaaagaggtcccgtctagtaccagtgaccacaggcacaactgctggcctggattgagtatgtgctggacagaatcgcccagtgaaaatagtcaacagttttggagccgaggttcaaatctatgtcagtagtttattctctttgaatttcgacaagacacttcgcactcttcattgtaaactggggataatctacgcttcgaggctgttacaagcattaagtaaaacaacccatgtagggcatgtgcagagtacctagcttccagcaagcactatgtagccaggtacatttggagactttacacacaccacctcactacactgggctgcctcctgcctcacctttgccttggaagacagttcaatgttaagctgctggggggagagggggcagtcatgattagttctttgttctttacttggttgcaggacacttaggactttgcccagtacccaaggaagccatgcttgggtcaggaagagagtctctgtaaagccttagactgggagtcaggagacgggtttgagtctaactcattgttgctaccgctttaggctcctcctgaatctgcacaataggacaaatacttcctttgtacctaactcctagatcatagataacaggctttgaaaatgatgggttgccatgtataagggacaagagcactaacacttcttagtttcagggtaaaaacttccaaagttggaaaactcctatgcctaaggctttggaagggaaagtctatgtttctcttctttcctcagccttattcctaaggctttgagagcttttcaggtgccctggaaggcagccttatgctccagccttgggaggtagtatagctgagcacttaagcaagctctggactcagacaattctgggcttcaatctcagatttgtgaccctgggctttacctctgtttttgtatctgtaacgtggaaacagtcttcagaagaacaggaagaactaaatgagataacatgtacagttcttactacacaaaaagctcatagtacttaatagtagctttttttttttttttttgagatggaatctcactctgttggctaggctggagtgcagtggcacaatctcgactcactgcaacctccacctcctaggttcaagcaattctcagcctcagcctcctgagtagctgggattacaggcacataccaccacatctggctaattttttgtakttttagtagagacgggtttcaccatattggccaggctggtcttaaactcctggcctcatgtgatccgcctgccttggcctcccaaagtgtgattacaggcgtgagccaccacacttggcccaatagtagcttattctaatcccwgctctgccactgacttgctatggcactgctgttccttaagtatctctcatctaatgggatcagttatctgtgttcaccaaacagaactaagcgcaagactgaattttaaaattcccatgcaaaggctttgaaagatacagtcctccacttccccatacccaggcctgagagttattcattgagtttcttgtacactgcttctctaccccagctcatatactcataaccttccccctaccctcaggtgtgggttttgctaccaggcaggtggccagcatgaccaagcctaccacaatcatcgaaaagaatggggacattctcaccctaaraacacacagcaccttcaagaacacagagatcagctttaagttgggggtggagttcgatgagacaacagcagatgacaggaaggtcaaggtaagtcagggaaacaggggtggggaatggagagtgctgagactctaaaagagaataggctggtagtcttggctccctrgtattgcaccctgaggggcagactatcatggggaatttaaatgaaacaagattcataaagcctgtgtagtgctggaatgccactgatgctaaatacatgtcagttctgtcctcttgttttcttccctcccttcttgggattcatctattgtctgcctcggaatgggcagcacagagccaggatgttcttctgacctcagtatctactccagctccagctgggtgaccctgtgcaaggtatgcagtagctctaggtttctttccccttccatagatggcagagttatgtggccatggctgtgacctgaagtgctttaggaatgatgcccagaagtcagggccctccactgagtgaggtcattgtgacctccagcagcaaaaaaggcagccaggaactagaagcacctactcagatgccgcttcaacttctaactcccagacatggccaatgaccctgacaaactatttccagtgttgccagctgacaggcaggaagagctatgttccgtgatagggcattcaccttgtcatgaatgtgtttgcagtgtcttcccaccaagccttagcccctcctcccagggttctatcaccctgcagtggctgtcttggcagcttgcctcagccttccaggccaggcatgggagcgagagaacttaagggctttgacctctatagggtgtccctatagcagtgttctatcatgacactatcattcagccccatcagctgtttcctcttcctcatagctgtccccagaaagaacaggatcacacaggtggctggcagcagagctggggatggtgcccaaagatggcagtctaccttggataaaggtggctgccccaccacctgctcatacctccttggacttgcctactttctcaaggggcaagaaccccaattaaacacaatagccctgtggaatgcctagggcaaaaatatctactctgagtaggcaaaaaaaactaggggaatgagaacaaggagtaaggtaaggataaaaaagagcacactaagagacaggcctcataccccttatcacctaaacaatacacagaaccttctcagattctcctactgaaccaccttgctcatcaggatcccttagcctggccttgtggcccccaaactcctaggaaagagagctggaagagctgccaaatgagaaccagctgatgtatgtatgctggcagcacccagagctgaggaaccacttcaagggcatccagtcacaggactttgtggttgctgccctcttgttggctaaagaggtcacatgatgtggaccaagaaaaggtgtaggaatacagggcaggaagtctaattatccaatacttcctatcactaagggtcttttagacattatgtggactaaccacaaggctggataaagattctcaggactactcctcctcctcagtcagtctttcccagggatagactagtaaatcccacctgtatctgaggggaccaggctacgggaatcacctagagtacagataagtgtctgtcttgaaggcttgtggtacttctcagagccaggctctctggctccaccatactgcctgcctctccctccttgcctaatatctgaaggcctcttccccagaaaggcagtagtggagcagaggctggaggtgaactagatgtcttgcagggatagctgggaggcggattgcctgagctcttgtcctcacaccatcactagtttgggtcaaaggctgtgtsctctgtggcccagtgtccagaccccaccctgcccctcaattcctgactaagatcacagctcaggcctctaccctctttccacagtccattgtgacactggatggagggaaacttgttcacctgcagaaatgggacgggcaagagaccacacttgtgcgggagctaattgatggaaaactcatcctggtaagatgggcaactttggagctatatctgattggttattactactgctctttcagccaagcctgttctaaaaagccaagtcctcccctgagagctgtagaagctgggacaagagagtggttgtgggtcagggtggtatcaggtgggaattttctgtgtagtggctttggactcacacaggccggaactcaaatcttaccttataggctacatgactgtgggcaaatcaccttttccaagtgcaactgtaaaacgggtattaataataccaaccttgtagggctgctgggaagcctgtaagagacagtgtatgcacagcacaaagcatcactgattgaggaacacagcaggtgctccatgtcctttgtttgctcttcctgtgtttctaccttgcctcacctcaggaagaagtagaaaacagggccaaatctgatcccaggccctctaggaggggctcccattgcctatctcagcattccctttcctctcctccctaggactgcattgtcacttgcagggacaggctcgtgactggtggggacactgaatgacagtacagtcctttcttccccattctagtcctaccccattttcatgctttctatgtctggcctactgaaactacttgactactgcttgggtaggaagtaccacagccaggctggcagatctgttcaagcttggggacttcacttggagaatctagccttgactgaattccccccagacccagggagagcagccaactgtggattctgcctaaccacagggcctcaggttttcacctaggcatcttcactgcacaccttcttgggtcagcataacctgttaactgcattcttgtactcatgtgggacaggggtccccttgaagtttggaatgaggtgcctagctttggtggggatgtgatatgcaggaccaaattctcagtggcagctgaactatggtgaggccatgggtctggctctatgatgccagaccggatagtgggaggtacagggctctggccctggcactactctaagttagggaaggattggagttagtasccaaacacagtcctttcctgagtctctggatatttttcctatttgtcaactatatgccaggcaccatcttagacactaaggatgaaggaagccaaatggtataagggaaggaaaaacactcaggatcttgaccaaattacttcctctctaaaggctcgttttttccaaatctctaaaataagaattacaatgcctrtcttaaggatttgctgtgcatatcagaaaaaaaaaattatgtatgtatacacacacacacacacacacacacacatacatacatatagccggcacatagtaggtactcaagtgacaattatcaggaggaagggagggtagaatgctcgcaatggtgttcctggctccaccccccatctcactctgtctttccttccagacactcacccacggcactgcagtttgcactcgcacttatgagaaagaggcatgacctgactgcactgttgctgactactactctgccaatcggctacccctcgactcagcaccacattgcctcatttcttcctctgcattttgtacaaatccacgaattcttctggggtcaggtgccactgaccgggatccagttccagttcccatggtgtatgtggtttttttttttttttttttaactgcactcatagggtgctctgaggtcaataaagcagagccaaggccacccagttgcctttttgcctttggtaacataactctgggagtcttggtttatcctgtgtgtcagagagtgggcagaaataacggcctgaaggttactgaggaagaagcactggatgggagactgaaatggacagtctcggagcctgttaatcagctgatcaccttacacatttaataataaaagagctgtacctacacgttgcctttacactgccccccctccatggtcaaatgacctagttcagtcagtgatggggcttccccaggtttggctattgaactgtcacttcaggcccatcctacactgaaagctcttgggtctggctgttctctgtgaaatgctgtagtctctccctttccagaattcaggttcagggcacagaacccaggcttgtaccatggtggtgggagaaaatgaccactggccaagaggactgctgacctgtgcaccaggctagtacttatgactacaaattcttactgcttctctaatcaactctgagggaagagggcatctgatcattacaaaagggagggcttataagtgatctcccaagaaggcagtgatctgctagtgcctttggctctgtacctctgctgggcatctctccaaggtctaaggtaacatattaaatgtttttgtcagctaatgcaggctcagtgactttaagtctgtaagttacccaggaagaaggattataggaaaaataactcagtaagtttaaaaccaaacacatttccatttagtgacaggaatttaagcaaggacctgaagtagaatcaactgattcacacagtagtaaatacaaagtagaacaatgatcttggcttcgctgtctggttcagtggtctgctggaatgcaatacacaagttaagtcacactgcagactgttttctagctgtggccgctggatgccacttctagcatagtagaactatgttaggaggaatgggaaaagtgagcaccacttctcaccatgttcccccctcctgctgccagtctctgctcccatgttggatgcagcagagatcacccaccagttggcccaggacagaccaataggaagggtccaatcactctaactacagccgaactcacctccacaacagtctctgtggctctagcctggactcctttacaggaatccagctctggcagtggcagctggagagggtaataggacctcctgctgaatgaaggaagttgggtgaatgaatgggtgagctgcagggttcacttgcaaagggaccaggagtgataaggaaacaacaactcattcaggcagctgcttttgacctctaactcccaaacctgcctgttgcatgaggggaagccatctcccatgggagcgaagttaatggggtgggaggctatattctcactattgagtctttccaggagtctcaaggcacaaggctcctggtttcttactctcaaccaccccctacactctttatactctcactccttgtgcttcttcttgtgcttcttcttctttttcttcttctttgctgccttgctgtcttttgatgtgtgccttgccctcttgcctgtatcactctcagagtctgagctgtcagagtcagatgacttcctatctctatgtttctttttcttcttctcctgaaaagaaaattttaaaaatcaacactgtatgtgtatatttgcttttaacaatcatagcacataattggccaggtgcagtggctcacacctgtaatcctagtactttgggaagccgaggtgggaggaatgcttgaggccaggagttcaagatcaacctggctaacatagcaagatctcatctctaaaaagagaaaaaaagaaaaattatagcacacaatcaataggggaccacttaattttcttttagacagtctcgctctgttgcccaggctagagtgcagtgcagtggcacgatcacagctcactgcaacctcaacctcttgggctcaagcaatcctcccacctcagcctcccaagtagctgggaccacaggtatgcaccaccacaccctgctaatttttatggagttgggtttctccatgttgcccaggctggcctcaaactcctaagctcaagcaatctgcccaccttggcctcccgaagtgctgtgattacaggtgtgagacaccatgtccagccaacacttaataaagtataagacattgtggccaggtgcggtggctcacgcctgtaatcccagcactttgggaggccgaggcaggtggatcacgaggtcaggagatcgagaccatcctggctaacatggtgaaaccccgtctctactaaaaatacaaaatattagccaggcgtggtggcaggtgcttgtagtcccagctactcgggaggctgagacaggagaatggtgtgaacccaggaggcggagcttgcagtgagctaagattgtgccactgcactccagccttggcgacagagcgagactccgtctcaaaaaaaaaaaaaaaaaaagtataagacattgcaaacaataaagtaaatctttaagtgccaacaagaaaaaaatagctaaaacatgttaagtaaaagaaccaagacataatatgtattgtaggttccagtgcgtataacatatacatgtgtatttatatatatatgcacatgatataaactgtgtatgttacacacacttgtgtatatttagtatacacagagaacactgaaaaggatacatcaaactggtaataagtgttacacattgggaatgaactgaatgggggaaaggatatgggtctttcactttttccttcaaatacttctgtctaatttgattttttttaaacaagtatcttattactttcattttttaaagtgcaggacattaaagctgaaaggcgcccctaaagactagccagtctatctagaaacagtgactcacatatccaaggtcaaagaataggagtaaaagatttagaactcctgactgctattctggtttctattagatcctggtgccaggggaaataactgccatcaaataataagcctgtacttgctacccttgaatattcatcatctctaactttacagccacctcacaagattatactcataaagaaaagagctgagaaagaacattcccaaaactatacccaccacatcatgctaccaaagtaacagtacaaacccatacaaaagacgagaggcagattcccaggtgtctaatggggcagtatgagcagattttaagcacggcataaatctcttctttgaatttcaaatacctatattgcctctgtaaggtttctaagaagagggagaaagtatgggaggagaaagagagcagaaaaggatgccagcttccaaccagcagcctcagagctataaatctagctgaatgatacaccaggtcttagaagctggctgtgaaaaatggtggaaagaacactgaagcaggtgttagatagacctggacctgagttctggctctgccatttactattctgcatccgtgggcaagtcatctgaactcactgaggcctgttcccttcaaatgtaaactggggataagaataacatctactggctgggcgcggtggctcatgcctgtaatcccagcactctgggaggccaaggcaggtggatcatgaggtcaggagatcgagaccatcctggccaacatggtgaaaccctgtctctactaaaaatacaaaaattggccgggtgtggttacgcgggcctgtagtcccagctactcaggaagctgaggtgggaggatcgcttgagcccaagagctggaagttgcagtgagccataatcctgccactgcactccaggctgggcaactgagcaagaccctgtctcaaaataaataaataaataaataaataaataaataaataaataatctccccctctccccaaaaaaaacacctatggtgacaagttaatgagatagtatctaaggcttggacaagttgaaagccacttgtcccagatcgcataggcgcagttgggatcttcatgtagatcatatgaatggaaatctcctgagttttcctatgtagcacatggcccctctttctgtatggtaacaggaggcctcatggtatggtcattagaacaacaaattttggaataagatagaattaagttcaaattctagctctgcaacttaactcactatgtgacttagaacaagggatttaacttttttgaacctcagttttcttttcagtaaactggaaataataagtacctatttcaaaggatgctatgaggtttaaacaagataagcactaactatagtgcctgacacattataggcacttagtgggagctatatgtatttttctctcattaactcccaggatgttctgacagcctggccaagcatctacaggagacaagtcaaagttttaagagaagatgaaataacaattcttccttggcatctccaatggagtagagagaaggcaacaaagcttctcagacccacattaccgagctataacaaccatggctgggaggagctgagagttggcaaatcaatagtttagctatgttgctgaaccttcctggatggcaagaccatggaagtccatcacaagatattatggggtcaggagcctcactgggttctgccccttatataggtgaatatcctgggaaagtaaaaatgaaaatacagagtctggcaccagttccctgcaagcctggtccagcctggataaagaagtgaggagagtaataatactgccttacacctaaacagtgctttagtttatcaagctttttgcatccttatcttacaataatagtctgtagagtcaaacttcatgagttattattcccattttacagatggaaaaactgcaactcagaaatgtaaagtgagtcgaccaaggctaaagcggcaaaaccactatactttataacacagagtttggcactatttccactttgttctctctcaaagatgaaggctcaggaggagggaagataaaaacaaatcactggagagtcctggcatgctggaacatggactctagctagcaagaagggctcaaggaggtggccttctcctagacctcaactttgatgcaaaagctgttttgcagcctgaacaaagacaatccaatcctccagcaaatggcgtcattttccctacgtgtctagccttgagctacagaacaaaagaacaatcacatccgaagttgtagttcgcctggttgcggtggctcacgcctgtgatcccagcactttgggaggccaaggtgggtggatcacctgaggtcaggaggtcgagactagcctgaccaacatgaagaaaccccatctctactaaaaatacaaaattagctgggcgtggtggcacatgcctgtaatcccagctactcgggaggctgaggcaggagaatcgcttgagcgtgggaggcggaggttttggtgagccaagatcgcgccactgcactccagcctgggcaacaagagcaaaactctgtctcaaaacaaaacaaaacaaaacacgcacacacaaaaacaaaattagccgggcgtggtggcacatgcctgtaatcccagctactcgggaggctgaggcaggagaattgcttgaacccggaggcagaggttggggtcagccaagattgtgccattgcactccagcctgggcaacaagatggaaactccgtctcaaaaaaaaaaaaaaggttgtagttcaaaagcaaagttgggagttggggtgggggaagactgagagccagaagatgaaccaagcttctgctctctcaacttcattcaagtgagaagggaaacagaagataatgggttaaaaaaaaatgacatggattcaagtatcagatggaaatagaaaattaaacataaaacagtttttaaatggcataggagtgtgagcccatggcgcaggtcaagggggcactggaaggaagccactggtcaaacatctcaaagactgctctctaggaaaagcacatatcccttgttagagcagctagtctacccattttcactatagttctgaaacaggatagcagcagcccagtgtgacagaaaaacaaaaataaaagcaaaaactgaaaaaagagaatatagcagtgaacatttattgagtacttaattttctattttatttatttacttatttttaggatggagtcttgctttgtcactcaggctggagtgcagtggtgtgatctcggctcactggagcatctggctcctgggttcaggcaattctccttgaatcgcttgtagtcccaagtagctgggactacaggcgcatgccaccacacccagctaagttttgtatttttttttaactagagtcggggtttcaccatattagccaggctggtctcaaactcctgacctcaagtgatccacctgcctcatcctcccaaagtgctgggattacaggcatgagccaccacacccagccagtacttaattttctaaaggcaggtggatctcttgagcctaggagttcaagaccagcctggaaaacatagtgagaccctgtctctacaaaaacaaacaaacaaaattaccagtaacctccacgtggccaaatctagtggtcaattattgggtcttatttacttggtcagtcaagatggatacagaccatcttacctagaacacattcatggtatttctaccacattttacattctcttacttttctacaaacttc

SEQ ID NO: 12247 - DNA, 32332 bp, Homo sapiens
  misc_feature (1)...(32332): n = A,T,C or G, or insertion/deletion polymorphism (see Tables 1-2)
ggcacatggtgagcaattactaaattgtaggcctagtccctataatcccagcacttttggagaacaaggtaggggaatcgcttgaagccaggagttccagaccagcctggccaacatagtgagactgtgtttctataaaataaaaaaaaaaaatacccaagcttggtggtgcaggcctgtagtcccggctacttgggagtctgagtcaggaggattgcttgagcccaggagttcaaggttgtagtaagctatgattgcaccactgcactccagcctggcgacagagcatgaccctgtctctaaaaatataaaattaggccaggcacagtggttcatgcctgtaattccaacattttgggaggccaaggcaggtggatcactgtgagctcagcagttcgagaccagcctgggcaacaaggcaaaatcctgtctctactaaaattacaaaaattagccaggagaggtggtacacgcctgtaatcccagttactggggaagctgaagcaggagaattgcttgaacccgggaggcgaaggttgcagtgagccaagatcgtgccattgcactgcagcctaggagacagagcgagactcgatctcaataaataaataaattaattaattaataaaaaaataagttgggcatggtggcacctgcctgtagtccaagctactcaggaggctgaggtgggaggatcacttgagccaggagttctaggctgcagtgagctattatcacgccaccatactccagcctgctgtatgtactccagcctgggcaacagagtgacaccctgtctcaaagtaaagtaaaataaaaattaaaaaacaaattactaaattgtacttaacagtattgtcatcagtcttcctaaataggaggacaggcaaaattaagggacttaacatgtgccctcaggtatagtagtttggggcaggccagcatcacccgcacagtagttctgtactgtaggtgcgtgttctctgggtcaactttatggcccagtgaggccgtactctaccagaatgtcaggggacaagggttgggagaggcaaaagtgctggtctgaagcaggagtctgggtttccatcctagctctaccaccaattctgtatgaccgtgccccctccatttcctccatgaccacatagagacatggggcagttggatgaaatcaatgattcccagtcttggctctatcatggaaccatttgctaacttctttttttctcttatggatcccatatttttaaagatttttactaaatagaaattgacttatacttttccaagctggagtgtggtggcatgatttcagctcactgcaacctccgcctcccgggttcaagtgattctcctgcctcagcctcctgagtagctgggattataggtgctcaccaggcccggctaatttttttgtatttttagtagagacagaatttcaccatgttggccaggctgatttcaaactcctgacctcaagtgatctgctcacctcagcctcccaaagtgctgggattacaggcgtgagtcactatgcccagccgcttactcacattttctagtcaaaatagaaaactgcttaagtcactgtctgcagaagagcaaaaaaaaaaaaagaaataaaaaattgaaaactgctgatcagattgagaaaaacataagattattcaccacctaaagagaaaaaatttcagtcgaaagggaaaaaaattcatttttgtcttaataaggcaaattcacaatttttgaggttttaacaaaatatatgcagaaagacaaggccaccccgtagaacgtgcacacagccctaggcttggaaatggctggatttaataatatctggtctttctttgagccctgaaattctctaacactatgtcttggaacataattttactgttttcagtggttatagagatttgctttacaatttagcattggtctttacccatgattttgtttgacgccaacttgttgggcaggaatgcaccccctgccccccgctttgttatggccttgctcctatagggcaagaatatctgctttaaggccgggtgtggtggctcaggcctgtaatcccagcactttgaggggccaaggcgggcagatcacctgaggtcaggagtttgagaccagcctggccagtatggtgaaatcctgtctctactaaaaataacaaaaattagctgggtgtggtggcacacacctgtaatcccagctatttgggaggccgaaacaagagaaccacttgaacccaggaggcggaggttgcggtgagccgagattatgccactgcactccagcctgggaaacagagcaagattccgtctcacacacaaaaaatatatatatgtctgctttaagtatgcaggccgtgtttgtgctgaacggcaggaatgccaaacttggctgcatggtaccaactagggacctcagagttccaaggagaacaaacagttggttcctggaggctgggggcttgtatcagaccctgaagactaagcatgtgctgggtccattgttgtcctgcacccatggtagtgcactaaacacctaacctatatttaagtgtttttgtttgtccaaaaaatgtcttttttttttgggagtcaagagtcttgctctgttgcccaggctggagtgcagtgacacgatctcagctcactgcagcctccgcctcccgggttcaagctattctcctgtctcagcctcccaaatagctgagactataggcacgcacatccatgcccagctaatttttttatttttagtagagacgaggtgtctccatggtggccaggttggtcttgaactcctgtcctcaagtgatccacctgcctcggcctcccaaagtggtgggattgcaggcatgagacaccgcgcccggcctgccttgtcccttcttaaaatgagttgtccatttgtaagctgctgatttctttgggacattgtctccgtaaacttttcataaagcatcagtgatttcaccattcttccacccaagcttcaccgtaaatttgttgtttgttcttgcttcaatttcagcagaattcatttagctctgataagggctcgcttcaaactgatgtcttatccttcttagtgcctcaaactacatcctgttcactcatgttatagcaagttagtgtgagtttattttggtgcacaaaaatttttttaaatccatgcagtcttttttcataatacgcattttccatgaacttttcgaagaccccttgtagatgtctgttgtttaaaccacccagtttacagtaatttttttttttttttgagatgaagtcttgctctgtcgcccaggctggagtgcattggcacactctcggctcactgcaacctctgcctcctgggttcaagcaatttttctgtctcagtctcccgagtagctgggattacaggtgtgtgccaccatgcctagctaatttatgtgtttttagtagagacggggtttcactatgttggccaggctggtctcgaactcctcaccttgtgatcggcccgcctcggcctcccaaagtattgggattacaggcgtgagactcttgcacttggcctacagtaattttatagcagcctaggctaagatagccatttctgggtataagaatgtcatatactgaacaggcctgcaactgtgagtaaaagtctgcaaagaggccgggcagtggctcatacctgtaatcccagcactttggggggccgaggcaggtggatcacctgaggtcagcagttcgagaccagcctgaccaacatggtgaaaccccatctctactaaaaatacaaaattagctgggcgtggtagtgcatgcttgtaatccctagcatgcacttgggagctacttgggaggctgaggcaggagaatcacttgtactcaggaggccgaggttgcagtgagctgagatcacgccactgcactcctttctgggtgacagagtgagactccatctcaaaaaaacaaaacaaaacaaaacaaaaacaaacaaaaaaacccaacaggtaggtagcagtggttcacgcctgtaatccccactttgggaggctaaagtgggcagatcacctgaggtcaggagttcacgtccagcctgggcaacatggtgaaactctgtctctacaaaaatacaaaaattagccaggcatgatggcgggtgcctgtagttccagctattcgggaggctgaggcaggagaatcgcttgaacctaggaggtagaggttgcagtgagccgagttcacgctattgcactccagcctccatctcaaaaacaaaacaacaaaaacccaaaatatatattataattttattttatttattcaattttattttattttattttatttttctaggaacaggtctcattcaggccaggcatggtgctcacgcctgtaatcccagcacttgggaggccgaggtggaggtgggcggatcacctgaggtcaggagttcgagccatcctggtcaatgtggcgaaaccccatctctactaaaaatacaaaaattagccaggtgtggtggcacacgcctgtaattccagctacttgggatactgagtcaggagaatcacttgaacagggagatggaaattgcagtgagccgagattgttccactgcactccagcctgggtgacagggcgagactccgtctcaaaaaaaaaaaaaaaaaagaaagaaagaaagaaagaaagaaacaggatcttactctgttacccaggctggagtacagtggtgcaatcatagctcactgcagcctggaactcctgggctcaagtgatcctcctgattttttttggtagagatgagggtcttgcttgttgcccaggctggtctcaaactcctggcctcaagcgatcctgccatgtcggcctcccaaagtgttgggattacaagtgtgagccactatgcctggcctaaaaatatatatatgaaaatatataagaaatgggcctcccaggaattaaggtgtttgcgggagtcctggtccccagtttttctgccaacactccctgttcccacacatgacctggtccagaccccaaacagccaggcccaaaggacaggtgaggcgaggcgagaacttgtgcctccccgtgttcctgctctttgtccctctgtcctacttagactaatatttgccttgggtactgcaaacaggaaatgggggagggacaggagtagggcggagggtagggtaggaccagaagcctctctaggcctgccatggggcaggcagccagggagaaggagggcccctcagtggagacccagggatttcagtagcccctgttccgggacaggcgcaggtcctgggaggtgacagaagatagactaaaggcccaagagtccctggacctgactcctcccaggcagctgccacacacaaacacacctccaggcaccctggacaggaaggaggagaaatgggcccctcctccagtggctgagaagctggggcaaatgttggctgttcctatccctggtgcatcccatggcgaggggcaacttccatcaggccacaccttttatctttgtctctatttttgatatctgtgtattatgattatacaaacccccacattggcctatatgtgcagatctgattaagaacttacgatattccatggacattccattcctaatctcctttagtcctcacaacaaagtattattcccattgtatagatgaggaaactgaggcacacagagatgacaagcaaccaccgctatatgttaggattcgaaggagctccaggaaagtctcatagccccactggccagaatgggctaaatctcagagggggagggtgggagatgggggtgacagtgaccttttttgtgactcctcctagaccatccatccctgctcccaggaggacctgtcctcccagatggtggagatggacaggaggactatctacccacccgtccccacggccctgaccctctgacctcaccctctccgctgatttcttcatgttagttcaacattaacccagaggggtcaggacagacaattcctcagtgacccaggagctgacacactatggcgcacgtccgaggcttgcagctgcctggctgcctggccctggctgccctgtgtagccttgtgcacagccagcatggtaaggragygcttgcaggctggaacaggctggaggactggggtgtgggcccatgggctggggtctcctggctggacagagcacacagagctggcccctaagtaggtctcagccccaggcggccagcttagggaagaagtcaggagctcagggctggaaagagaatggctgcttctctcttccaatatagggagcaggctgggggcaaggggcagtgtaggaggggcacagggggccacatttagcagccttccaggcacttccaccagcccagacagcctctctcagaagccagcaggggagggtgggcttgcttcatgcccccagaatggccaagactgcctgttcctgaggccgctgtcccatgacccccccaccgccttacagtgttcctggctcctcagcaagcacggtcgctgctccagcgggtcyggcragccaacaccttcttggagraggtgcgcaagggcaacctggagcgagagtgcgtggaggagacgtgcagctacgaggaggccttcgaggctctggagtcctccacggctacggtgagcctgggctgctcggacggtgccggggcctcagaccgggcccaactctagacacttccacagagaagcaagcgaggaaygccacagccccttcgctgctcacagcctcatttcaactctgagcccctcctcacagggctggcaagaggagcggcctcagcctttcctgggggtctctgtgcctggactgtgtccctgtgcagctccatgacatggggaggcctccacagtcttcagacatccacctgccctggagctctgtgtccacatggcctcctcagcggcagactcccacaccacccttgaggggtgggactctggggaggccaccacaagcccccgggctcaagactcagtgttcctggagctctgtgtcgcctttcctgtctgtagggctctgccagggtcccactgccccctctcctcccatctcccccagcctctttcagtctcggtgtgtgtgttggaggaactcccctatcctcaaatattcttctccttttggaaacaaaagtaggaaactctgccacaaacctccccagagcctgccccctgcgtgaccaggrtaaaggaaagtgtgaggaggagacataacatttactaaaacaacacaaaacaggagctgccgtagcctcactcccagcccttgtttttcaggatgtgttctgggccaagtrcacaggtgagcaccgggaaggatttgccccaggaagggaggcctggggaccccagtgagagaattctacccagagaatcttctgctgcacctagccatccacccatccaccccttccccactccttccttggtccctcccatctgttcatccatctytctgtttctcaccaacatcccatccaccctgactccagctcatcctggccataccccaatcccaaaggtaaacacctgggtcttttccagcttgtgagacagcgaggacgcctcgagataagcttgctgcatgtctggaaggtgagcaactgacacgggtttggggagcaggacatrgaggggagcctgggagaagagctcaggggtgggtttggagtgtggctggtggaggccgaggcagtccccagcatctgacattgctcccattcctggggtcaagatgtctctttgtacctggctctgtgtctggcatgcgaacgaatgaatgaatgaatggactaatgaattaatgtttttttttttgagacagagtctcgctctgttgcccaggctggagtgcagtggcacgatcttggctcactgtaaactccgcctcccgggttcaagcaattctctgcctcaacctcccaagtagctgggattacaggtgctcgccaccacgcctggctaatttttgtatttttagtagagacggggtttcaccatgttggccaggctggtcttgaactcctgacctcgtgatccacccacctcggcctcaaagtgctgggattatagaagtgagccaccgcgcctggccatgaattcatgtttaaggcttcattctcctttgcctgacccgagtctctgcccccacctagtcagagctttgatgatgtcacattccccttctagctttaggtgtcactgaaccaaacaggaacccaaacccccagctgctctgacaccaaggacttccctaagcatgccaaggtgtttctagcacctggccttgcatatgttgtcaatttcctctggagcgaccatcacatctactgaacactttcctatccttcaaggactgcttcaaatgtcaccacttttgctgagacttcagggagcaccctccctcctgcactgtgttctgaaggcacctttagcacgacaaaaatggaacyctttgtttatttataagagacagggtctcccttttttgcccaggctgatcttgaactcctgggctcaggcaattctcccatctcagtctcccaaaggagtaggattataagtgtgagccaccatgcctggctgccatactttcatttttttttttttttttttgaggtggagtctcactctgtcgcctaggctggagtgcagcagcgcgatctcggctcgctgcaacctccgcctagcggattcaagtgattctcctgccttagcctcctgagtagctgggattacaggcacacactaccatgcccagctaattttttgtattttttagtagagacggggtttcaccatgttggccaggctggtcacaaactcctgacctcaggtgatccaccagcctcagcctcccagagtgctgggattacaggtgtaatccactgcgcccagcctcatttgttaaattacgtactcaacagacattttacaaagttcctgctacgtgccaggcactatatcaggtgctggggattttaagagaatcaaatacagtctctgccttcaaggaattcaaaatctcaaaagagaacaaaaatacaaaatattaaaatgattgcggccgggtgtggtggctcaagcctgtaatcctagcactttgggagctgaggtgggcgcccaggccaggggtttgagaccatcctggccaacatagtgaaacccccaacctctactaaaaatacaaaaattagctggggtgtggtggcacgcgcctgtaatcctagctactagggaggctgatgggggagaatttcttgaatctgggaggcagaggttgcagtgagctgagatcatgccactgcacttcagtctcggcaacagaacaagactcatctcaaaatacataaataaaaataaataattcaataaagtgattgcaagaaaagttctgttcaaggcaccaagagaccacaggaaaatgagtgtctggtttgccagaaaaatgagagatggcttcccaggagaggcagagttctgcctggcctggtgggatgcatggatgaacaaacaagtgggcattccagtcagaagaaacaatccgtggaaagacccagaggcatgagaagcygagctagcagggacaggtagaccagggccagttgaaaaggaccttcatcactttttcatcctgctggccaagagaagccacagaatggaagctccatgaggrcagggctgtgactgtcctattggttgatgtgtactgagcacccgacagtgcctgtcayatggtaggcacttagcgaatatttggaggccactgttgagtgaatgggagaactgctggttgcagaggaagaggggctgggtgaatgcaggttcaggattgtggacctgcatgagctgggaggtgggggatagacaactttgcagggagagaggaaataagtccccaggctccaaggctgaccggggtggggtctccgcaggtaactgtgctgagggtctgggtacgaactaccgagggcatgtgaacatcacccggtcaggcattgagtgccagctatggaggagtcgctacccacataagcctgagtgagtgaggggccggccttcccaccatgggctgagaacagggagcaagcgtacctcaagcccaacagcctcctgttgggcaatttcctsttccagaatcaactccactacccatcctggggccgacctacaggagaatttctgccgcaacccykacagcagcaccaygggaccctggtgctacactacagaccccaccgtgaggaggcaggaatrcagcatccctgtctgtggtaagctgggggcagtggggcggcccrtggccaaggcccgggggcttcatggggcctggcagcctgggatgggaaccaagaatactggctacccaggcacagtggctcatgcccgtaatcccagcactttgggaggctgaggcaggcagatcacctgaggtcaggggtttgagaccagctgggccaacatggcaaaaccccgtctctactaaaaatacaaaaattgccaggcgtggtggtgggcgcctgtaatcccaactactctggaggctgaggcacgagaatcgcttgaacccgggaggcggagtttgcagtgagctgagatcctgccactgtacttcagcctgggcgacaagagcaaaactctgtctcaaagaaaaaaaaaagatgctggccaccttcagagctggcgtcagtcattcagatcatatctgtgcctattgctcagtaaagtcagggaatcaggggatctgagtggggggatctgccagcctcctcctccccctccccactcttgacttccttatggtccaggctgtggctcattccaaacatgcctcctttctgatcaaggcactcctccctccgggaagccctccctagccatttcagtccacacaccctgttctgagtatcacagagcaagccttgtgcagtttggccctgcgggattctgtcattattatttccttggtgtgttaagtagctatagccaccccttccctgaggcagaccacaataagcatttctttttcccatgagggttggcaggtgtggctgcactcgctaatgcgtctgtagggtcaactgacggaggttggccctggctgggtggctctgattcaaataatgggtccagctgagtctggctcctcgttgagggttgggcctagatctgctccacgtgcgttcatgctggggctgaggctgaaagaaggtacctgggaaaactcttcttatgctgatgacagacacagaaaacaatgaacagaaaagcgtcttctgtcctgaaggcctggctcagaacaggcacagtcagccctgcccacgttccattggccagagcaagtatatgttcaaggccagggtcaagaggtaaactacacctcagcctgtaaaatcacagagcaagggatgtggatgcaggcaggggtaaagaatttgtgccgattaccagtccacaaacatgsgttagtgtttgttctctaggcatccctgtcgggcccattgctcattcctggggttggtctttttttttttttctttctaagatggagtctcactcccttgcccaggctgttggagtgcagtggccctatctcagctcactgcaacctccgcctcctgggttcaagcgattcccctgcttcagcctcctgagtagctaggattacaggcgtgtgccaccactcctggctaatttttttttatgttagtagagacggggtttcaccatgttggccaggctgatctcaaactcctgaccttgtgatcctcccgcctcggcctcccaaactgctgagattacaggggtgaggcactgcgcccrgccwtttttttttttttttttgagatggagtctcactctgtcacccaggctggagtgcagtggcataatcttggctcactgcaacctccacctcctgggttcaggcgattctctgcctcagcctctcatatagctgggattacaggcacacgccaccacgcctggctaatttttgtatttttagtagagacggggtttcttcatgttggcctggctgatcttgaactcctgacctccggtgatctgcccagctcggcctcccaaagttctgggattacaggtgtaagccactgcgcctggcccctggaattggtcttatagcaagtttatcccaacaaaaacagctactatttactccccaacccccatacacacgcacacacattgatgataaataagttgcaggcttgcagaaattgacccatccaggtgaacagcctagtgatccsagcaagcgtcctgctgtgcagctataaaaacatgactcctccagcagctccaggcagccactaccagttaattacagatggcctaggaggccaaacctggttactatctctggtttattatgtgccagacacttatgctgtatattttgtttaatcctctcaacaaacctgcaaaagtggcattagtaacccctttaaaggcaaacggtcagaagcccagagaggttaagtaacctgaggtcacacaggcagaaagcagcaagaccggggttcacacccctgtctgttccggtccatgtgtggtctcactcactctgctgcctccttgcccctcacccaccaggccaggatcaagtcactgtagcgatgactccacgctccraaggctccagtgtgaatctgtcacctccattggagcagtgtgtccctgatcgggggcagcagtaccaggggcgcctggcggtgaccacacatgggctcccctgcctggcctgggccagcgcacaggccaaggccctgagcaagcaccaggacttcaactcagctgtgcagctggtggagaacttctgccgcaacccagacggggatgaggagggygtgtggtgctatgtggccgggaagcctggcgactttgggtactgcgacctcaactattgtggtgagctgcctgggtagggggcctgagttgcagggacaaatcctggtgggaataacaacagccgcttctgcttatcgaacgcttacctcattgagtgcgctcattacagccttacagtaaccaggtggggggtaaggtcctgtgcccatttcacagataagtacactgaggccccaggaggttattgcctagtagcccaactgtgcatgcacgcttaacctctgcaccaaatggcctccaaggcccgtaggggaaytggggggatctaggggatgggtgaggaatggcccagcccagtcccagccggtgcctgggtcccaacagaggaggccgtggaggaggagacaggagatgggctggatgaggactcagacagggccatcgaagggyrtaccgccaccagtgagtaccagactttcttcaatccgaggacctttggctcgggagaggcaggtgaggtagtgggcatcygaggggatgcggggctgcggggctggtggccaggacttgcccctcactgcttggcttgctctgcagactgtgggctgcgacctctgttcgagaagaagtcgctggaggacaaaaccraaagagagctcctggaatcctacatcgacrggcrcattgtggagggctcggatgcagagatcrgcatgtcaccttggtgtgtcctggagccctgcgctaccattcactcctgggggcaggtgtgctgctggacccccaccctcaggccctgcctgcaggcctgggctttacagatgacaacagctgagcatccaggatcccaccaactccacacagcagccacatgagatgggttgtttacttctttttttttgtttcttagatggagtcttgctctgtcacctaggctggagtgcagtgctgcaatctcggctcactacctcgatctcagctcactgcaacttctgccttccgggttcaaacgattctcttgcctcagcctcctgagtagctgaatttacagacatgcgccaccacacccggctaatttttgtattttaagtagagacagggtttcaccatgttggccaggctggtcttgaactcctgacctcaagtgatccacctgcctcagcctcccaaagtgccgggattacaggcatgagccaccacacccggcccatgggtcctttacttctaagcagatggtaaagctgagactgacggagctggtggctcacctccgcgcacagctaatgggtttgaatccagttcttctgattccagagctgtgctacgctatgtgaactctggactggaaggacctagttagggggtgcaaaaagcaggaggcaggtcaggtgcagtggctcacccctgtaatcccagcactttgggaggccaagacaggaagatcacttgagggcaggagttcgaggccagcctgggcaaaatggtaaaaccccgtctctactaaaaatgcaaaaattagccaggtgtagcagcatgtccctgtagtcccagctactaaggaggctgaggcgggaggatcgcctgagcccaggaggctgaggcttcagtaagctgtgactgtaccattgcactccagcctgggtgacaagagtgagaccctgtctcaaaaataaataaataaataaataaaaaagtgtgaggcagcccctcagcatcacacggaggctccaggccccaaaggcggccagcccaagcttggatctgggccccggaggcagctctgcccagctgggttcttagacctgggattgttacttctagggctggtgtagaggcagccccctcatcctcagctcctaatgcttcctgctgcccctcccaggcaggtgaygcttttcyggaagagtmcccaggagctgctgtgtggggccagcctcatcmgtgaccgctgkgtcctcaccgccgcccactgcctcctgtacccrccctgggacaagaacttcaccgagaatgaccttctggtgcgcattggcaagcactcccrcaccaggtacagaactggtggcccgtgggtgtctggcaggggtctgagtcctccaaagcgatcatgaggggccctggtggctccgggacacataggatgttctgtataccccccagratataacatcccagcagtctctgctggaaagcccatttggtcacgtcctgactgaggcttggagctgcggggagaaatccgtctgtctcctggtccctccaacactaggatatagcccatgtgggagtctctgaaaatagagtctgtctggactagggcgtgcagcctgtgcccctgtccccgtcctccaggctgtctgactccaaagccctgcacggctttaggcccaggaagaaacasccagggggctgccatggcaggaaccagccctatcccctccctggtggcctgcaggacacactgtctcccagaccccaagggcaggcagtttcctgctccttgctgggtgaacctgcagcttctccatttctttcttggggtctctgcaggtacgagcgaaacattgaaaagatatccatgttggaaaagatctacatccaccccaggtacaactggcgggagaacctggacygggacattgccctgatgaagctgaagaagcctgttgccttcagtgactacattcaccctgtgtgtctgcccgacagggagacggcagccaggtgggccaccagatgcttgttagctgaggggcagaagccaagttctgggcctggctctgataccaagtagccttgcaagagcccctttcccttttccaggcctcggtttcttggagtgaacccaaaagttcttttcagtactggcgttttattttttatttatatttatttatttactgacggagttccactcttgtctcccaggctggagtgtagttgtgcgatcttggctcactgcaaccccacctccygggttcaagcgactctcctgcctcagtctcctgagtagctgggattacaggctaatttttgtatttttagtagagactggtgggtttcaccgtgtcggccaggttggtctcgaacccctgacctcaagtgattcacccgcctcggcctcccaaagtgccgagaccacaggcgtgaacgtcygtgcccagccagctctggcgttttagattctggtctctaagaaatggcgttggggccaggcggctcctgtgggggttggctctcactaggcccttcttccttccccaaagcttgctccaggctggatacaaggggcgggtgacaggctggggcaacctgaaggmgacgtggacagccaacgttggtaaggggcagcccagtgtcctgcaggtggtgaacctgcccattgtggagcggccrgtctgcaaggactccacccggatccgcatcactgacaacatgttctgtgctggcaagtctgtgcagggcgggctgagggaacagtggggcccaagctgggagaactgagttgtgcctgggttcargccatgtgactttgagcaagttgcctaacctcttggtggctcagtttcttcctctgtaaaatggaggtaaaagtctctatcccataaggttatgggagggttaaatgaagtagtatatattaatgtacttggcatagtatcagtcaccagtgagctcagatagcagcaagaggctgcgggtagggaaatgccattcattcagtcactcagcaaatayttattgagcgcctatcacgttccaggcagcgttctagggtatacagcagggacccagacggacaatgtctgtgccctcagagagcttccttcctaggagggcacatccataaacagatctaaaacagcaatccctgaccagtgctgtgaagaaaaatgaagcacarggagagagaacggctgatgaagtgggcttctaaatagggtggccagacaaggtgggcagatcacttgaggtcaggagttcaagaccagcctggccaacatggtgaaaccccgtctctactaaaaatacaaaaattagctggtcatggtgacgcatgcctgtagtcgcagctactcaggaggctgaggcaggagaattgcttgagccagggaggcggaggttgcagtgagctgagatcgggcatcattgcactccagctgggcaacacagcaagactccattgatcgatcgatcaatcaatcaatcaggtggccagagaaggttggagaaggcctccctgagaaggtgatgtctgggcagggactggaagaggggaaggaaggagtgagcaggcatatctaggggaggagcaccgcaggctgggggcatggcaggcactaaggccctgaggtgggagcactcttggcttgtctggggagcagtagggaggcctggggggctgaggaggggcagcagtgggtgaggggagagaggggggcaggcagaggacagccacttcctttagggcctggaaggactttattgagtgagatgggaagttattgaggggcttgaggcaggttaagaaatgatgtgactgactttaaaagtaaaaaataaaaaaatttagtgtaatttcagactcacagaaaagttgtaaaaataatacaaagatttcctgtatactgtcatccagattgtcctccattctgtggatgtgtgggaatttttatatatatatatgcatagtttgagagcaaatcatgaatatggtttctttttacccataaatacttgagtatttccaaaaaaaaaaaaaatacccaaggatgttctcttatgcaaccacaatacaaatattaaaacccggaaatttttttttgacatagcttcgctgtcacccaggcttgagtgcagtggcacaatctcggctcactgcaacctcctgctcccaggttcaagtgattctcctgcctcagcctcctgagtagctggaatcacaggcatgtactaccatgcctagctaatttttgtatttgtagtagagacagggtttcaccatgttggccaggctggtcttgaactcctgacctcaggtgatccacctgcctcggcctcccaaagtgctgggattacaggcgtgaaccactgtactcggccaaaaccaggaaatttttttttttttttgagatggaatcttgctctgttgcccaggctagagtgcagtggcatggtctcggcttacttggaattacaggtgcctgccaccacgcccggctaactttttgtatttttagtatttttagtagtgatggggtttcaccatgttggccaggctggtcttgaactcctgacctcgggtaatccacccacctcggcttcccaaagtgctgggattacaggcgtgagccacagcacctggcccaaaaccaggaaattaatgatgatacaatattattgtctaatctatagaccttattcaaatttttgttagtcttgctaatgtcttttatagggaaaaaaaaaaaaaaaagcgtgtttctcacccaggattcaatgaaggatctttctttgtcttctatgaccttgacatgtctgatgagtgcagtctggttattttgtacactggccctgaatccgggtttgtctaaggtttcctcacggtcaggttcgggctcagtggtgccatgtccttcttggtgcatcctgttaactggcacatgagaacaatttgtctcatatgtggtgagtctaactctgacctcttgaggaaggcaatgtctgccaagtttcttgctgtaacttctgtttttccctttgtaattaataagaatctggtaaagagacactttgatgtttttttttttttttttttttgtgatggagtctccctctatcacccgggctggagtgtgtggtgcgatctcggctcactgcaacctccatcccccaggttcaagtgattctcctgcctcagcctcccaagtagcagggattacaggcatgtgccaccacacccagctaatttttgtatttttagtagagatggggtttcaccatgttggccaggatggtctcgaactcctgaccttgtgatccgtctgcctcagcctcccaaagtgctgggattacaggtgtgagccaatacgcctggcctactttgatattttgtattctgtttgcatcaaaaccttctcccaactagggtgactaccaaatggcacttatctaattctgtcattccttctacatttgttagttactttattgctttccttcctttcattctatcagtgtggacttaaggatccttactttattctaagggttcacctttttttttctttttttttgagatggagtttcgcccatgttgcccaggctggatggagtgcaatggcgtgatctcggctcactgcaacgtcctcctcccaggttcaagcaattctcctgcctcagcctcctgagtagctgggattacaggcatgtgccaccacgcctggctaattttttgtatttttagtagagacagggtttcaccatgttggccaggctggtctcgaactcctgacctcaggtgatccgcccgcctcagccttccaaggttctgggattataggcgtgagctctaccgtgccaggccatactttgttactactgttattttttctgatgctcagatgatcccaagtttggcctgtggaagtcccttcaagctggcttctgtgacttggggagatgttctgtcattctttgagtactttctttctttctggcacagcaaaatgattcaggttaatcctactttccttactgtagtgttggaaccagccatttctccagggaacccttgtagtcaagagtggaatttagaactgagatctgggtgctggcgtgtgcacattgctagtgggatgtcattacttctaggctctcttagtggacagaaccagaaaaaaattatatgatgcatataccaatatctctatcatctatataaaaaaccatgagttcctactgaaacctccaattccattctaacaccacaggattaattttagcttttccttttccatatttgtaactctctctgttgacagtgagaaacctgaccctcattatctgtaatgcatttgcctatttgaacaatactagaatatagtttcaaaatcctccatccataacactattaaaaccaatcctatggctgggctcagcccactgcaacctctgcctcctggactcaagccagcctcccactttagcctcccgagtagccagggctacaggcacacaccaccatgcccagctaatttttgtattttttgtagagactgggtctcactgtgttgcccagacaggtcttgaactctgagctcaagtgatccatccaactcagcctcccaaagtgctaggattacaggtgtgagccaccatgcctggcctctcctagtaaatttttagaagtggtgttgttaggtcaaaaggcaaacatgtatgtcattttttagagatttttaaatttctttccataagggttgtaccagtttgcatttccatcacagtgtatgagaatgcctgtttccccacaaccttgccaaaagaatgtcacagttttaaatttttaccaatctgagaggtgagaaatagtatcttgaaattgttttaacggacatctttcaaattgaaaatgaggttgaacatcgtatcatatgattaaggaccttttttttttttttttttttttttgagatggagtctccctctgtcacctaggctggagtgcaatggcacgattttggctcactgcaacttccgccttctgggttcaagcgattctcctgcttcagcctcccaagcagctgggactccaggcgcgagtcaccatgcccgctaatttttgtatttttagtagagacagggttttaccagattggccaggctggtctcgaactccttaccttgtgatcctcccgcctcggcctcccaaagtgctgagattacaggcatgagccaccacgcctggcctaaggaccatttttatataattttttttttgagacagagtcttgctttgtcacccaggctggagtgcaatggtgcaatcttggctcactgcagcctccacttccctggttcaagtgattctcctgcctcagcctcccgagtagctggttccacaggtgcgtgcctggctagtatttgtattatataatttttttgtgaattgtctcttcatggttttttgcccattttttggtccctttcttatcaatttttgtgagttcttcgtatttatattaggcctttatttgtgatatacattgcaaatgttttctcctagtttgtcagtttttttaacctcatgtataatttttctggccatgcagtttaaaaaattactaggtagtcaaatttatcaatcatttattttattaaatctggattttgaatcagagataaacttttcctggccaggtgtggtgtcttacacctgtaatcccagcactctgagaggctgaggtgggggatcacctgaggtcagaagttcaagaccagcctggccaacatggtgaaaccctgtctctactaaaaatacaaaaattagctgggcgtggtggctgatgcctgtagtcccagctactcaggagactgaggctggagaattgcttgaacctgggaggcggaggttgcagtgagcagagatcgtgccgctgcactccagcctgggtgacagagcaagactctgtctcaaaaacaaaacgacaaaaaacaacaacagaaaagcctttcctgatagctaggtcattgaggaattcactcatgttttcttctagtacctgatttcatttttctgcacttagattcctgactcatatggagtttatttttgtatctgatgtgaggcatagatctaatttattattttccaaatggctaactagctgtctctaaaccctttattaaaaattattggccaagtgcggtagctcacacctgtaatcccagcagtttggaaggctgaggcaggattgcttgaggccaggaattcaaaaccagcccagacaacatagcaagaccctgtctctacaagaaaatattggtcaggtgtggtggctcacgcctataatcccagcactttgggaggctgaggcaggtggatcatgaggtcaggagatagagaccatcctggccaacatggtgaaaccctcgtctctactaaaatacaaaaaattagctgggtgtggtggcgcatgcctgtagtaccagctactcaggaggctgaggcaggggaatcatttgaacccaggaggtggaggttgcagtgagctgagatcacgccattgaactccagcctggcgacagagcaagactccatctcaaaaaaaaaaggaaaaagaaaatattttaaaaattagctgggcatggtggcatgtgccttgtagtctcagctacttgagaggctgagttaggaggattgcttgagcctaggagttcaatactgcagtgagctatgaccgcaccattgcactccagcctgggcaacagagtgagaccctgtttctattaaaaaaaaaaaatcggctgggcgcggtggctcacgcctgtaatcctagcactttgggaggccgaggcgagcggatcacctgaggtcaggagttcaagaccagcctgaccaacatggaaaaaccctgtctctgctaaaaatacaaaattagccagacatggaggcacatgtctgtaatcccagctactcgggaggctgaggcaggagaatcgcttgaacctgggagacggaggttgcagtgagctgagatccctccattgcactccagcctgggcaacaagagtaaaaactccgtttcgccaggtgcggtgactcacacctgtaatcccagcactttgggaggccgaggtgggtgaatcacaaggtcaggagtttgagacaagcctggccgacatggtgaaaccccatctctactaaaatacaaaaaattagcctggcatggtggtgtgcgcctgtaatcccagctacttgggaggctgaggcaggggaatcacttgaacctgggaggaggaggttgcagtgagccgagatggtgccactgcactccagcctggcaacagagcgagactctatctcaaaatcaatcaatcaatcaatcaatctttgaactagtgatttgagatttcacctttatcacattctagattgtatcttattttcatttatttatttgaaatatagacaagtctccctgtgctgcccaggctgatttcaaactcctggctgggctcgagcaagtctcccgccttggcctcccaaactgctgggattacagacgtgagccaccatacctgacctaggttttattttttagttttattttttcctgcatccagctaatttgatttgatttgtagagacggggtcttgctatgttacctaggctggtctcgaactcctgggctcaagtgatcctcctgccttggcctcccaaagtgttgggattaccagcatgagccacggtgcccagccccacgttctagatttctatggatagagtatgcttaaggatgagtatgtttctggatgttcgactcggctttcctggtctgttgtctgtctgtgtacagcgtcacattgttttaatgatagaggctttagcgtacatagctgggaaggctaatgttctcttttagtttttctttccagtggtttcctggcaattcttgcatgtttgtttttccatatgaactttagtgtcaacatgcctaggtctataaaaaagcttggtggtaattttattgggattatgacacttcaacaaattaactgggagaatggacatatttttgatgttgagtcattttatccaaggataagaaacgttttcctatttgctcaagtctattattgtatctttcttgactgctgcaatgtattctcttataattttttctattggtatcttattttatgtatttgtaatatcttatttttcttgagtaaattagttaatggcttgccggttttctcaaaacaaatatctagggatttgatttatgaaattattaggcctattatttttcttttttttgagatggagtctcactctgtcgcccaggctggagtgcagtggcgtgatctcagctcactgcaacctccacctcctgggttcaagtgattctcctgcctcagcctccccagtagctggggttacaggtgcacgccaccatgcccggctaatttttttatatttttagtagagacggggtttcaccatgttagccaggctggtctcgaactcctgacctcatgatccgactgcctcagcctcccaaagtgctgggattacaggtgtgagccaccgtgcctggccttttttttttttttttgagacagagtcttgctctgtcacccaggctggagtgcagtggtgcgatctcggctcactgaaagctccacctcccgggttcacgccatcctcctgcctcagcctcccgagtagctgggactacaggtgtacactgccacgcccagctaattttttgtatttagtagagacagggtttcaccgcgttcgccaggatggtctcgatctcctgaccttgtgatccgcctgcctcagcctcccaaagtgctggtattacgggcgtgagccactgcgcccggccaggcctattatttttctattgtggttcattaatttctgcttttttctcttaaaaagtttgcttacgtttttgtctggtttactttgctgttctcttgctagcttttttttttttcagatagggtcttgctctgttgcccaggctggagtgcagtggcacagtcatagctcactgcagccttgaactcctgggctcaagcaatcctcttcttgcttcagcctcccacgtagctaggatcagaggtacatgccaccatgtccggctaatttttttttttcgagacagagtcttgttctgtcgctcaggcggtagtgcagtggtgcaatcccggctcactgcaacctccacctccacctcccaggttcaagcaattctacctcagtctcctgagtagctgggattataggcgcacaccaacatgtctggctaatttttgtatttttagtagagacagggtttcaccacgttggccaggctggtcttaaactcctgacttcatgatccgcccgccttggcctcccaaagtgctgagattacaggtgtgagccacagcacctagtgaaagtgtggtttttttgtgtaggttttactgttgttagtgttgttctgtattgtttgtagaggatacgtggggagatttggataaaagcaactatcattattatcctcatcagacttgtaggtctaactttttaattttttaatttttaatttaaatttttttcttggtcttttatcattaattaattttttcgagacagggtctcactctgttgcccaggctggagtgtggtgacatgatcacggctcactgcagccttaacctcccaggtgcaagtgatcctcctctcttagcctcccgagtagctgggactccaggcatgtgccaccatgcccagctaattttttgtagagagagggttttgccatattgcccaggctggtcttgaactgctgagctcaagtgatccacccggcttgggcatgagccacctcccctggtctggtccaactttttaaaagcattattctgcctgttgggtggagaatagactgtaggtgggcaaagaatgaaggaaactagtgggttcaggagctcgagctagaagtggtgagaagggtttggatttggggtctatgctgaaggtagagccgacaagatttgctaggattggatgtgtagggtgaggaagtggggacagcaagaatgactggaggggtaagtggactctcaccagctgtgtctcgtgaaggggcgtggctgggctatgagctatgctcctgagcacagacggctgttctctttcaaggttacaagcctgatgaagggaaacgaggggatgcctgtgaaggtgacagtgggggaccctttgtcatgaaggtaagcttctctaaagcccagggcctggtgaacacatcttctgggggtggggagaaactctagtatctagaaacagttgcctggcagrggaatactgatgtgaccttgaacttgactctattggaaacctcatctttcttcttcagagcccctttaacaacygctggtatcaaatgggcatcgtctcatgggstgaaggctgtgaccgggatgggamatatgkcttctacacacrtgtgttccgcctgaagaagtrgatacagaaggtcattgatcagtttggagagtagggggccactcatattctgggctcctggaaccaatcccgtgaaagaattatttttgtgtttctaaaactatggttcccaataaaagtgactctcagcragcctcaatgctcccagtgctattcatgggcagctctctgggctcaggaagagccagtaatactactggataaagaagacttaagaatccaccacctggtgcacgctggtagtccgagcactcgggaggctgaggtgggaggatcgcttgagcccaggaggtggaggctgcagtgagccactgcaccccagcctgggtgacagagtgagaccctgtcccaaaagaatccactatctatcttcagagcagggccaggtgagaggaaagatggcaggttgaatttacaggcattaaagatgttccaccctctgggttttaatggattatctcatttaatcctcacaagaggtaggtgagtaaactgagatttggagaagtaccttgtccaaagtcacatggctaagaaagctcaaagtaggacttcaaatatagaaaatattgagtgaggacggtgcttttttagttaactccctacatcttcccttgtatcattaaaatgatatcagatcaggtagggcatggtggctcacacctgtaatctcagcaatttaggagactaaggttgaggctaggaatgcgagatcagtctgggcaatgtggtgagaccccaaaaaataaaattagctaggcgtggtggcatgtgcctgtagtcaaggttacttgggaggatcacttgagcccaggaggttgaggctgcagtgagccatgatcatgtcactacacctgcactgcagcctgggtgacagtgaaaccctgtttataaaaatcagggctgggcacggtggctcaagcctgtaatcccagcactttgggaggctgaggtggatggatcacaaggtcaggagattgagaccatcctggtgaacacggtgaaaccctgtctctaccaaaaatacaaaaaattagccaggcgtggtggtggacgcctgtagtcccagctacgtgggaggctgaggcaggagaatggcatgaacctgggaggtggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatggtgcgatctcggctcactgcaatctccgcctcttaggttcaagtgattctcctgcctcagcctcccgagtagctgggattacaggtgcccgccaccacgcctggctagtttttgtatttttagtagagatggggtttcaacgtgttggtcaggctggtctcaaactcctgacctcaggttatccacccatcggggcctcccaaagtgttgggattacagacatgagccaccctgcccggccttcccatatacttcaaatcatctctagatgacttacacccaatagaacgtaaatactatgtaaatagttatactgtattattttaaaatttgtattatttttattgttttctttccccacaaatattttcaatctgcagttggttgaatctgcagatgcaaaacccacagatctggaaggccacctgtatattaaaaggtgtatataacgacattacttacctcatacggttatgaggattaaatgaaagaacttacatggtgccttagcacaatgcctagtgcctagtaagctgtgaatcactaccactcgtattctcactattgcctgggaactggaccgggcattgggcctgttgaaagttcctctgccgcttacctcgtccctctcttgggccctggaaatagcccatcagtggggtagttgcttcctggaatgtttcctcacacagcagttcccagctggaacaatttatttttccaagaaatgggacctctaagttataagagtcatgggctgggcatggtggctcacgcctgtaatcccatcactttgggaggctgaggctggtggatcacctgaggtcaggagttggagaccagcctggccaacatggtaaaatcccgtctctactaaaaatacaaaaactagccgggtgtggtggtgggcacctgtaatcccagcttctcagctgcttgggaggctgaggcaggagaattggctgaactcaggaggcagaggttgtagtgaggagagaggcatgccactgcatgccatccagcctgagcgacacagcaagagtcccttgcaaaaaaaagaatcatagaacttcaaagataccctttcagagcacattcttcacggttactgttggcagaggtcacaggtgtgggatggagcatggctccgtcttgagaagtctcatccatgagctcagggaaagaatgaagatcaacgtctgcctcaggcacaggatagtggagtggagcagggaaaccctgtggctacagtacctggcctaggatcttctaacgtggttttccacgggaagggacctgagatagggatctttagcaccctcctcataacgtttttttttttttctcatttttcaacacatcagaaaacaaacaggacagagttccttggcctcattctttggttctggttgactgaaaggcagtgagcttgcaggatttggcagcccagggcatcaactcgatcaagggggaagggattcagaattacttgtgacatgcaggacctgctttttaaacaagaacacacattctcataagtctgttttcttccgacatagcggtcagtgttgtaagctctagggacttgggtttttccagtcagctgtgctaattccagacaggagtacagccactcttttttttcctcttcttttgtttccctcctcttttttgagacaaggtcttgctctgttgcccaggctgtagtggagtgatcatggctcactgcagccttgacctcctgggctcaggtgatcctcccacctcagcctcccaagtagctgggactacaggcttgagccactatacccagctaatttttgtatttttttggtagagccatgttgcccatgttggtcttgaactcctgggctcaagtgattcacccaccttagcctcccaaaatgctacggttgtatgagtgagccaccaggcccagcctttgtagccattctttctaaatatgtctttccactatagcagcaaacgcctccatcatcccttcagtgaacaaatacccactcccatgttcccactataaaggagagacaagtttaatttcaggaggctccggggccacctgaaaacgatgactggaacctttacaggattaatcttccatcaatctttcatttcttggacatcaattgaattgaaggtgggctacaataggaaagttcctttgaactttataactgcccaaaatctcctcctgaatccagaaccttttcatcctgaagagtttttctgactgtggagggaggtcctgtggaatttattccagaggtgaatactcagctcactttctcatccttactctgactgaatgtgaagcaactgttagcctggaccaaaagagactcatacaaccaagcagcaaaccactaagatttcccaaactccattagtcaaatgaacacaaatctagttgtagtgtgagaaccactgaagcccagccaatctctgggcgcaatcttgtgtgcctttggtcagcaaagtggtaggatgcccaagagcttcttgaaacgactggtgataattggagggaaatcatgaccaaaatctcaaaacaaggaaggatgagatttttctgctccctaggagctgtttgtggagagcagggaaggagagttccttccattccaaaggaataaaagacagctccaagtctgtgagccaagaaaaagggaagctctgtaagcagtaattaacctttctctaactggctgaatacccagctggtaccaaaagttaaaaaattgctgcccaacactccatgatatggagcatcttgggagtcaggtatagttaatgcaaactttatttataaaagactcttaaattagttgtatcatgccatgcattcatacagaatacagtgacccttcagggcgacagagaagagctcacaaactgaaaggaaaactattaaagagtttctaatattaactattaaaaagctaggaaagattaggacaattttacaaatgagcaattaaaaagaaaaggatctgggaactagactgagcagagagggggcagctgtttacaagtctgtacactaaactcatccacggacagtcttctagagcagcaggacgctgacagagagaagcagagtatgtacaaatacttgtgccacaatgactcctccccctagctccacggcatgatacatacaaccagtttgtatacactaggcctgctgaggccattttaaactatgaggacttctagtttagtaaactaaagctgcagggtgccgggggagtggggcagcttcatttgcgactgctctttattctctccagtctttttttcaagtcgtctatgttagctgtggmggaggaggaggtcacagttcctgaagagtgagtctggttagaatccaggtctgaatgctggtgctgctcccgtgactcccggagctgagagagtttgctgtggagcatgtctgtggaagaggcgacagtaggaactgctggtttggagagcaaagaggtcaaaggaggtcggtcatcttgctattgagagaaggagagagattgtctaaggtcaggtcaagcaggtcaagatgcagctccagaactacagcaagactaagccacttctctgtgggccagcctgcctcggacctgcttgtgactaccctccctgaactgcacagaagaaaaggagcagtacctttgtgttgtccagaccacatcgctgtcggaggatctttagcctttccaagtagacagatggccccacttcttccccatttgtgttacctatggaggacactgtgcttgtgggcgtgggcacacatgtgacttccatctgaggggagatgcctagaggggaaaaagtagaaagaatattcagatatccacatatcccccttctaaagtgccttggttaatctcccaccaaaaagaacaattaagaatttcctatacttgaaaacgacaaattccacaagaatctacctggagttggtgataagggtgctctgaaatatacaatataagcttcttgagaatgcaaaaaactgatatagaaaggcagaatgtaaattgggtcatccatctgcatcctgggttatgcaggggattgtactccagtaatcccagggctgacttgggcaatccaaaaagctgaagctactcctaagcatactgtaattgcccaactgaaaaacccgaggaccttaaatgtttggaagaattagattaagtttggaccaatgtcacataggagaaactcatttgaacctgtgaaggaagcaaggtgtccaaggctatggtgtattcatggggaagagaaggtgtccaacaattatctaaagagggcatagaactggagtgtctgtaaccctaccactaagatcaatattctggcaggagagaggaaaaccaaaacaacaaaaaatccatcacacttcctaaatttctgagaatgaacaatgatacaatgcgggcctttaaaatatttcacttggtatcaatgcaaatgcattccacaggccccaaaggtaaggtactgggaggaaacactgccttatggtaaatagaaaagtagaaaggttactccagggaaaaaggactcctttaatgtaaagatgaggagaatcctctgagggggtgaaaaatgaatgaagaattatgtaaaagccagcaatatgagatgtctgaatactctaaggcacaaaatcaatttaataatcagtgggaatacatgcttgggttgcaaatgtgctgtttaggccaaaattatcacacgt

SEQ ID NO: 12248 - DNA, 13971 bp, Homo sapiens
tgaagattgaaacattttaaatttctccattagcttccatgtctatagccttagcagaaaccgtgacaaccaagaagcagtgacattccctgagatttttgcctcattgagcaaatgcagaacaataccacccaaaagagcatgggtcccaactcaaacatatttttagtgcttggtccagaacttttacctgggtgtggcaaagttgagctaagcttttttctttttttattttcttttcttttttccttttttttttttttttgagacagagtctcgctctttcgcccaggctggagtgcagtggggcgatctccgctcactgcaagctccgcctcctgggttcacgccattctcctgcctcagcctcccgagtggctgggactacaggcgcgtgccaccacgcccggctaattttttgtattttttagtagagacggggtttcaccatgttagccaggatggtcttgatctcttgacctcgtgatccacccacctcggcctcccaaagtgctgggattacaggcgtgagccaccacgcccggcgagctaagcttttaaattaaggcttgggtttgcagaggccagggctgaaaccaccttgagacccctcttctccttcttcccttccccaggattgtcaaaacaagtactactgtgaaagaagcttccaataagagataagttctcagtaaaatatcaccaagcaaatgaagattgacaccatgaaaaagagactcaacaaataaaagaattgttttatctactataagaaattgaaattcgaaacaatatggcaagaacttaaacgtaaaagactcaaacaacaaagaaggaaatagcaattttgaaacaagaacaaatagttgtgaaaacttgccaaatgaaagttttcaaaagaaaattgtaatttctcaaagaaaaaaatgcagtacgttatgtgaatctcaggttggggcctaccatatatatcagaacagcaagaataaatttaagaatctaaaagagagtaaagaagtttacggataaaagaatgagaagtagactgacattgtacttttcatcaacgtgttgaatgcctaaagaatggaaggaaaataagcttaaaattttgaatctatgataaagaaaactattgattaaccatatgcatatttgacattaaaataattcataattaggactaacagatttctggcttaaaaaatctaacaattactttaagaagcaaaagacatttccagaataaagtagggggatatatagaaaagttggtaccttttttaaacagagtcttcttttgtaaggaagtagaatttattcatcaaaggagatttatgaaaagtatggtggtatagtgagtggcctcactagttttaatgattgatatttgaatatagcttagtcttataacaactccccaaataaaaatttaaaattcatttgtatccctttgattttcagtgctaaaaactagattgtgaatgtcaaggaaatatttaagttatttctgaactaatgtatttgtagagagaagaaaggagtgtgcacgtgatcgagaattatgttttgaaaataaatgaatgattggctattaaaaaaatttttaagcctttgggatcttgcaaattttatttaatcttgatatcattaagactaacccaagttcaacagaagtaccaattagaggccagagaatttaaataccaatttcagaaagttaatttgatgtacaaaaaagtcttatatttaatttcttctttgtccctgaaatcaaagatataaataagctcaatttggaaccaacttggagattaatacataattttacagttctccaagtttccacaagtctcaagatgcaaagggagacattaaataaaaaattgcctctatagggaattattcttcatactccacccctttctgaatacagatagttcttttaaaattcaatgtgtagatcaggtccaaataaacaagtttgtaagtccttacagcattattttatttcccaaataatttaaaatttatttatttaacaaatataaactgagtgtctactatgaatgaggcattgtgctatttgctggaaataccactgtgaataaaccagaaacagactctaccttcaagttgtttagagtctagtaaggtcattttatatattctagaatgagggaagggagtaaaatttttccttctcttactttttgataattggaatactggtgagatcgatttgtaaatattttacaataatgaattagcctgcctagaagaaaaattactagaaaattattaataacccttttaccttgtgccaggcatttagttcgtggaattccaaaacgtggcaacactagttagtactgtacatgtggtactctctctgttctgtatttaatgaaatatccagatgaatatgtttttggaagttgtcttcaaataaaagggtaaaaggtttctaactgccctgaaagagaagcagctttgaaccaagagtaagatgtgattgtttcccaccttcaaatttagtatagattatcttttctggctttgctaaattctattcattttctcaacaatgtataagtccagtacatctaaaaactaaattacaaatggtatctgttcttctatcttcagtgtctaaatgactcagcatattgccttttgaactttagtctccgatcatataccatattagtccccaaaagaactgccctctatattttccacagttgagtacttccctggctctgataccacctgggactaaggtaatcaaagagagagaaatcttgatcagaattctatgccttttcctgatattcatggaaaatcagctacgtatgcaaagaagaaaaatatctgaccaaaacagccagattcaaacatctctataaagtacttaaagtgaaaggaaatattatattaattttcctctgactattaaagattcacatatttggctgggcatggtggttcatacctgttaatcctagcactttgggaagtggaggcaggaggatcccttgagcacaggagttccagaccagcctgggcaacatggggaaaccccatttctacaaataaattttttttgttgttaaatagctgggtgtggtggcacacacctatggtcccagctactctggaggctgaggtggtcagatcccttgagcccaggagattgagactgcagtgagccatgattgtaccactgcactccagcctgggcaacagagcaaggccctgtctcaaaaattttttttaaaaagtatttatgaatttgatgctgttacataaaattacaccatttaaatgtgataataactacactttaacatatgtttgaaagcatgtcaatcttaaactcttgctttttggggaatttttaaaatctttgagaaattctcttttctctagtcatgagtatttaattgctagaaagttatatggatgttctgtgggtgaagaaatgcttgtaagaagaaaattaattttttcctaatacacttccctaattaggagctaaatattttgtcgcttaaaataagtttttttattttactcaagataaccataagattccatgttttggttgcttccagattttattcttagttgtagctaatttagagtttcacaacgatattgccctctcctttttagaactttctattcttgtacatcttcttttaattacattgcaggaggtaggatgctgataaggatggacagtttctatcccagaaagaccatatataatcctaaatcatgtcaggttaaaatctgaaggagggaaccaagacaggaaaaaaagaaaatatctttctcctatatcatcatacaagtggcaagtaggtattaataataaaataggactgggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggtgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaataggactggataggacaccacttttaccttgaagcatttagatatcatatacccatgtattttcttgaaattaaaaattgtctctcagattcataacacttacatctcagaatttatgaaacaaatagttgttccaccagatgtcttactaaacaacgtttttgtgtcaaatggaaaagaacagtcagttttttaaatggcataggtttaatttttttcctcagtcatcatgaacacactttagataaaccaaagggtaattacccatattagtctatatttgtgtccatattttggccaatataagcacataaaatattgaaatattaattgcaaatgtcaacacagaaaatgaactaaattactttcatttgagtactatatccctaaaaagatgatatattactatttattaaagaaaacacattcttgtctatccttaaaactttgttaactatagacaaagctgctttgggcatattatagaacacattatatgaatatattcaacaagggaaattataaaattggtggtttggaactctctctacattgctttataatgtaaaatttgaatggagttattttaataagctatttgaaatcactattaaaagacagtgaatttctttttgctccccattagaaaaaaaaaaggcggaattaagactgcgttggcaagccaggatgaaaggagaatatgcaaggattaactacagaaaaagtagaatcaatatataaacaaaatgttctatcgactaaggattctcgattgaaatacaaaacattcagagccacacaactactttccagtactgttaatgaaacctaagccatccctggatttgatattttgctctattcttgctacttgccttgaaccagaccaaaaaagacctctccaatggacaaagcagtaaaaaaggactttccacagattaactaagacgaggctcagtagatccttattaacacttaactgaattcaaagctcttcctgaaactgggatttgcctcgctaaccctctctgcaccctgagcaacgaagttggggataattggcttcaggaacttgaactcatttgtcccggagcctccagtcagacacacctcgtattggtagctctgggacagggtcccggtgccgctcacgtccaccatctgccctggaaaggggccctcgggcaccgagcagcgacccaccgaggccgccctgctcctcctgcacagccgcaccgccacgaacaggagcaccgaaaagaggaagagcgaagacaccgaggccaatgccaccaccaggtagacggtgagcaagtcggcctgggcctgggccggtgccgcctccgggagaggcaggtagggctgggagaagccgtccaccaggagcacatgcagcgtggcggtggccgagcgcggaggctcgccattgtccttgaccagcaccaccagcctgtgcttggccgcgtcgcgctcgctcagcagcctggcggtgcgcacttcgccattgtgcgcccacacgccgaacagcccgggctccgtggccttgagcagctggtacgacagccaggcgttctggcccgagtcgccgtccaccgccaccaccttggtcaccaggtagcccggctcagccgcccggggcaccagctcggtgcagggcgcggagccgttctgcagcgggtacagcacgaagggcgagttgtcgttggcgtccagcaccagcacgcgcaccagcgcctcgctgctcaaagccggggagccacggtctgtggcgcccacgcggaactcgaacgcctgcagggcctcgtagtccagcgacctgagggcraacaggtggccgttgtccgygttgatggagaccagggaagagaggggcaggtgcgggtcctggggcggcagcagcgagtaggttacctgggcgttggtgcctgagtctctgtctgtggcgctgacactgccgatgtgcagggcggggctgttgttctcgcggacgaacagggtgtaggagrtttgggtgaaggcgggggcgttgtcattgacgtcggagaccagcacggttatgttgtacttggttttcagcctgggtgtccccaggtcagtgatagtgatggtaatgttgtactcggawctggtctctctgtccagcgcgccttctgacactagggtgtaaaaattctctacagatggtttcaggaagaaggggagattgttctcaatggaacacatcactcttccgttgtctccagagtctagatcagaaacactgaaaacagccagtwcagtctctcccgagttctcaggaatagggctgtttactgaagacaaggtcagttccggtgggttgtcgttgacatcaaccacctggactatgactgtagactttccggataggcctccgccatccttggcctcgatgtcgacttcataactattaatcgcttcaaaattcaaatatttgaccagttgcataycaccagtaattggatttagctgaaaagttttgcgaatttcttcagaagcatgaaaaaatgcatatgatattgtcccaaaacttcctgtatctaagtcagaagccgagacagtgacaatgacagagttaacgggggtattctctagaactgcaacctcatagagcggctgtgcaaattctggtgcattgtcgtttatatctaagacctggatgtttatctgggctgtcccagaccgagggggagagccgccgtccagcgcggtgagcgttaagctgagttycggctgctcctcccgatcgagcgctttatccagtactagttccgggtacttccttccgtccctacgactgcgagtgagtacgtggaagtgggaattcggagtgatagtgtagttttggaggctgtttcttcccacatccaagtcctcagcatttcccaaaggaattactgttcctggcagagtgctttctaggattttcagatgcatttcattttcaaagaataccggagaatggtcatttacatctatgatacggagctcgtttgtaacgaaytgcaaagggttttgcagtaatatctgaaaatgtagtatgcatggttctgtggggccgcatagctcctcccggtccaatttctcattcaggagcaaatcacctrtctgatgactgagctgaaaatgctgtttgttccctttggacacaacttgggcccccctcgcggccagttcctctacccttagtcccagatcctttgctaggttggctattaaaaagcccytctctttttcctcagccacagaatagcgtcttgactcggacccagccagagaccctcccagaaaaacaaagagaagcaasacttgcctttgtctaagaaatcgctctcctcccgcctccattgcactttccgtcacgctcttccagggaatgtcgccaagctgaacctcagacagmgctgggaaacagtcttttgccccacaacctttgtagacggcctagtgaataagcctttccagaggctcagasttgctggstcaaaaatctgcctgggctctcaaccgctggtttaccacactggatccgtgcgtcaccgagcatgcacaatgcctgtggtttaattcgccttcttagtcaacagcgccaccatgcgttcgcttgcagttacaaaatcttggagaaggtgtttttattttgctttatcgattattcttatcaaccctagttgacgctactggaggagtttctcatgttatatgaattaaataaatgcaatctagggaaataaaatgcacttttatctacgagcagcgattcttcctggtagagtcctcatttacacgatttaacggaagtgtacacatactagtttacccctccccttttgtaataattacacacaaacttcaaaagatttttgctctagatgatagcatgcttcactatcctatttatgtttttctttttttcctaaactttgtgaaatgagcccgaattgcatataccagaaaaatacaaggaaaagacacctcctgcaaggtggtaaaaaagaaaatatatcatgtcagaggtggatccagaggactacaaatacctaatttcttccagattatcatgctcaaggaacacttaaagtgctttctcttcttatttcagagcaaatttacaattattcatttcatctgtattagtttatttccacagataattgttgagtttgtagaagttaggcaagtggtggtaacaagacaatgtctgtatatcttacaacaattttccatctagtgggtgtacagtctttaaacagatgtttaaacagtgtgaaaagtgctacatagaaaaggtactgagtgcactgaaagtatgcaatacggggacctaacttaatggagagtgattaagaaagtttcccccaaggtgcaccatttaatctgaaacatgaaataggagaagtgtgccaggctaagactgtagaatgtgtgaaggccctgagagagcaaagcatagctattaatagataatgaatgaaggacagtgaatacaaaacttaatgtctcaagagtaagtggaaaggaaggctgaaaaggtaaaccaaggccaaataatgggcgcttggattttattattctaagaacaaaaggaagccattgcaaggttgttggtacagaaataaaacagtgcaaatatgtgttcaatgtagccgcttttgtacttctacacaattatcaagaatgtttgctcttaatactagtgatactaaaaataacagcaatttcacttttatgtctttatattgagtataactgcaagctattcaaatacctgctatcatttgggtagaagaaaagaaactttgtgactcatccaaaatcctacaggtaatgagttggttgatcagagacttttgataccaacacagcgctctacaccattgctaatctcaaaacaagaccttcaaagttaatattaaaattttaataggatagctcattcaaatgtatgtaaaaatgatataaaaatataaagatagactgagtaacattaagaattaagatttgttttaatgtatggatcagaaagtaaactgcaagaaatgaaaacagttgggtgagtcatttagggaactatggaaggaaatttaagtaataaaattaaaagccatctgtattccttaagccagtggacaggaaaggaggctcaatttaagcattaagagaaaaagtaaaaatatgttgaaggaaagcgacaacagaatgataactgcatgttcaaacaatggtaaccaattcaattaataacaaaattataattcattgtacaccaaagagtatttgattccagcaaaatgttttcctttaagtgttctagtttatttaaatatcaatatatcacaggtaaaatacttttctctctttcaatcattcaaaaattttattaagagcctataatattccagtgactgtgtgaatcattcaataaatgagggagctgttgagaaacagaactcaagcacctttataaaaaagcattgaaaagtctagggaaatgaaagggggaaaaatagaagtagtcagtgcaaaaaaatagagtgagtggtgctagataaatttttctccctaaaggcttgtttctaagtgaatcctaaatgctccagaaaattttaaaaacagcaataccaagctatgtttgagggttctaaaggtaaaggacaaagacatgtactccctcaaattttttggattttaatgaagtgctcaaagttaataggttattaataattttaaaagattttaaagggggggactggaataagcagagggctcttaaaaaaactatttgaaagagaaagcatgatgaattagcatgcctttgaaaattgctagacatgtattatttatctacatttttgaatattaatgattgacttttgacaaaaatttattagagcacttatgatgttagtgccttgtagaatccaacagttaaaattcttacaatctctaaagactaatacttttcatatgtcaacacttgaaagaagtatacatattggactggggggcggtggctcacgcctgtaatcccagcactttgggaggctgaggtgggcagatcacctaaggtcaggagttcaagaccaacctgaccaacatggagacaccctgtctctactaaaaatacaaaattagccgggcataatgatgcatgcctgtaatcccagctacttgggaggctgaggcaggagaatcgcttgaacccgggaggcagaggttgcggcgagccgagattgcgccattgcactccactacagcctgagcaacaagtgcaaaactccatctcaaaaaaaaaaaaaaattacatatattgaaaaacgtaaggacggtgcttgctatattattcataaatatacctatttaaagggttagccaatgtgaattcacaggatagaatttacactagcctaagaggatataaaaaacacaaatattctgggctggaaaatataactcatgtaatgataacaaatattttcaaatgtaggacttcaaaattatctaggaccatagactgtgaggtctggaaaagatgctctaacttaaagatttctgaaaatacaaaatttacttttacactttaaatgcaattaaattgcaatgaaactaaccaacaattagaatacaaagaaaatttacatttattataccgcaaaaaaactcatacatttataaataccagtaacatgcatagaattggaataagatggttactttctaataaaaggagacacctccaatgggcaaagcagtaaaaaaggactttccacaaattaaacgagactagcctcagtagatccttattaacacttaagtgaattcaaagctcttcctgaaactgggatttgcctcgctaaccctctctgcaccctgagcaacgaagttggggataattggcttcaggaacttgaactcatttgtcccggagcctccagtcagacacacctcgtactggtagctctgggacagggtcccggtgccgctcacgtccaccatctgccctggaaaggggccctcgggcaccgagcagcgacccaccgaggccgccctgctcctcctgcacagccgcaccgccacgaacaggagcaccgagaagaggaagagcgaagacaccgaggccaacgccaccaccaggtagacggtgagcaagtcggcctgggcctgggccggtgccgcctccgggagcagcaggtagggctgggagaagccgtccaccaggagcacgtgcagcgtggcggtggccgagcgcggaggctcgccattgtccttgaccagcaccaccagcctctgcttggcagcgtcgcgctccctcagcagcctggcggtgcgcacctcgccattgtgcgcccacacgccgaacagcccgggctccgtggccttgagcagctggtacgacagccaggcgttctggcccgagtcgccgtccaccgccaccaccttggtcaccaggtagcccggctcggccgcccggggcaccagctcggtgcagggcgcggagccgttctgcagcgggtacagcacgaagggcgagttgtcgttggcgtccagcaccagcacgcgcaccagcgcctcgctgctcaacgccggggagccgcggtctgcggcgcccacgcggaactcgaacgcctgcagggcctcgtagtccagcgactggagagcgaacaggtggccgttgtccgcgttgatggagaccagggaggcgaggggcaggtgcgggtcctggggcggcagcagcgagtaggtgacctgggcgttggtgcccgagtctctgtctgtggcgctgacgctgccgatgtgcagggcggggctgttgttctcgcggacgaacagggtgtaggaggtttgggtgaaggcgggggcgttgtcattgacgtcggagaccagcacggttatgttgtgctcggttttcagcctgggtgtcccgaagtcggtgacggtgatggtgatgttgtattcggatctggtctcccggtccagggccgtgcttatcaccagagtgtaaaagttctcaacagaaggtttcaagaaaaaaggaagatcatcttggatggagcacaccatccttccgttgtctccggagtcaggatctgaaacgctgaatacagcaatgagggtgtcctgcaagttttctgggatctgattgataagtgtcgacatagttagttccggaggattgtcattcaaatccatcacttggacaaataccacacaagttccagataggcccccaccatctgtcgcctgaatatttactgtgtatgtctggatggattcgaaatccagtttctgtcttaaaagcagttctcccgattttgcacttaatcgaaacgttttgcgaatgtcttcagatgcttgggaaaatgcataagatatttctccattagttccaatgtctaaatccctggcagagacgatggcaacctgggatccaacggggctgtcctccgggatctgcacctcatagagcagctttgcaaactctgggacgttgtcattgatgtccacaacttcaatccgtaccagggccgtgccggacctgggtggactcccgccatctagcgctgtgagggttaacctgatctcaggctgctcctcgcgatccagggctctgttcagcaccagctgtggtaatattatgccatcgagactgtcttgtaaattaagatgaaagtggaaattgggactgattgtgtaattttggagactgttggttcctacatccaagtcctgggcacgttctattaagaaagtagttccaggagtgatactttctggaattttcaaaagtatttctttgtctaggaaaactggggaatgatcatttacgtccctaatccgtagctccgcctgaaaaaactgcaagggattttctagtaacacctggaaaggtaggacacagggctctgtggggccgcacagctcctcccggtccaatttctcatttaacaacaaatccccggtctgcctatcgaactgcaaatgcattttttttcctttggaaacgaccctggcccccctcacagcaagttctcctatctccagccccaggtcttttaacaaattggccacaaaggagccactctccgtttcctcggccactgaatagtgcctaggctggcaactagcctgagctatgcccagcaaaacaaagaatatcaggacttgcctttgtttcggaacgcgctccttcccctctccggcctccattgctttctggtctctcaccaaacgtgctccagctctggctcacgttgtcgctaactctatctccccgtatctcgctgatactgggatgagtggacaatcctagggcccggatttcccggagcgaccgccttagaaagcctcctcttcctgcttgctgcttctttagctgagtatctgggtaagggagcgtcggctgggtgctttgtttctgctacttctaaggctgcagcgccaccccgcgtctcttccgagtatttattttctcctaaactttaagaaaatcccagtgctttctttcaggctgatggcaatcgaaattgagtattttcaagtagtgtctctcagtgtaccgaagtcttattggcgtttcgaaaggctcttcattgcacccatagagacagggcaagaataaataaatcttcacttccctcacaaatccaagctttttttttttttcaaactggaaaaaataaatttcagaacctggaagggagtgatctcagtcctagcatgcttcggaaagaaggcttagactaagaaagttcta

SEQ ID NO: 12249 - DNA, 17247 bp, Homo sapiens
ccagctactcgggaggctgagtcaggaaaatcgcttgaacccgggaggcggaggttgcagtgagccgagaccgtgcagcctgggcaataagagcgaaactccatctcaaaaacaaacaaacaaaaaaacaaaacaatgggatagaccaatttctagtacttctaaactatggaatacgatacagctgataaaccaaaacacattagatctatgtgatttctcttaaaggatgttgattataagtttcaacttgtttagaacgagcccatattcatcaaaaattctgtatgcaccgatgtggtggctcatgcctgtaatcccagcagtttgggaagccaaagtggacagatcccctgaagtcaagaggtcgagaccagcctggccaacatggtgaaaccccttcttgtggagtaaaagttaaatattaaatttgaactcaattggacttgaacacaaggaatggttacgtgccagaaatctgtccctgggcacttgctcaggaacggatggacatactgattgttcttgataaatacatcatctgcctcgaggcaataaacaaaaccttgaaaataggctgacctttccgtgttccttgagtccaatgacaaaaggcccttgtgcctaggcctcatgccaaaaagaatactataaaaaggtcaggccaggtgcgatggctcatgcctgtaatcccagcactttgggaggccaaggtgggcggatcacctgaggtcagaggttcgagaccagcctggccaacatggtgaaacccccatcctactaaaaataccaaaaattagctgggcgtagttgctggcgcctgtaatcccagctactcaggagactcagacaggagaatcccttgaacccaggaggcggaggttgcagtgagccgagatcgtgccattgcactccagcctgggcaacaagagtgaaactccgtctcaaaaaaaaaaaaaaaaaaggtcagggtcccagactacgctgaagctccacgagacctctccttctctgtgcatggaccagtggctgactctggagcccaggctgttgcttcccggtctggtgatgaatcctccattgtctggtgagtgtatatatgctgattgtttttttttcctcactgctatttgctcaatgcaccttctattttatacttaaatgaacctaaagtagtttacaatctgcacttatgtgtgagtgctgtgtgtttgcttgtacctgtgcactccccacacagaacatgtctctactaaaaaaaaaaaaattagccagctgtggtgcatgtgcctgtaatccctgctacttgggaggctgaggcacgagaatcacttgaacctgggagagggaggttgcagtgaaccgagatcatgccactgcactccagcctgagtgagagagtgagactctgtctcacaaaacaacaacagcaacaaaaattagccaggcgtggtggcgtgcacctgtactcccagctgcttgggaggctggggcatgggaatcacttgaaccagggaggcagaggtggcagtaagtcgagattgcaccactgcacttcagtctgggcaagagagcgagactctgtctcaaaaaaaaaaaaaaaatctatatgtgggtatatttgacatgtcttgaagaaaactgtggaagggcactcgttaaactgttaacattggttatctctaagatatgaggaagaaggatggagacctcttttagaggattctatacctctagggaatgatcgttagcttgtatacatctttggattcctttacctgataaaaaattagttttgtcattaaaattaacaaaaatattaactttgagccgggcgcagtggctcacgcctgtaatcccagcactttgggaggttgaggtgggcggatcacctgaggttgggagttggagatcagcctgaccaacatggagaaaccccgtctctactaaaaatacaaaataagccaggcatgatggcacaagcctgtaatcccagctactcaggaggctgaggcaggagaattgcttgaatccgggaggcagaggttgcagtaagccaagatcaagccattgcactgcagcctgggcaacagagtgaaactccgtctcaaaaaagaaaaaaaaaaggaaaactataaattatactgaatgttttattttcctattgctgtggtaataaataaccataatgttagtggcttaaaacaacctaaatttaatatctcatagttctataggtgaggagtctcaccagattaaagtcaaggtgtcagtcacattttgtttctttttggaggctctaggggaagatccccaacactagctcatccatgtgttggccgaattcagttctatgatgtgggattgaggtctgtttcctggctgtcagctggaagccaccattagcccctagagttctttccctgcccttgcacataagcccctacatttctttctttcttttttttttttaattatttttttctttgagatggagtctcgctgtgttgcccaggctgaagtgcagtggtgtgatctcagctcactgcaacctccgcctcctggattcaagtgattctcttgcctcagcctcctgagtagctgggattacaggcggacgccacctcgcccggctaatttttgtgtttttagtagagatggggtttcaccaagttgaccaggctggtctcaaatgcctgacctggtgatccgcctgccttggcctcccaaagtgctgggattacaggcgtgagccaccgcgcctggcccgcccctacatttcagaagcagcaacagggcatggaattcttctcatgctttgactctctcctgagattagattgggcctacccagatacttcagaataatctcatctccagatccttaaccttaattacatctgcataattccttttgtcaccttaaggtaacatattcacaggttccaggaaattagggaatggacatgtttgggaggcgattggtttgccaaccataatgaaggacataaacaaaaaaccaacttaaatggcacatttaaaacttgttgtgataccctaccttgtttaaacctgagtgactctctcctagcagacagagccggacagactccattttagtttctttgcttgcagccctctttatccccctaagggagtaactagtgcaagctgactccaagcacatccaggaattcacctgctgataagatattgaggcaagctgtaccagcagctcctgggaatgtgctcggtggaaggtacctaaagcccccgcatttatctcttagtgatagtttaagcccctgtacctggaactgtttattttttgtaactgcttctataaccaattaacttttttaactttttgcctattctgcttctgtaaaactgcttcagttaaacccccctcccctatttagaccttagtataaaagaaaatctagccccttcttcagggccgagagaattttgagcgctagctgtctcccggttgccggctaataaaggactccacaatttgtctccaagtgtggcgtttctctatctcgcttggttacaacattgtcacattcttagatgggaagatttgctattgtaaagatgttatttctgcctacattagcctacaaattcggtgctagatgttctaataactaaagttgaatttttttcattaggtgagtggatagatgctcagagaatatatactgtttagagaaataaaggaaggtgactttgcagactttaactcaggtagaccgcgtatgtttttgagacaaatacaccagcattctgcacgagggcaaagtaatgtttcccactgtttccaaaatcctgttaatatccaggatttgctgggcacagtggctcacgcctgtaatcccagcactttgggaggccgaggcaggcagatcacttgaggtcaggagttcaagaccagcctggccaacatggtgaaaacccatctctactaaaaatacaaaaaaaattagctgggcatgatggtgcacgtctgtaaacccagatgctcgggagactgaggcacaagaattgtgtgaacccagtacgcagaggttgcagtgagcccaagatcacaccactgcattccagcctgggcgccaaagcgagactgtcttaaaaaaaaaaaattaggatttttctggtcaccattttttaggcacacattgactgatactttgaactgtctacggagacttgttccatcctttcctattcataaccaagagctcaaaactgtatcgtaagtatactttagttccccaacacatcatttttatacttgtcaaatgtgaaactcgtgttgttattattattatttgtttccagacggagttttgctcctgttgcccaggttgggttgcagtgttgcaatctcagctcactgcaacctccgcctctcaggttcaagcaattctcctgcctcagcctcccgagtagctgggattacaggcgcccgccaccatgtcaagctaatttttgcatttttagtagagatggggttttgccatgttggccaggctgatctcgaactcctgatcttaggtgatcttcccgcttcggcctcccaaagtgctggaattacaagcgtgagccaccgcgactggcctcgtgttatttttctgtccactcacacagctttatgagaactttcggcaaaggtttctgatggatgggcattgtatcttcactgtcttgagatttagagaagaaactgtttaagaactacttccatcatgatgcatcctcaggagatgtggatgaactgcggagatgtggggtgaagatgaacaagagatgagtgagtttgtgtctccctctaaagaaagtggcttttgtcaaaatgtacttgtaaagaagtgtataggctgggcaaagtggctcacgcctgtaatcccaaaacttcaggaggctgaggcggaagaatcgcttgagcccaggagttggagaccagcctgggcaacacagttagatcccgtgggtaaaaaagtgcaaaaattagcatggtggtgcatgcctgtagttccagctcttcgggagcctgggctgcagtgagccgtgatggccccaccacactccagcctgggcgagtgagaccctgtctcaaaaaaaaaaaaaaaaaaaaggcaattaacccacaattttcaaggcaattgttatgctttattacaagaagtgtttgaaatgcatcccatttgtagatccctagaagtaaaatagtcacctttgtttacactcacaccaaacacagtttttggaagagatatcgcagacttcattattatccccagattaaaggtcagttttgagtctttttattttgtctcgaccttattaccttcctagccaaaacatggaagtaaaacatcttttctacgttaatactgcatttccaggggtcttggggtgttccgggggagggtgaggtcccctctctgtcatggcggggtgtggacgcggtcgccttctcctggcgccgcggtacctaggacaggaggaagaggccaggaagggtccagggaggctcaggccgggtctgcgacttgccggtgggtggcggcaacgaccctgtgggcaccagcccgtcagacggccccagctccgagcccggctgcgagccctctccagcctgcagccgctcctctcccggccctactccccgcccggcactgacgtccagccccgcccgtgcagtgaggccagagcctggtgtagccccacgcggggccgttccatcttcgaagttttctggtgactgggtcggtcccgcaattatctcagatcaggggggaagccaagggcaacgggacaccctgatgtatcaaacacctccccctggagccccatcgcgcatgcgcaccctggaggcaagcgctcgaggcacagggcgcggcttggggagggaggaggcagggcggtggttgggcaagagaagagccgcgcccaccacggaacatctctgcgcatgcgccgggggccagcttctggtacttttgacgcgtctgctaacgtagtccctcagtgcgcatccggacgtaggaggtggaggttgtggaattcgccgttcgaaagcagggactaaaagccccacttcgtcttacgttccgaaaggaaggcgtctgttgagcctttctctcagtcgtgagggaggcgtcgacggcgtgcggtwagttttctgctgacggggtctctcaggaccaccgcagtggtctctcaggagtgagggacgggaaacgtgccgggccccgcgtttggggaacgcagcgtttcgcttcaaggccgcggcctcagggcgccgagcggggtttctagggctcggttcctgtcgcggcggtcgccgcccgcgccgtggctccgcctcccggaggttccccgactgtggcttccgggtggccaggcgccggcttccgcgactcgacttgttttttctctcttggttttttaggaagtcctgagttgaggcttgcgggatcctttccggagaaagcgcaggctaaagccgcaggtgaagatgtccaactacgtgaacgacatgtggccgggctcgcckcaggagaaggattcgccctckacctcgcggtcgggcgggtccagccggctgtcgtcgcggtctaggagccgctctttttccagaagctctcggtcccattcccgcgtctcgagccggttttcgtccaggagtcggaggagcaagtccaggtcccgttcccgaaggcgccaccagcggaagtacaggcgctactcgcggtcatactcgcggagccggtcgcgatcccgcagccgccgttaccgagagaggcgctacgggttcaccaggagatactaccggtctccttcgcggtaccggtcccggtcccgtagcaggtcgcgctctcggggaaggtcgtactgcggaagggcgtacgcgatcgcgcggggacagcgctactacggctttggtcgcacagtgyacccggaggagcacagcagatggagggacagmtccaggacgaggtcgcggagcagaaccccctttcgcttaagtgaaaaaggtgggtgggtcatttacctttccatttgtggtaatgtatggtggcagtatatgagtaggctagggaaccaacgttgctgtgtagtttcaatattagttcctttagtgcccgaaatctttttggaggaaagagggaggacattacctgtatttaagtggacagcattctctttagggttaaaggtcaactggatgttaaatggctcaggatgtagggaactttttttcctattggctgactgttcttagtgggtggagccttttaaatgttatgattaagttaaaggttctaagttaacgtgattgggaagaacaatatcaaaacacgccttcttttagttgacattattactgaataaaattggattgtcgagtatcctaagtgacctaggaggccgggcgcggcggctcacctctgtaatcccagcacttggggaggcggaggcggaggcgggtgggtcacttgaggccaggcgttccataccagcctggccaacatagctcactatctagtaaaagtacaaaaattagccgggggtggtggtagaaatacactttagtagtgtatcagtattggttcagtggttgtgataattatataaagaatctacagcagaaaaacctggttttcagaaatacatctttgaagagaaagcaaaataatatcactattagctagagaaaattaagtacaacaaaaagacaaaataataggacgctcaggcctttagtcaagaaaacaaaactaattgttgagataatttaagaattttattcttttcagcaagaaatgagctggagaatagaattttcagtgaataaagttacacagttgtccctctgttcactcgggggattggtgccaggatgcatatggaaccctcgcgcacacttggggtttacagtctctcaaacactgtggtactttctatctgcatttagtaagggggagaaaaaacaagtataaagtggaccagcgcagctactagtgttcaagggyaaccttagtttacctattataaaacaagtgacttaatatatttaataccacaaaataacatatttattgtgtaattctgagttctcttgggaaataactaccagattaatgagtattttaaaatctctctcttttttttttagatcgaatggagctgttagaaatagcaaaaaccaatgcagcgaaagctctaggaacaaccaacattgacttgccagctagtctcagaactgttccttcagccaaagaaacaagccgtggaataggtgtatcaagtaatggtgcaaagcctgaagtaagtattctaggtttgtcggaacaaaactttcagaaagccaactgtcaaatctgattagccacttatatcttagactatactttttgggaagtctagagatgtatataatgtgctaaattcaaagtagcaaatctgaagataggcaatgtcaaacccatgaaaatgggagattaatgagctttatttggccgtgcatgrtgcctcatgcctgtaatgaggcagatggcttgagtccaggagttcaagactagcctgggcaatgtggcaaaaccgcgtgtttacaaaaaatacaaaaattagccaggcatggtggtgcatgcctgtagtcccagctgtttgggaggctgaggcaggaggatctttgagcctaggatgctaaggttgcagtgagccaagatggcaccattgcactctagcctgggcagcagagcgagaccctgtctcaaaaaatacatttatttttttcattttcagttaacagtgtactcttataacaccgttattagctggtactttggtgatttctattactagtttttctaagctatttacagagtgtttgtagctttcatttgcagcattatgttcccacaaattctgtactcagcatatacagtatagtttatctgctctatttctgtcttatagaaatcatgaatgtggtctgcagacattgatgaagaaaatctgttggtaattgatacatgggctaaagcatcagaggtttaatttgaagtttatgttcacacactgaaaacttagtttttttgttggtagatccatgtgcatgctagaatttgggacaggyactatttgcataaagtattaaagtcaatttttaaactaagcaaaggtacacgttgtaacggtggggcatctgtgaaaaagatgtccctttcataatatatgcaatatattccagatgttttgagagattacagaagaggaggcctgcttcacttgcagataagtttattataattctccagaaatgtgcaggatgtgcattagcaaattgcactgtacttttcactccagcctgggtgacagagcaagactcccgtctcgggggcttaaaaaaaaaaaaatgctgtatctaaatgaatctgtgtaattgggcccagatgtgggtttgctcagtattagtagacaaggtctttgttcagacgattaggtgcctaactggcaaatgccttagtttcttaaaacgtattttctgatgtggctttacatttcaaaagtgaacttgattcaacctgagaaaactgattaaaaaattagtttaaatttgccagcagggaagtaaaataattatgggaagagtgtcttaagcctaatattaaatcagttttgttaaggggaaaactcaatagttctgttacttaggctgttagatccaagttgatttttgtgtctacagctaaattttgtttacaattaggctattttttaatataggatttagaaaccaagggtatgtgttttaaaattacactttttcttaacctgtctagctgtcggaaaaggtaacagaagatggaactcgaaatcccaatgraaaacctacccagcaaagaagcatagcttttagctctaatgtaagtatatccaggcattgaacactcaaaaattggatttaggatgtatttttgcatctttgtgtttttatctttgtggtgatagttgggggcctactgacacactttttaaatagaattaaaatcatttgtttttgagccacttttataagtggccattataatgggtttgtaatatatataacattcacgttagttccgatattttgccattcttttaagtgtccccccttttttattgaaatattttaaagggaaatctttagaatactccttaatcacaatgttttaaaataagagtttcaaaaacgaagcctcaaaatcattataccttgtgtatcttgtgtatgtccagtgtctccctgctgccccagtatcttcacttcactttttgaatcaagctacaattaaggttcacactatgtgtttggttgataatccttttttttttgttttgagacagagtcttgctctgttgcccaggctggagtgtagtggtgcaatcttggctcactgcagcttctgcctgcctcctgggttcaagcgattctcctgcctcagcctcccgagtagctgagactactggcgcatgccaccacgcccggctaatttttgtatttttaggagacagggtttcaccatgttggccaggatggtctacatctgacctcgtgatccgcccgtgtcagccttccaaagtgctgggattacaggcgtgagccaccgcgcccagcaattgataatatctctaaggctcatacatgggattatttaatgtacttttttttgtgaaaaaagtgtacaatgtatgtttgggaagctgactgaatttgttcttttacagaattctgtagcaaagccaatacaaaaatcagctaaagctgccacagaagaggcatcttcaagatcaccaaaaatagatcagaaaaaaagtccatatggactgtggatacctatctaaaagaagaaaactgatggctaagtttgcatgaaaactgcactttattgcaagttagtgtttctagcattatcccatccctttgagccattcaggggtacttgtgcatttaaaaaccaacacaaaaagatgtaaatacttaacactcaaatattaacattttaggtttctcttgcagatatgagagatagcacagatggaccaaaggttatgcacaggtgggagtcttttgtatatagttgtaaatattgtcttggttatgtaaaaatgaaattttttagacacagtaattgaactgtattcctgttttgtatatttaataaatttcttgttttcattcttagtctttattgtatatatataacctaatggatctttatttaatgtagagatataaggtggtgtgtgttgattaaagccctgttaatcccaagtccaaggctgactggccctacctgagattttgagaaatgctgaatctcaagtccctaccctagacctgctgaattagaaactgaattttaacaatattcccaactgaggtcaatacttcaacttgaaaaattgccctaaaaaatttatggaatactgggcttcaaggcaagaaactaagccagaaagaggaggaatagaatgcctcattaagctgtaaaatctgaggtatagttaaaattattatgcttttaaaaaagcattctaagtaaactttttttttgagatggagtgcagtggtgcgatctgggctcactgcaagctccacctcctgggttcacgccattctcctgcctcagcctcccgagtagctgggactacaggcgcctgccaccatgcctggctaatttttttgtatttttagtagagatggggtttcaccgtgttaggatggtctcgatctcctgaccttgtgatccacccgccttggcctcccaaagagctgggattacacgtgtgagccactgcacccggccaaagtattctaaataaactcttaatttgaaatgtattggtgctactgtaactgggaatgatttttttttggagaccgagtctctctctgtcacccaggctggagtgcagtggcacagtctccactcactgcaacttccacctcccgggttcaagcgattctcctgcctcagcctcctgagtagctgggactacaggcatgtgcccccatacccagctagtttttgtatttttagtagagacggggttttgccatcttggcctggctggtctagaactcctgacctcgggtgatccaccctgctcagcctcccgaagtgctgggattacaggtgtgagccactgcacccggctgggaagaatatgaagcacgtttttttttttttttttttttttgagacggagttttgctcttgttgcccaggctgcagtgcaatggcacaatcctggctcatcgcaacctccacctcctgggttcaagcgattatcctgcctcagcctcccaagtagctgggattacaggcttgtatttttagtagagatggggtttgtccatgttggtcaggctggtctggaactcctgacttcaggggattcaccagcctcggcctccgaaagtgctgggattacaggcgtgagccactgcgcctgaccgttaagcacataaaattttaagtgggtattacactttatgaactggagaatcttgacagctggtctaagtaagactgatttttatagacactttattttttagagaaggggtttcttgctccatcacccaggctgtagtgcacagtcacagcttgctgcaaccttgaactccagggctcagggaatcctgccacagcctctaccatacaggcttatgccatcgcacctggctaattttttgggggtaaagatgagtgggatttctgttaccctaggctggtcttcaagcagtcctcctgcttcggcgcccccaaagtgtaggcattacaggcgtgagccactgtgcctggcctaaaataatagtttcaccaaatgttttaactttcttacaaggatatttggtttttgaaggatggcattttacagaatgttattaaagatcagtgtctatctccatggttttgttcccataaatgcacctgggctatgcaatagagcgtggaacaggaaagcacctgtaattgtgaccacttctggggaagaagagggactagggtgaatttcctgtagtcattgtcaccttcctttcactacctacatagcttgcaagaaaaattagcaccctacctctgaagctcccaaggtcaactctaggcttcacattaaacacaaacagaagacaacccaagtgaataatatacagataaacgtggaaatatacacattagaacatttctttacaaactacaaacgcgcacggacctggccaggcggcaggtctgagctggtgtccgagactatgcatccgtttccggcgcagcgcacgggatctgcgcagtctccgttcgcgcttctgggctccgtaaggagaagcgtcttcagacggggtggcttggcttccgaggccctctgctggcgacccagtcccagtgtctgcgtctccctctcccctggcatcgtctcctcctctaggacagacgtagccacaaacgtccctacctcgatacccccagggaagggcctgccacccatcttgtcagccacagtctccgccctcccctggcaacgcttccctccacttccggtaacaattaactggaaccccgggcctcacttttccggacgtaacccggcccttcctgggggacccaggcaatccccacccctggcagtcctgggctgcgtccgactgggctaggcctgtgcgcaggcgcattgggtggagaaacccggacctgtgctggagacgcgaggacgcagtgagctatgatctcagcctctcagcctgggtgacagtgagacctatctcaaaaacaaaactctgaaggcagactatccctctccttcctcagatttccttaaatgcctttctttagggaagccagctcaccactttaaaagtcagtttcctctgttacagctcttcatacatttttacattttcttctttgcagcacttacatacatgtaattacataagtgtggagttgcttgtttaatgtagttaatttggggtttttttgaaccccaaattttgaacggatctcgctctatcgcccaggttggagtgcagtggcgcgatctcagctcacggcaacctctgccgcttgggttcaagtgattctcctgtctcagcctcccgagcagctagaattacaggcgcccgccaccacgcccggctaaattttgtatttttagtagagacggggtttcaccatgttggtcaggctggcctggaattcctgacctcaagtgatccgcccacctaggccttacaaagtgctgggattacaggcataagccactgagcccggcctaatgtagttaatttaaatgagacatttcttaacctctattaaaatagcaaatatttggccaggcactgtggcttactcctgtaatcccagcactttgggaggctgaggtgggaggattacctgagcccaggagttcaagaccagcctgggcaacagagcaagaccccgtcccctacctctgaccctgccagcccctcaaaattgaagtattagccggacatagttgcaggtgcctgtagtcgcagctactcgggaggctgagatgggagtatcctctaggaggcagaggttgcagtgagccaagattgtgccactgccctccagcctagccaacagagcaagaccttgtctcaaaaaaaaaaaaaaaaaaaaaaaaaaaagcaaatatagcagagtaacaggaattttctctatgttatagatgatttgatagagcaatattacaggtatttacattctttaagaatacaaaaatgtcaattataaaccaggcatggtggctcatgcctgtaatcccaactactcagaggaagagtctgaggatggaggatcacttgaggctgggatttcaaaaccagcctaaataacataatgagaccctgtcttttaaaaataaagtcaattataaaattattttcagtaagatcacttatcagaattacaggttttgaaagttatgttactaggcttacatatgctaagtaattaaggagagcttaataaagggactgtttacaaagttgtagactgggtaagaaaaaccaaccagagtgaagcataccagcgctatcaacagggggatccctcactactactaccccaaaagaggcaaaagaagggagcagcaatgggaatccagaaagtatagggttaggccgggcgcggtggctcacgcctgtaatctcaacactttaggagaccgaggcgggtggatcacctgaggtcaggtgtttgagaccagcctgatcaacaaggtgaaactgtctctactaaaaatacaaaaatgagccgggcatgttggcaggtgcctgtagtcccagctactcgggaggctgagacaggagggatagaagatagtcttcagacataagcggtgactacggaaatataccaaatccgtaatccagccagggaataaataccttgacctcatttcttccaaacctctgatcttatgtaggtactgtgcattggcaggacccaagaaggtagagggcaagagagtttactgatgcagttcattcaggctagcactcagggacacagaacatggagaccaatggagagtagttctaacagggcagacagaaaatatgtagcacaaattctttttcaacaggacatggcaacaatttaaaaaattggagtcttataagaagtctgttcaaattatatttatacatatttattaacaaagaacagaacaagtgatgtgtctaattgaatttttctagatgctggaagatcttccattctatgtgctagtcttacaatgtaacattggcactccttctatctagaagtagagtctgtatccctaatccttgaatctgtgactatggagggagtgacactgtgaattctgagactaagtcataaaaagtgaaacagattccacctagttctcttgggatacttgttcttaaaacccagcccccatgctttgaggaagtccaggccaatggagaggccaggtgtgggcgttcaggcctacagccaacatcaaccacaagacttctgagtgaggaaacctttacaatgattccagccccagcccctaatctgactgcaactgcatgagagaccctgtgtgagaaccacaccaattctcagacctatgagagataataataaaataatatttgtgctaaggtaccaagttttgggatgatttgttatgccacaatagagaaatgatacagttcataacagttttttttttgtttgtttgttttattttgagccggactcttgctgtgtcgcccaggctggagtgcagtggcgccatctgagctcactgcaacctccgccttctggattcaagtgattctcctgcctcaccctcccgagtagctgggactacaggcgcacgcagtcacgcctggctaattttttgtatttttagtagagacggggtttcactgtgttgaccaggctggtgtgaaactcctgagctcaggcaaatcacccacctcggcctcccaaagtgctgggattacaggcgtgagccactgtagccagcccagtttttaaaaatcacacaaattatcatattgcacagaaaagcaatgttgaaaatcctgtgaatactcttaataaatccttacaaaatcagttgagcaatttttaccacacatctttcctttctatactgcttatcacttccagaaactttagttaattacaaacatttccatttttttaagtccagacttgcagattttaatttgcaatataaacaaattggtaatatagagcccaattttactggcaggaataggatttttttttttttttttcaagacagggtctcgctctgtcacccaggctgaagtgcagtggtgtgatcagggctcactgcagccttgacctcccaggctcaagcaatcctctcacctcagcctctcgagtagctgggactacgggggcaggctaccatgcgtagagatgaggtctcgctatgttgccagggctggtcttggactcctgcgctcaaaggattctcctgccttggcctcccaaagtgctgggattacaggcttgagccaccgtgccagccaggattcttaataacagtaaaataagaaggatgtaagcactactcttccccaataactgaaatccaagaggcacaaaaccacatgtaattgtgtggtttttttttttttttttttgagacggaatc

SEQ ID NO: 12250 - DNA, 238318 bp, Homo sapiens
aattgggtctttttttgattcacttagtcagtttttttttctctttctttttcttttcttttctttctttcttttttttttttgagacagggttttgctctgtcactcaggctagagtgcagtgatatggtgttggctcactgcagccttgatctctcaggctcaagtgatcctcccacctcaccctcctaagtaactgagagtacaggtgcatgccaccatgtccagctaattttgtttattttttgtagagacaaggtcttactatgttgcctaggttggtcttgaacccctgggctcaagaaatcctcccactttggccttccaaaatgttggaattacaggcacaagcctctacacctagcctaagattttttctttttcatttattttcaaaagtttgcctgttatatgccttggtgtggagtctttggagttcactcacctctctatattgtttatcaaatttgggaactttttagccattttttgagttatttttagccttgtcttctttgccttttctttcagtactccactgacatgaatgttggagcttttgttaagttcccacatgtccccaaggtactgttcttttttattcttttagtctattttgttgctgtttttcaaattgcgtaatttttatttatttacttatttgttatgtttttagagatggggtcatgctctgttgccctggctggagtgcagtggcatgatcatactgcaccataacctcaaactcctgggcttaagcaatcctcccaccttcacctcccaaagtgctgtgattacaggtgtgagccactgtgccctgcccagattcagtattttctatttttcttttagtttccttattctcttttttgaccactccattcttctatttgggtttttattttggttattgtacttttttccaaaattttcatttggttcttttcatcatctatttatttgctgagactttctgtttcattgctgagggtttctatttttttatttgtttcaagcatatttgcaattgctcattgaagcattttcatggtgactgctttaaaatttttatcacagaattctaacagctctttcatctcattgttggcattggtatgttattttttaaatttaatttatcttcttggttattggaataatgagtaatttcttcatattgaaacttgaacatttttatatcatgttttgagactctagagcttacttattctattttagctagtttctcctgacactgttctgtcagagagagcattggcactacctcattactgtcacttgaagataaagcccaagtttcccataggcctacattgacaaatgcatggacatgtcctctatacttctaggtggggtggaagttttggccccaccatgtgttctccatagacactaaggtagagatgcccttgttatcacatggtgaaaggtcttggctctccactaaaacctcctctgacatcacctgatatggtttggatatttgtcctcttcaaatctcatgttgaattgtgatgcctaatgttggagttgaggctatcaggaggtgtttgggtcataagagtgcatccctcatgaatgacttggtgctattcttggggtagtgagtgagctcccactctgtgagttcacacaagatctagttgcttaaaagagtgtggtatctccttccttttcctcttgctctctctctaatcatgtgatatgctggttttcccttcgtgttcagccatgattggcagcttcctgaggccttcaccagaagcagatgccaacaccctgcttcctgtacagcatgcaggaccatgaggcaaataaacctcctttctttatagattacccagtctcagatattacttcatagcaacacaaaatgaactaatacagaaaattggtaccaaagactggggtgttcctataaagatatctgaagatgtggaagcagctttggagctgggtaacgggctgcgattggaagaatctggaggtctcagaaaagacaggaagatgagggaaagtttggaacttcttagagacttgttaagtggttgtgacaaaaatgctgatagaactatggatagcaaaggccaagctgatgagttctcagatggaaattaggaatttattgggaactggagcaaaggtcactcttgttatgccttagcaaagaacttggctgcattgtgtcaatgtcctggggatttatggagggttgaacttaagtatgattacctaggatatccagtggaagaaatttctttcttcttttttttttttttttttttttgaggcggagtctcgctctctagcaggctggagtgcagtggcacaatctcggctcactgcaagctccatctcccgggttcatgacattcttctgtctcagcctcccgagtagctgggactacaggtgcctgccaccacggctggctaattttttttttttgtatttttttagtagagacagagtttcaccgtgttagccaggatggtctcgatctcctgacctcgtgatccacccaccttggcttcccaaagtgctgggattacaggcataagccactgcgcccagccaggtggaagaaatttctaagcagtgaagcattcaagatgtgtcatggctgcttctaacaacctatgattagatatgggagcaaataaatgacttaaagttggaacttatatttaaaagtgaagtggagtgtaaaaatttggacaagtcacaacctggccacgtagtaacagaaggaaaaagcattttcaggaaatagattcaagagggctacagagaaaccacttgccatggagattagcatgactaaaagggaggcaagtgctaatacctaagataatggggaaaaggcctctaagccatttcagaaatcttccaggtagtccctcccatcacagatccagagacctaggaggagagaatgagtttgaggaccaggcccaaggccctgctggcatgtgaaaccttgggacactgctcccaggatcctgactgccttggctccagctggtacaggtacaggccacaggtacagctctggccactgcgctggagagtgcaggccaccataaaccttgatggtttccacatggtgttaagcctgtaggcgcacagaatgcaagtgtgaaggaggcttggcagcttccacctagatttcagaggatgtatcagaaagcctggatgcctaggcagaagcctgccatagggtggagctcctgtaaagaacttctactagagcaattcccaggagaaatgtggagctggagctctcccaccgagttttcaccagcatactttctaatggagctgtgggaagggggccgctatcctctagatccgagaataatatgagaatgccaccagcagcttgcaccctgagcctggagaagctgcaggcattcaattccaagccatgatatcagccatgggtgttgcaccctacaaaggcatggaggtggggctgctcaatgccttaggagtctgctctgtgcaccagtatgccctggatgcaggacatggggtcaataattattttggagctttaagatttaatgtctgccctgtgtggtttcagatttgtgtggggcctgttcctttcttttggctgttttctcccttttagaatggaaatgtttacccaatgcaatgcctgtaccaccattgtatctttttttttttttaaaatcttacaggctcttaggtagaaggaacttgccttgagtctcagatgggacttgggacttttgattgagttggtgctggaacaagttaagactttgggagaactattggtaaggaatgattggattatgcaatgtgagaaggacatgagatttggagggctggggtggaatgatatggtttggatatttggctcctccgaatctcttgttgaaaagtgatctccaatgttggaggtgaacctagttgtgggtgtttgtgtcatgggggcggattcctcatgaatggcttggtgcttggtaatgagtgagttaccactctatgagttcacatgatatatattttttaagagtgtggcacctcctccctctctctcttgttttctctctctcttaccatgagctatgctggctccccctttgctatcagttgtgattggaagcttccagaggccctcaccaaaggcagatgctggcactatgcttcttacgtagcctggagaaccgtgagccaaataaacctcttttctttatagattacccgcctcaggtattcctttatagcaatgcaaaatggactaatgcaccaccccagcagagagggggaggtggcaccgtgttattttctgcacagtccaggctgtccacatggtctcctctgataccacaactgtggagcttgctagcagttgggggaatgaaagtctcagtttcattttttggcctgatctgataccaccagaagtattgggattcctcattaacagctttgcaagagcgttaatctagattccccactcaacttttgctggtgtggggccacagtttttttctgtggtgattacctggagtaaatgattatctaggagctttttgtcttgctaggctgcctatttcctggtcctttgtctagagaaagcatgcttttttttttgagctttttgcatcagtacccaataatgtttctggttgttggcttcttctggtccaagtctggaatagataaggcaaaaacccagagatttcaccactgtgtcagtcttcaaaatttataacactttaaagtattttgcacttccaaatgttgacaatgttctctaaatctgctaacctttagaatgtttccaagtttaaagtttgcttcacttttagactaagagaatattcatgtatcttatgttgctctatcttttgtaataaagtaattactacattgaactgttaaaatacataaactgcttgttaaaaataaaatagctccatgttttgtctatatcttaattatcaagtaaacaaggatttaggctttctgattatgaagacatactggattaaataatccttattcacattaatgtccttaactattcttagtacttaaaatataaacattatggccattcctttaaaaaaaaactagtgatagcttattctgatcacatttcttagtcaaactaagatgtagctatgggattctgattatgaattggactgaaattgaaagagaggtttattaataggtaggttattctcaaattattttttaaatatatctttgcattagatttacatttttcttttgactatggattatataaagattctcagtacgtgtctctgatattgcgattcaatatccatatgatttttgttgtaatatgacaatgtttggtcttgataagaaaaaagcatggatgaaaatttaacataggaataaaagatctagtggacaccgattcaattaggaatactgagttttggaagtcagagttataagttcaatacttaggtcattatgttatataacaacaagggaaaatgtcacaaatatctttattctaacagttaaagtatcagaaaatgatgaagttgttcataccacattaaaggaattttacatgtgttcagaaattttccaaaaatgtcatctgtaagtacctgataactatatatacatgtgcatatgtacgtgtgtgtgtataatatcatttaaaaaaaaacacccaagctatcctagaataaggtgaatcatatcagtcaaactaccttattttaaaactttgacattcagttgcaaatatttaataataaaaatatataagctgataaatcgttttaaataaaatgatgtaaggagaggttaagtagatcttaaagtttctaattcaattgtaatatgtttgtaatcattactaaaagaaaatactggattacacactctccaatgagatttgaaatgtcctgggtcttaaaaggacataaaattgaaaatgattgcatttaacaaattrcagacrgatatagattgcatttkgaaaatcaacgaatggatctaaartttacattggccacatgatgtcgctgtacaccacaaagtcttgtcaatagaagggagctactgatcactaaaagtgaaggaggaagctccattttgtcaccgcctgagagaagacagaaacggtaaagagataaatgattggaaatattagataaaatggcatgattttgaagtaagaggagagcataagaaaggtgtagtcyttttgcaatggtgttttctaggagagggggcctgggagcccgggatctgcttctttggcttctgctcctcgcagcctgggaggtggggagcggccagctccactactcgatcccggaggaagccaaacacggcaccttcgttggccgcgttgctcaggacctgggactggagctggcggagctggtgcctcgcctgttccgggtggcgtccaaaacacacagggaccttctggaggtaaatctgcagaatggcattttgtttgtgaattctcggatcgatcgcgaggagctgtgccagtggagcgcggagtgcagcatccacctggagttgatcgccgacaggccgctgcaggttttccatgtggaggtgaaggtgaaagacattaacgataatccacccgtcttcaggggcagagaacaaataatatttattcctgaatctagactcctgaattcgcgttttccgatagaaggagctgctgatgcagacattggtgctaacgctcttctaacgtacacgctcagcccgagtgattatttctctttggatgtagaggcaagtgatgaactgagtaaatctctttggcttgaattgagaaaatatttggatagagaagaaacaccagaacttcacttattactgactgccactgatgggggcaaaccggagctgcaaggtacagttgagctgctgatcaccgtcctcgacgttaatgataacgccccactgtttgaccaggccgtatacagagtccacttgttagagactacagcaaatggaacattagtgaccacattaaatgcctctgatgctgacgaaggtgtaaatggtgaagtcgtcttttcctttgacagtggtatttctcgtgacattcaagaaaaattcaaagttgattccagctcaggagaaattaggttaattgataaactggattatgaagaaacaaaatcctacgaaattcaagtaaaggcagttgataaaggaagtcctccgatgtcaaatcactgtaaggttttggtgaaagtgctggatgtaaatgataatgctccagaactggcggtcacttcattgtatttgcctatcrgagaggacgctccactcagcaccgtcatcgccctcatcaccgtgtctgaccgtgactcaggtgccaacgggcaggtgacttgctccttaatgccccacgtccccttcaagctggtgtccaccttcaagaattactactcgttggtgttggacagcgccctggatcgcgagagcctgtcggtctatgagctggtggtgaccgcgcgggacgggggctcgcctycgctgtgggccacggccagggtgtccgtggaggtggccgacgtgmatgacaacgcgcctgcgttcgcgcagcccgagtacacagtattcgtgaaggagaacaacccgccgggctgccacatcttcacggtgtctgcgcgggacgcggacgcgcaggagaacgcsctggtgtcctattcgctggtggaacggcgggtgggcgagcgcgcgctgtcgaactacgtgtcagtgcacgcggagarcggcaaggtgtacgcactgcagcccctggaccacgaggagctggagytgctgcagttccaggtgagcgcgcgggatgcgggcgtgccgcctctgggcagcaacrtgacgctgcaggtgttcgtgctggacgagaacgacaacgcgcsggcgctgctggcgcctcgagtgggtggcactattggtgcagtcagtgagctggtgccgcgattggtgggtgcgggtcatgtggtggcgaaggtgcgcgcagtggacgccgactcgggctacaacgcgtggctgtcctatgaactgcagccggcagcaggcggcgcgcgcatcccgttccgcgtggggctgtacacgggcgagatcagcacgactcgtgtcctggacgaggctgacttgtcgcgctaccgccttctggtgctagtgaaggatcacggtgagccggcgctgacagccacggccactgtgcttgtatctctggtggagagcggccaggcgccaaaggcgtcttcgcgggcgtcggtgggtgtcgcgggcccagaggcggcgctggtggatgtcaacgtgtacctgatcatcgccatctgcgcggtgtccagcctgctggtgctcacactgctgctgtacacggcgctgcggtgctcagtgccgcccactgagggtgcrtrtgtgccgggcaagcccaytctggtgtgctccagcgcgttggggagctggtcgaactcacagcagaggcggcagagggtgtkctctagcgagggcccacccaagaccgacctcatggccttcagcccaggcctatctccaagtcttaacacgtcagaaagaaatgaacaaccagaagcaaatttggatctttctggtaatgtaagtccaactttcgagtttyggctttaaatatttttcatatttaacttgtctaatcatcttttcaaatatcactttaaaaaatgtcttcaaggtgttcactaacgttgaaataaatcataccattgaatgtagatatcctattaatggcagttttgtcttgaatggaactagaaagcaaagaaaaatgtagggacaaattgtcgtatttcttgatttaaatggcaggttaaaaaagctacaatacaaggtacaataaaaggtaatgttggtcatatttaacacaatatctcaatgtagtaaaataacagtgacatattcggggtaacttattatgttatcttttctggtgaaatgtcaagccccggacaaacaattcttgacaaagttacagaaatcatctgccttccctttacgtggctaagtttcaaagtgaacaataaactgaagttttaagcaaacgtaatttaaaatacatttattggctgggggcggtggcttatgcctgtaatcccaaaactttgggaggccgaggagggcgtatcacctgagatcaggagtttgagactagcctggacaacatggtgaaaccccgtctcaactaaaaatacaaaaacattggccaggcctggtggtgggcgcctgtaatcccagctaatggggaggctgaggcaggagaatcgcttgaacccgggaggcagaggttgtagtgaaccgaagtcgcaccattgcactctaacctgggcgacagagtgagactctgtcaaaacaaaaacaaaaacaaaccaaaaccgaccaaccaaacaaacaaaaaacaccatttattgggcgatttgtttaatttctttatgaaaacatacaaccacgacttcattgtcattgtgaacaatttcctgatgccattaaccttgaattcccctgggtctagaaggcttagcattgcatgtatttgctatttcggggatccagttaggaaacacttattaagcacctcccattcctcccattcactcacaaatgttctaaaacsctttacttttttagctcattcgatccttccaacgattttatgaagtgaagactttmgtcacattttgtggataaaggtgctgaggctcgcaaaacctaagttcagtattattactaagttttcttcaaatttcccgaggatatccaaaaacttgcttgctgttaatacagttctttacctttcctaaaatgtttaaggtggcttacagtggaagaaatttgtgaaagcaaattattaaaaaatctgcttaaggtcaaagtaaaagatcaagagaaaggtgggagtcattatttcaaaaatcaaccctaggctgagtgaaaatcccaatacttaccttcctgtaagtcaatatagaagtatgaaaaaataacaataaaaggaaattctctataccatttcttcaagagagaaaaaatagcctcttcctgctgcaaaatcaaggaagatttgattactgatgattgtgtaaaggttgagaaatatactgggcagcacgttttatagcagttttgcaaaacccacggaaatatccttgatgtagacatcattgtrtttggtagtcattcagtcaagggcataatgttaaattttatttcctatgtttgcttctgaagttacttaaatattaaatgaatatatttttgtttgtcaaactttcaaacatacatgaatgtccccttgtgaagacattctatgagaaattaatataatttgctagttaagtttccagagatttgagttgatacagagttgttgcttagagtattgtaaaaaataggctgtaaacatgttctgtaacttttaatatattatcgtactcagccttttggcaagaatcagaaaaaaataatcttagcatcacgttgccaagaaaatgtcccagttcctcaaaatatgagacaaactttgcaggattataaaattggaaaaaatagatcagaaaatcacaaaataatttctctttccaaytcacattactgtgtccccaaagcttcatttgctaacagtattaatggccaggcttaggattgcctttacatacattcaatatttctttatttagttttctaggttagttgagtgtattaacctgaaggtgaatcacaaataatagtgaattactattaaaccaaaaataaatgggcgtaggagtacaaaatttgaaaagtaatttttatgaaaaggtaattctagaatggaggaaaaaatgattgtggagtggtattgtcacttagtgtttattttaatgtaaatatgaatggatttcccattggtagttaaagttcttgctccattccaaatcttcatatagttaacacaactttcaacaggtttatctttcttcacaagatttcttccacaaactagtaaggtatcatttgagggaccttagagacttgtggtcagtgaaggatgcaaatagatgaaaatgagaaatagtttatattgctagccactaccgatattcctctgagaatgctggaggatttcacttttctgttattttgaggtagcacgattgtgtaatttcctttggccaatgaaatgtgaatggtgtgtcacttccaagcagaattatgtaactgccagtgaaagactcttctgctatcttttcctgttacagcaattacataagcactggttgatactgagacaccataaagtcaaagcaatccaggatgctgagccaacatgtggagaaaagctgtcataggaagtccccaataactacaaaggactctgcagcagcaagaaataaaattatgtttattttagaggaaaaactgaatgttaactcacaacagcatatgtattgaggtcccactgccattaagctaatatgaaccagataaattttaagaggggggcatttttttttacaacaggaaatacaattgtaggagaacattattgttgacactttttactaagacatctgaccgttaagcagattagataacttgaattccatggaaaaaatctactgtgttttgatttctttttcttaaatataaaaggtagcagaagaaaaataataaactgaaatttaaaatgtcatagatattccttcttttttcttgcttagcatccactccccttgttgtttttttcttctggggtcttctagtagttttgtgaaagattaggttgaaggttttgcaagaatgagtgcttggacatgtaaacgttaagggatatacagttccatagataggtgcaaagggtataattttagcaatgggtactatattaatttccttgggctgatgcaacaaattaccacagacttggtggcttgaaataacagaaatttattttcttacagagtctctgtaagaataaatttcttctctcttatggaggccagaagtccaaaatcagcgtgtttcctgggccgcatttcttctgaagactttaggggaaatttttttcttggatcttccagcttctggtagctcttggcattgcttggcttgtggcagcataactcyagttcctgcctctgtcttcacatttccttctttcctgtgttactatatgccttctctttttctgtcttttataaggggcaaccatcattggatttatggccttctgtaatctaggatgatctcatatcaagatcctcatctttgttacatctgcaaagacctttattccaaataaggtcacttatttaaacctcagaaaagtgatgtcttttggggtrtctttgacccaaaacaggtaccaagagatatcaagtgcagtgggaggaaggatatttgctgagcatggcttcttaatctcttttccccgttgtgggggaaatgtacttgcatatctggcaatagtattctatctccgggggaagggggaaatattccatattctcagaaatcctaaataacagcacaaaatgcctcttatacccccacatatgtcattctgaatatccggtataattaattaccttatatgattgcagaaattgtctcaagcaagccatgtttcctgaagctagcatctggattctaggtataattccttctatgtgtcaacagtggtcaatgttggctatagattaaataataattactgggtatcatacatatgcaattgctttgcaactacataatgctgtaacgagcagttctgaagctatctgccatctgtttaagctccaggagaatttgggtacatgccatgacctccacttttcagttcacataaaaaccaacctcccacttttcagttcacataatttaggtggagctgatttcatttcctggcttcaagaatgagcaagtggacccatgtctagccaatgtgagaaaaatcacaattattgactaaaggaaatttacatcatccaaactgggctgtaggaagtaatatccaggatttttgctggactattagaaaagagcactttctggtaagagtcatcaaactggtaatttttagtctagaaagctactttggccattttgccagcagatgggaaaagtctatctgagaagaagttcagcaggggaaaaggaattataaatgtggagattattttccttatggaattatggaagggtgtagacccagctctgtctgaaaccagtaattaattacccatttccatgtaygagtcagtacaggattctctggtttatttttgcttaaatcggttaacttgggatttactgttagagtatgattaacataaatacacatttccatagatggtacaaatgagtatcttaagatactgtacatgagggaaaaaaattgttattggaaaaaaagctagcttttcttaacaagagctttgcttttctcttacggacattgcaaattttgcaattaattttacttctctctttgctctaggaagctgaaaacaaaattggtgacatggttagagtaactgaaggtgaccctttattatggattttgtatgctatcccactccttgattcattttatttcatcctcatcttatctttattctattttcatttttttactgtgaagggatcagctaaaaattaacaaaagaagatattctcaagtaattaacacaaaaaaagagatcgattgtattgttcttgcataaaagtctaaatgtaatggaaaaggaatattctaaagtaatagtacattatccaaatgagaaacaaataaattattaatttcaaaacatttgcaaacaattcaaaaatcaaaattaaatcacaaaacaacagtatatatacacatatattttcaatggactaaaatacctttgattactatgttcttcatttgaagaaatagtgaaaaatrctaatatatccaaaagaattgaaagcagggtctcaaagaaatatatgcacacccatgttcatggcagcactgttcacaacagtcaagaaatggaagcaactcaaatgtccacgaatacttgaatgaataaacaaaacgtggtgtatacatatgttggactattattcagccttaaaaaggaaagaagtcctgtcacatgttacaatatggatgaaccttgaggaaccatccacggatgcttgaatgaataaacaaaacgtggtgtatacatacgatggactagtattcagccttaaaaaggaaataaatcttgtcacatgctacaacatggatgaaccttgaggacattgtgctaagtgaaataggccagtcacaaaaagacaaatactttacgagtccacttacacgaaatatctaaagtagtgaaattcatagaaatagaaaataggactgtggttaccagagactggagtgacggtgaaaagcggagttgttgtctaatgggtatagagtttctgttttccaagatgaaaaatttgtaacaatgtgaatatacttaacattactgaaatgtacatttaatcatagttaatatggtaattttaaatattatgttgtgtgttttttaaccagagtaaaaaagggtaaaaaggtaatatattttagggcttaaaatagttatttttttccaagatgaaagctatgagtaaacttaaaccagaaaatcgactagttttaaatctacagaataaacagtagagccttccttttagccacatgatgtcgctgtccaccatagmgtgttctctaggaaggaaaatacccagagcccctttgttacttcagagaagcggaggaataagagaagcagcaggactttaacagagactagaatatttaaatttttgcaaaacatgctcttctaatttgatcaaaacattgaggattggtaatggcgtcttctatcagaaggggccgaggggcctggacacggctgctctcgcttctgctcctcgcagcctggraggtggggagcggccagctccgctactccgtccccgaggaggccaaacacggcaccttcgtgggccgcatcgcgcaggacctggggctggagctggaggagctggtgccgcgcctgttccgggtggcgtccaaaagacacggggaccttctggaggtaaatctgcagaatggcattttgtttgtgaattctcggatcgaccgggaggagctgtgcgggcggagcgcggaatgtagcatccacstggaggtgatcgtggacaggmcgctgcaggttttccatgtggaagtggaggtgaaggacattaacgacaacccgccaatatttccaatgacagtaaagactatscggtttcccgaatcaaggctgcttgattctcggtttcctctagagggagcatctgatgcagatataggagtaaatgctcttctctcctacaagctcagctccagtgagtttttcttcctagatatacaggcaaatgatgaactaagcgaatctttgtctctcgtgctggggaaatcgctggacagagaggaaactgctgaggttaatttgttactggtggctactgatgggggcaaacctgagctcacgggcaccgttcaaatacttattaaggtattagatgtaaatgacaatgaaccaacttttgcccaatcagtttacaaagtaaaattgttagagaatacggcaaatgggaccttagtggttaagttaaacgcttctgatgcagatgaaggaccgaacagcgagattgtgtattcactcggtagtgatgtgtcctccactatacagactaagtttaccatagatcccatctcaggggaaatcagaactaagggaaaattagattatgaagaagcaaagtcctacgagattcaggtcactgcaactgacaaaggaaccccttcaatgtcaggacattgtaaaatttcattaaaacttgtggacatcaatgataacacaccagaagtctcaataacgtctctctcacttcccatctcagagaacgcttccctgggcactgtcattgctctcatcacggtgtcggatcgcgactctggtacgaatggacatgtcacctgctccctgacgccccacgtccctttcaagctggtgtccaccttcaagaattactactcgttggtgctggacagcgccctggaccgcgagagcgtgtcagcctatgagctggtggtgaccgcacgggacgggggctcgccttcactgtgggccaccaccagcgtgtccatcgaggtggccgacgtgaacgacaacgcgccggcgttcgcacagcctgagtacacrgtattcgtgaaggagaacaacccgccgggctgccacatcttcacggtgtcagcgtgggatgcggacgcgcaggagaacgcgctggtgtcctactcgctggtggagcggcgggtgggcgagcgcrcgttgtcgagctacgtttcggtgcacgcggagagcggcaaggtgtacgcgctgcagccgctggaccacgaggaagtggagctgctgcagttccaggtgagcgcgcgggatgcgggcgtgccgcctctgggcagcaacgtgacgctgcaggtgttcgtgctggacgagaacgacaacgcgccggcactgttggcgcctagggctggcaccgctgctggcgcagtgagtgagctggtgccgtggtcggtgggtgcagggcacgtggtggcgaaggtgcgcgcagtggacgctgactcaggctacaacgcgtggctttcgtacgagcttcagctgggtactggcagcgctcgcatcccgttccgcgtggggctatacacgggtgagatcagcacgacacgtgccctagacgaggctgactcccctcgacaccgcctactcgtgctggtgaaggaccacggcgaaccagcgttgacagccacggccaccgtgttagtgtcgttggtggaaagtggccaggcacccaaggcctcgtcgcgrgcgtgggtgggcgccgcgggctcagaggctacgctggtggatgtcaacgtgtacctgatcatcgccatctgcgcggtatccagcctgttggtgctcacggtgctgctgtacactgcgctgcggtgctcggtgccacccaccgagggtgcgcgcgcgccaggaaagcccacgctggtgtgctccagcgccgtggggagctggtcttactcgcagcagaggcggcagagggtgtgctctggggaggaccyccccaagacggacctcatggccttcagccctagcttatctcaaggtccagactccgcagaagagaaacagctctcagaatcagaatacgtaggaaaggtgagtcttttactttttcttgccaattctaaaattgttctttttaaaaaattctatatgatttctactagttatttagattcatagttcttcatttattttatatcatcctaccgtgcgattttgaatatgaattagagatcaatttattgcatttactgaacaatttatttaaacaatctacataactgttttcttatttttacattttggcacttccatcattaagtcataagtaatagaccatgaaacactgaaaaacacctcagcaaaatttgtaaattaaacatttcccataaatattttctctcttaaaaattgaaaatcacaatcggaagaaattaaagaatttgattatataatacgtattttcaactgacactgtctatccaatctgtcggatagtgtttggaataacctatatcctggacatttcttagattgttctttggatcaacaatgcccttgtctatgcaatagttaataagctacattttttktttgtttgtttgtttttgttgagacagtcttgctctgtcacctaggctggagtgcagtggtgtgatctcagctcactataacctctgccacccgggttcaagtgattgtcttgcctcagcctccttagtaactgggattacaggcgcccaccaccacgcccggctattttcttttttaaattttttatttttagtagagacggggttggtctcaactaaatgttggccaggctggtctcaaactcctggcctcaagtgatccaccctcctaggcctcccaaagtgctgggattacaggagtgagccactgcacctggtctttttatttgtatttgaaagcagcctgagtggatattttaacaccagaatttccaaaagtatgtagcacaggttgttacaacaaaatgacagcacttaggaataactgctaatcttaagtatgttttttataagtaaaataacccattatttggtataaagatttcacactgataacatttttgagttatcaggcaaaaatagagagtattgagaaaagagaccctctcaattttgtttaatttgaaaatattaacatttaaaaatcacactggggtttttcaggyggtgggactttttcttcatttaagtggagactacccagtctttatgttaatsgttgataaatcatcctttcagtatcattatcattaggccaatgtgtgcaggcctcccactgcagagattgaytacttttttctggcatctaattctatgcgtgggaatacattttccattaatgtgagctcactcaattttacctggaagcatccatattcctaatgaaattggaatttttccaaaagatgaggcctggtcttggatgactacattttcacttgaaacatttattttgggtaattrtaacacygaactcgacaagtaaatgttacacttggaaagaacttttttagcttttccaaccaaaggcagatgtattgcaataaaataactgtcttaaacggtcctctactatttagttcttagttatttgctgtttattctaaatatatgtgcatattgataaatcatagaaataacttccactagtgatcttacctttagccatttcatagttaggtcagaatatccatttccaagtaatacttgaccactatgtttctaccataggtaaatgataagcttctaaaattatattcacatatatccaaatctccaggagtcacaatctgttgctctataagttttttcaaaacattcttatttacattttttcttggttgtctaagtgacatctaggtggtagtagaaattattcactgatactttatctacaaaatggctcaatcttctaaactcatagttcctttaatattacctttatctcttaataatcagtatggagtctactctgctataaattctcatgtgacattccattttgcaattagtataactcttaaaggtactgaaaagtgcagtattacaataagttgtcaaaggcatctcattactatgaagtccatgaagtttaaaaattttaaatttatctcttattttcaaactagctaccatctttaaaaattcagcaaagtggtaactggaatattaatagctataattatttcttaggtccatgcttttcagaaataatgcttaaatgtttacttacttcttcataatatagcacaatataatcatttagaaattatgtaagtttgatattaacaaatatcattaacttacatttttatttatcttgcttgaaaaagttaattcaaaatattaatttatttattcatgaaaacaacaattgataatttatcctattctaaatatgaatgataaaatctgagtaagttgcagtcctggcttccatttcatgaatacacaggaaacaaaagctgaaatgaaaacttttcccctaaatatttaaatcacatgtttgatttcatttttaaatggtctgggtataagcaaaaatttgtacattattttatttctctaaatttgacctctttccataaattttctttgccccacttccaaatgcggcgagaattcatgcttctcattgaattcacagatatctttagaatgttttattgcttagtgttaaatatgttgagtaaatactggcttatgttcctaggttacttttctcccttcactgtttagttaaataatcaattctttcaagtaacaacttttaaaaaaactggaatctagaaattcatcaggagtggagatcatcaaaaacgtaattactttatattgttaacattttagtatatacaggtaaattcaaatacataaagagtgtggaaaaattaaacctaatatattcttaattgatgtgatgtgagtgtaacaaatatacaaatcacattcccacaataggaaacaaatttcctgtttgaatttctctgtaaaggaccgacttctgaaatctttatgtaagttacagtcaagacagttgatgaggctatagttcttgaaaaaggggcatgggagggaattacagacattctacaaatttaaaaaaccataaatgtacatattttaagaaattaacagttgctgtaataacataaaagtagatatatgtatgttttaatatatacagcacacacacacttttaaatacttcaacatctcaatgttttgatgatcataaatctgaaaggatctgatttttctataaaatgtaacttgggtggtraagaggttaatggtaagttgtcttgaatcagattgaaatcccatcgtaccaagagataatatcgttttacttaacctctatgtgtttataaaaagcgaataatattaaaacttatttcagaggattgtgataatttaacgggataattccattaagacaaatagaaaagtggctgtcacatgggaaatatttccaatagatgtccactgttaaaacaggaatcacaatattttagtgtatgtcatgaattagcacaattgatagtgaattagtataaaagttctaaggaaakatttagataaaatataaggactttgaggagtgaccgaaggatattacaattgaaactagaaattttgggaaagttcaaacgacatrcaaggaaaagaagatacgtttacrtatttaatasttacacgtttagccacatgatgtcgctgtccaccacaaggtctttctccacaaaagaaataacagcgtgcattacgtattcagatactgctttgcttcatcctctctaaaatttaacaccgaggagtttaagaaatgaagataaggaactcgaattatttttaaaytttggatcaatgtaaaggcaatctaatatttggaaaatacttgcaatgttgttctcctggcgagaagatcctggagcccagtgcctgctgctttctcttctgctcctcgcagcctcggaggtggggagcggccagctccactactccgtctctgaggaggccaagcatggcaccttcgtgggccgcatcgcgcaggacctggggctggagctggcggagctggtgcmgcgcctgttccgggtggcgtccaaaagacacggggaccttctggaggtaaatctgcagaatggcattttgtttgtgaattctcggatagaccgcgaggaactgtgcgggcggagcgcggagtgcagcatycacctggaggtgatcgtggacaggccgctgcaggttttccatgtggaggtggaagtgaaggacattaatgacaacgcgccagtttttccaatggctgtraagaatctgtttatttccgaatcccgacagcctggctctcggttttcgctagagggcgcatcagatgcagatatcggaacaaattsgttgttgacttacagtcttgattccactgaatattttaccttggacgttaaaagaaatgatgaggaaattaaatcccttggactcgtgttgaaaaaaaatttaaatcgagaggacactcctaagcattatttactaataacagcaattgatggtgggaaaccagagctcactggcacgactcaactaaagatcactgttttagaygtaaacgacaacgccccagcgtttgagaggacgatctataaagtcagattactcgaaaatgcaccaaatggtaccctagtggtgaccgttaacgccaccgatttggatgaaggagtaaataaggatatcgcgtattctttcaatacggacatgtcagcagataytctgtcaaaattccatttagatccagtcaatggacaaatcagtgtaaagggtaacatagatttcgaggaaagtaagtcatatgaartccaggtagaagccacggataaaggaaatcccccaatgtcagatcactgcacagttctactcgaaattgtggacatcaatgataatgtacctgagttagttattcaatcrctatctttacctgtattagaagactctccacttagcacagtcatcgcyctgatcagcgtgtccgaccgcgactcaggagtcaatggacaggtcacctgctcgctgacgccccacgtccccttcaagctggtgtccaccttcaagaattactactcattggtgctggacagccctctggaccgcgagagcgtgtcggcctatgagctggtggtgactgctcgggacgggggctcgccttcactgtgggccacggccakcgtgtccgtggaggtggccgacgtgaacgacaatgcgccggcattctcgcagtccgagtacacggtgttcgtgaaggagaacaacccgccgggctgccacatcttcacggtgtctgcgcgggacgcggacgcgcaggagaacgccctggtgtcctactcgctggtggaacggcgggtgggggagcgcgcgctgtcgagctacgtgtcggtacacgcggagagcggcaaggtgtacgcgctgcagccgctggaccacgaggagctagagctgctgcagttccaggtgagtgcgcgcgatgcgggcgtgccgcctctgggcagcaacgtgacgctgcaggtgttcgtgctggacgagaacgacaacgcgccggcactgctgatgcctcgggtgggtggcatcggtggcgcagtgagcgagctggtgccgcggtcagtgggtgcgggccacgtggtagcgaaggtgcgcgcagtggatgcagactcaggctacaacgcgtggctttcgtatgagctgcagcctgggaccggcggtgcgcgcatcccgtttcgcgtggggctgtacacgggagagatcagcacgacccgtgccctggacgaggtggacgccccgcgccatcgcctactggtgctggtgaaggaccacggtgaaccctcattgaccgccacggccactgtgctggtgtcgctggtggagagtggccaggcacccaaggcctcktcccaggcgtccgctggcgccacgggcccggaagctgcactggtggatgtcaacgtgtacttgatcgtcgccatctgcgcggtgtccagtctgttggtgctcacactgctgctatatactgctctgcggtgctccgcgccgccaaccgaaggcgactgtgggccgggcaagcccacgctggtgtgctccagcgcggtggggagctggtcatactcgcagcagaggcagcagagggtgtrctctggagaggggttgcccaagaccgacctcatggcttttagccctagccttcctccttgtccaattagccgggatagagaggagaaacaggatgtggacgttgatctctcagccaaagtgagtaatttttatttattctttccaaaatgtctttgtttttcattcctcaatgtttccactcctctggaaatacattaatagttaaktatgaattatgtgattcataattagacttttccagttttgtggttttgtggttaaaacsstaagatttttgttgctaatttttgaaccaaatcagcagtaagttatgatatccacacttgtaattttgttttgttattaggtgcagtagtagaattattttattgctaaatgcctgggtataagacaaatattttttcttagatgaattgcattatttagagaatctgacttcgacttgttttatacttatccctatacaatgcttcttcaatatcttttgccacttttcatttggacttcctactacctgttagtacaratgttacttgctcattttatgagttcacctaatgcttataactccctattgattatgcttttccaccttcagtytcaaaaattagatcattacacctgttgtcttttatggaacctcttttattctcttattcacttgtttggagtctcaatccttattttttacttgaatatgattcattttaggccttgtgctctaatttggcaataccgtttattgtttcttgatttcccagttkggaaaaaaatcgagaataacaattgcatttagaattgcatctttgttcatctttagtttatcactactttatttaatactactttaataatactactgtattatatgttaaaatttattactaataactaaaatatcaatatgaagtgaaaatttaatagttgtatagtatatttatatattcattttaaaagaatgttttaaatcttgttaaaaataattttcaatctgaacaatatcttgaaaataattatggtatctaattttaaaactatccctactagcaaaactttttattcattagtgtcttttgcataccatactaaggatgctaatatgaaataagtttgataagccaatgttataatgttattactggttaacttctctgaatagcatcctgcctattaatgtgtgccatgcaataagtagaaaactccaaataaccagaaccaaatgaaattgaaggtagacttttttctaatcactacccctacatatttggttatctcctctagcaattagttggactcccatttaagtttccctaccactggagagaaatagtaaccaactgaaacctggttaatactcattgacagtgtgggaggtctaacacrtaaaatagatatttttcttgactcctctccttcccctcacttccattttctttatttccttttttggcactatcctttgttgctcccttgtccatgaagtagtagccatagtgtgtccatctcaggtcagtattttaaaaatttagttctgttatcagcttcttgaatataatagagtcagccaaagtacttgtcttcccagatatggaacttcaatcttcaaatccagcttgcctcttgaaactattgtctaacaagactcttggcaaagacattttgaagactttggaattttcacttcacagatgtactgatgctatgccaaataaatattgaatagctaccaaataaacattgttttctattctgctgcattccccatctgtacattaaaatacctggtaaatgaaaatattacaaatgaaatgggtgaaaatggaattcttcctccttttttccaatgtgcttgatgtcaatgatcattttgtaaaaatatagtttgggtccccacatagtgaaagtactctggtttctgtttgattcagaaatttggtgggttttttgttgttgttttggtttttgtgtgtgtgtgtttgtgtgagtgtagttcttcaatagagagggagcgtaaagctattttcactagattgattttttgtttagacaaacaggatgaaaataactttatgratataggaggcaaggaaagtttttaaatggctaccattatgtctttatatattaaatttctttatgtaagaaaatgtattgtggtttatttattgggaagtcttcattccccattaatacccaggatgattcaaagatcrtgattaccaagaattagaataaaaattaagctaaaacccaagttttcaacattgaacttgaaatacatcttaattggggaaatgtctagagactttttttgtatctttagaaaatcatagaggctattgaaacaccacattttcccaactagatatgcgatcaccttaaattaatrcattttattaggcaatggaaggaarcaaacattttctgcagggtaaatatttaggaaatattaggtaagtccctctgagctattaaacaattaagatacaactattccctttaaaatatatattccaaaaaaggacacacatactcaaatgcttataagagataaattaatgtaataaatggcccacgcgattccaccctggtgctgcagtttgtaaaagaagaaaaaatacctgttcaattggtttgatcatgacattcttcatgggtcagggaagttttaagtggttataaaatggggtaaattggctttagaagagtttagaaatgatgtggattacttatagacaggacaaaatgaacatgcttgtttattaaaaaaagctattggaagcaggaaatattcagtttggctaaaatatataagcactataggagaaaatagaagcttaggcacattacatactggagaacaagcaagtacttataaactgtaagagtcaaaatgagaataccagcgtttctcatgggagcaaatgagttccaatgaataaaattatttggaatgcttttccatgcaagctatttgctataacttcctgcttccttgcactttcagccctgacatgactcaaggaagacatctaattaaatgctgatggtctttgatccttttataaaacatctgcaaatttccctgtcaatagcttgttcttggcaccagaagttccctagagaccagtcccctcaagtcaacaacaccagaaatactagggtgaaagagggtgttatcattaataaaaaaaaaccctggaattcttgggaacacaggaatctgtaatgaatttttctaatcaacagtttacagttacatgtttacaaagtgtatagttaggtctctgtaatacttaaaacctgtgttgaaaaaattatttctactgaagtaaaagttgcccctatggcgaaactaaggaccacactcaatcaatcastggtacaatgtgtaccacagtagtacaaaatgtattcctattctccgaaacgactgaaataataaataaaaccaagtagtttacagtagagtgtgtgggggtttccacaattgctacttacggtttggagccacatgatgtcgctctttaccacaaaatacatgagagaaggaggaagaagggaaaattccttctattcttactggaaggaaccatatrcactctttggagtctgaaatatggaggatgcagctgcacttgactgaccgattaaaagatttcccttgactttgagaaacgatatttaatcagaacaaaatactgtgcactaaagatggagttttcctggggaagcggccaggaatcccggcgtctgctgctcttacttcttctcctcgcagcctgggaggcagggaacggtcagctccactactcggtctccgaggaggccaaacacggcaccttcgtgggccgcatcgcgcaggacctgggactggagctggcggagctggtgccgcgcctgttccgggtggcgtccaaaaggcaccggggccttctggaggtaaatctgcagaatggcattttgtttgtgaattctcggatcgaccgggaggagctgtgccggcggagcgcggagtgcagcatccacctggaggtgatcgtggacaggccgctgcaggttttccatgtggacgtggaggtgagggacattaacgataacccgccggtgttcccagcaacacaaaagaacctgtccatcgcggaatccaggccgcttgactctcggtttccactagagggcgcctcggatgcagatatcggggagaacgccctgctcacttacagactgagcccaaatgaatacttttctctggaaaaaccayctgatgacgagctggtaaaaggtcttgggcttatattacggaaatctttagacagagaagaagctccggagatttttttagtgctcacagccactgatggaggcaaacccgagttgactggcaccgttcagttactcatcacagtactggatgccaatgacaatgccccagcttttgacagaaccatttataaggtgagattactagaaaatgttcctaatggaacattggtaattaaacttaacgcctcagatttagacgaaggattgaatggggacattgtttattcattctcaaatgatatttcgccaaatgtgaaatccaagtttcacatagatccaattactggacaaattattgtaaagggatatattgactttgaagaaagcaaatcctatgaaattattgtagagggcattgataagggacagctcccactttctggccattgtagagttattgtggaagtagaagacaacaacgataatgtcccagatttggaattcaagtctttatcacttccaattagagaggacgctccactgggtacagtcatcgccctgatcagcgtgtccgacaaagacatgggtgtcaatgggctggtcacctgctccttgacgtcccacgtccccttcaagctggtgtccaccttcaagaattactactcgttggtgctggacagtgccctggaccgcgagagygtgtcagcctatgagctggtggtgaccgcgcgagacgggggctcgccttcgctgtgggccacggccagtgtttctgtggaggtggctgatgtgaacgacaacgctccggcgttcgcgcagcccgagtacacagtgttcgtgaaggagaacaacccgccgggctgccacatcttcactgtgtctgcgtgggacgcggacgcgcaggagaacgcgctggtgtcctactcgctggtagagcggcgggtaggggagcgcgcgctgtcgagctacgtttcggtgcatgcggagagcggcaaggtgtacgcgctgcagccgctggaccacgaggagctagagctgctgcagtttcaggtgaccgckcgcgatgccggcgtgccrcctctgggcagcaacgtgacgctgcaggtgttcgtgctggacgaaaacgacaacgcgccagcactgctagcgcctcgggcgggtggcactggtggcgcagtgagcgagctggtgccatggtcggtgggtgtgggccacgtggtggcaaaggtgcgcgcggtggatgctgactcsggctacaacgcgtggctttcgtacgagctgcagccggggactggtggcgcgcgcatcccgttccgcgtggggctgtacactggcgagatcagcacaacgcgtgccctggacgaaacggacgctccgcgccaccgcctactggtactggtgaaggaccacggcgagcccgcgctgacggccacggccactgtgctggtgtcacttgtggagagtggacaggcgccaaaggcctcctcacgggcgttggtgggcgctgtgggtcccgatgctgcgctggtggatgtcaacgtatacctgatcattgccatctgcgcggtgtccagccttttggtgctcacgctgctgctgtacaccgcgctgcggtgctctgcgctgcccaccgagggcgcgtgcgctccgggcaagcccacgctggtgtgctccagtgcggtggggagctggtcatactcgcagcagaggaggccgagggtgtgctctggtgagggcccacccaagaccgacctcatggccttcagccccagtttacctgactctagggacagagaagatcagctgcagacaactgaggaatcctttgcaaaggttagtgtataacatccttttgtttaattttcgtattgtttttctctatcaacttcttcgtaaatttatttctaagagtcaaatttccctgggttaaaattttacctctttttacatatccattttaactaaagtcttttggaattataggacatcagagcaatatatattgccttccttcattttatgctgcattattcaatgcatattaacagaactgtaatttctagtaaattttcactatattcaccctctttgtttttggtaataatcaacattttagaaaacattttactattatttaacctattacatataaacaaatgtgcacaggctgaaataataaagctccataaattgtatgaaagtgaaaagctccgttgcctccatcgctgaagcccctcgcatgcacctgccaaatcacttcccttatttttcctccagtgtaaccgcacatttgccttttataactgtttgttcggggcctgttttgggaacgttatctaattggacttgcacaacatgtattgtctgtgcatttgtgtgttatttgtatttatcactcattgtttatgaaattatccatgttgttatatgtagttgtagtttatttatttctgtttctagtactatttcataaatatactataccttatttattctactgttcaggaatttgcattgtgcctcaatgtctatttcaaataatgccatcataaatatattgtacatttctttgatgcccatgtacacagatttctctcaggtttttgcctaagagttgtgtttgtgggtcacagaatatgtgtgtatctttgtcttttgtagctaacaccaaccaattttccaagatgtttttacctgtttacattcctagtagtgcataaggctttctgctgggccacatcatctctacatttgtcaggttattttcatgttagccattttactgggtgacttttgtaatctcattttgaaattattttatatttaaatgaagttgagtacctttctattttattttggcaatttttataccttattttgtgcaatagctgctcaaatctcctatttctctagtctgttgtttttcttttcttttttctcttctttttgcttccatagaactttatttatttccttatcttgtttttcttattacttaaacaaatcttgtattctgaacataactcctttttttagtagttttcaacctcatggctagtttttaattcttttttgtcttttggtgaatagaaagtcataattttgattaaactcaatttatcaatttttgcttctgatcctatttcacaaagataattttctgtggtatcttttatttcattgtttacattacatctacaatccatttggaatatacatatttttatcattgttgtgaggtaggggtcaagatttatttttatttcttcttattatttttattatactttaagttctaggatacatgtgcacaacgtgcaggtttgttacataggtatacatgtgtgccatgttcgtttgctgcacccatcaactcatcatttacattaggtatttctcctaatgctatccctcccccagtcccccacacctcaacaggccccagtgtgtgatgttccccaccctgtgtccaagtgctctcgttgttcaattcccacctatgagtgagaacatgcagtgtttggttttctgtgcttgtgatagtttgctcagaatgacggtttccagcttcatccatgtctctacaaaggacatgaactcacccttttttacggctgcatagtcttccatggtgtatatgtgtcacattttcttaatccggtctatcattgatggacatttgggttggttccaagtctttgctattgtgaatagtgtcgcaataaacatacatgtgcatgtgtctttatagtagcatgatttataatcctttagatatatacccagtaatgggtcaaatggtatttctagttccagatccttgaggaatcgccacactgtcttccacaatggttgaactagtttacactcccaccaacggtgtaaaagcgttactatttctccacatcctctccagcaygtgttgtttcctgactttttaatgattgccattctaactggtgtgagatggtatctcattgtrgttttgatttgcatttctctgatgaccagtgatgatgggcattttttcatgtgtctgttggctgcataaatgtcttcttttgagaagtgtctgttcatatcctttgcccactttttgatagggttttttgtttttttcttgtaaatgtgtttargttctttgtagattctggatattagccctttgtcagatgggtagattgcaaaaattttctcccattctgtaggttgcctgttcactctgattgtagtttcttttgaagatttattttttactaccattttttttgttggacttttaaaatgagtttggaagtgttccctctccttcaatttttttttttttggaagagtttgaaaacaattatcattgattcttctttaaaagtttggtagaattctccaggaaagatatctggttttgggcttttgttgttgttgttgttgttgttgttgttgttaggaggtttggattactgattcaatctccttactagttacagctttgtttagattttttatgattatgtcttggtagtttgtatgtttctaggaattaatcaatttcttctaggttattgaattttttggtatatgattttaawagcctcttataattgtggcatcaggtgtaatgccacctcttttgtttctgacttccagtctttttgtttttttcttagtctagctaaggggcttgtcagttttgttgttttttcaaaaaatcaactaagtttaaaaacttaatttaaactttttttcatttatttttgctctaatctttattatagtatttcctccctttgctttgggcttcctcatttgtcctttttttctagttccttgagttgttaagttttttatttgagatctttcttctttcttcatttttagtgtaggcatttacaactcccttctttgtttttgttttcatgtttaagagacaagatctcactatgatgtacagaggcacgatcatagctccctgcaagtgatccttgtgccttggattcccaaagcactgggattacaggcgtgagccactgagcttgcccagcttaatattccttcttagtactgcttttgttgtatcctgtaagtttttattgtgttgtgttttcatttttgtttatcttaacatattttctaattcatcttttgatttcccctttcattcaaatgaaattttgaacagaatttcgttcaaaattctgttgtttaatttctacatatttgcagattttccagttttaattccagtattgatttctagttttattccactgtggtcagaaaagatatttagtaggatttcaaccttcttgaatttgttaagacttgttttgtgacctgaygtgtgatttatcctggaaaatgctctgagtgtgcttgagaagactgtatatttgctgctgttgggtggaattttctgtatatgtctgttagttccatttcagctatagtgttgttcaagtcctctgcttccttgctgattttctgtctgaatgttctattccttattgaaagtaggataccaaaatctcctactacagtcattggagatacattctgagaattgtatcattctgagatttcatcactgtgcaaacatgagagtgtacttacatatttacacaaacctagatagtatagcctactacagacctaggttacatgatctattgcttctaggctacaaacctgtacatatgttaactgtactgaatactatagggaattgtaacacaatggtaagtatttgtatacctaaatatatctaaacatctaaaaggtacagtaaaaacattgtacagatttttaaaatggtacacctgaatagggtacttaccctatgaatggagactgcggggctggaaatttatctgcatgagtcaatgagtgaatggtgagtgaatgtgaaggcccaggacattactgtgcactaatgtagactttaaagcactatacatttaggctacactcaatttatcaaaaaattttctttttacaggctggtcatggtggctcatgcctgtaatcccagcactttgggaggctgaggaaggaggatcacttaagcccaggagttcaagaccagcctgggcaatatagtgagaccctgtctctagaaaataatttttaaaaattagctaggtgtggtgacacacacttgtagttccagctactcaggaggctgaagtgggaggatccttgacttgaggaggtcaaggctacagtgagctatggtcgtgccactgcactccagcctgagcaacagagtgagactctgtctcaattttttttctttcttcagtaataaattaaccttagcttactgtaacttttcaactttgtaaacttaaattttttaaccttttgactcttttgtaataacgcttagcttaaaacacaaacacattgtacagctgtacaaaaatattttctctttatatccttattttacaagtttttttgacttttaatttttttatttttttcacttttacttagtgtttttttttgttgttgttgttaaaaatgaagatataaacacccatactagcctaggactgtattgggtcaggatcatcaatatcattgtcttccacctccatatcttgtcccactggaaggtcttctggggcagttacacatgcgatgctatcatctcctatgataacaatatcttctagtggaatacttcccaaaagactttcctgaggctgttttgtggtgaccttttttcttttttttttttgagttaatgtattttttataagtagaaagagtacactgtaaaataccactaaaaagtatagtaaatacataaagcagtaacatttactatctgtatcaagtattatgtactgtaaattactgtacataattgtatgtgctatcttgtacttttatataactggtagtgcaataggtttgtttacaccaacatcaccacaaacatgtgagtaatgtgctacaacattatgactgctacatcatcactaggtgataggaatttttcagctccattataatcttatgggactactcttgtacatgtggtctgttattggttgaaacgttgttatacaacacttgactttattgtattgctatctatttctccatttctgtgaatgtttgcctcatatatttaggtgttttaatgttgggtgcatatgtatttataattgctatgtccttctggtgaattgaccttttatcattatataatgtccttctttgtctcttatgacactttttgacttaaagactattttgtgtgatgtagctgtttccacatttgcactcttttggttacaatttgcatgaaatttttttaatatcctttaactttcaggctatccaggtctttaaatctaaagcaaatctcttgtagttagcatataattgggtctttaaaaaaaatcaattcaaccactttgtatcttttgattgggggagtttatcccatttttatttaaagtaattattgatagggcataacttactgttgcctctttgttaattgttgtttgcagcttgtagactttttgctcctctttcctyctcttactgtcttcctttgtgttttattgagaattgtaatgctatgtttttgttcctttcctgttttcttttgtatatcttccataggtattttctttgtggttaccatggggcttacattttaaaactcttataaaaatgtattttaaactgatarcatctttactacaatcacaaaacaaaactcattatgtttacttctcccctacccaaattttatgttattgatgtcataaatacatctttttatattgtgtatacattaacattattttatagttagtttttctgtacttttgtcttttaatcagattttaaaatatcagattttaaagtgacttttgtaccaccattacagtattatagtattctgtttttatctatatatttatctttactagtgagctttatactttaataaaatacctatgtatttctgtttagcatcccctaattttaactcaaaaggccccctcttaacatttcttgtaaggcaagtctaattgtgatcaccttcagcttttgtttaactgggaaggtctttatctctttttcatttttgaagacaaactttggtggatttggtattcttggctggcagttctttttcttttcagcactttcagtataacatctcacccctttctggatggcaaggtttctactgagaaatctactggtagagttaggggtgttcttttgtacgtgatgaggcatttttcttttgctgctttctaaattcttaacatttcttggatcttgatgtccatttccttcctcatatttgggaagttttcagatgtaattttaaaaaataagctgtctgtccttttctcttatggcttcttcttttgaaactgtcataatgagtagagcagcctgctcgaggatgtcctatcaatttcttaggctttctttactctctttcatttcttgctctttttgctactctgtctggataatttcaaatgatgtgtccttgagttcactgactcattcttctacttgattaagtctgctgttgaacatgtctgtaaaattttcagttcaattattgtattcttcagttccaaaatttctttttagttcttttgaatattttctatctgctgaaattctgattctgcttatgcattattttcctgagctcactgaacatctttatgacaattattttgaatactttgtcaagtaattcacatagctctatttctttaggtttggtttctggaggtgtgtttgtgtgtgtgtgtgtgtgtgtgtgtgtgggcacgcactatttgattgggccatgtttcctgttttctcatattccttattactttgtgttgatatctatacatttcaaaaaaacaaaaaacaacaacacaccagctacctcttccagtctttatggactggatttgtacatggaaagatctttactaatcaggctggctagagattctagggacctctcaaaccttttctgtggatgcatcttctatggacttgtgtgtataattcctaattagagggatctgccagcttttttttttaagatgctctaatctttttccctctgtggtgtctgtgtgctgtactgtgggccctctggagcagcagtattcactcagctcttttaggttctgagaagccctcagttatagattctgctgaatcctatcagtgcctggagtcaagtgagacagaaacttggactgcccactaaaattcaggaactttggatgcattttactctctctttccctcatgagagagagagtgctgagctgagtttctctctgtgtgctgtatcacaggtcctgaggagcatcagcccgccacccagctctttattattctgagctgccctcaggattttagaatatgccaggttccatcagtgctctgagatatgcaagacagctcccctgaaaagtcagaacactgaatgcatgctttactttctctttcccttctcagggagaagacaggagctgggaatttccccctgtttgaatggaactgtgctgctggatgggactatagggaaagtgccccagaaaagtgcccagctagttttacacttgcttggagcccaggaccctcttaactggtttcggcacttatcaccatgggaattggtccttgtattgttgttgagttggtatacctgtggagggtctggggattcctataacagcatcttgctgatgtcactacctctgttatctttttaagctatatatgcttttacaaattattttattgatttcctcttttgttgattataacacacatccttgacttattacctcaattaaatcaataattttaataattccaggcaacgctaagaccttgaatcattataccatttacttgtaccmtactttttgttactgatatgcctttcaattatttatatgttctagacacacagtacattattatcattgttttgttaacacctatatatgtttctttctgggatcattttccttctgaagaaattaacatttcctttagtgtggcctgctggtaaagaaacctttacgtttttatatatctggaaatgtcttaattttactatcacttttgagaaacagttttgggtattgaatgaaagttatttttgccagcacttttaagatgacattccatggtcttcttttgagatgatggctgtcaagtttattgttcaattagtgtgtctttttttctgtctagctactttgtatacttactctgtttttcacttttaacagctttactatcatgtgcccagtgttaatttgctttgtttttaatctcgcttgcagttttcaaagcttcttatatctgtgggttgataatattttatcagtttaagagaagatttagcagtatgccttcaaatacggcttctacttcatattttctcttatattcttctgtgactataagtacatgtatgttaaatcttttcaccatattccttgtcttttatgtgccatttctgtttttaaatcactttttctctttgtttcataatccatgttttattctgacccatcttttactttaggaattttatcttgttattctaggccactgtcaaagtcattgattgaattcttaacttgaatcgtggcatttttccattttagaattttattttcctttttaaaaatatatttctaacttgggtactggctaatgtcaaaagaaactttcctcccacaaagttttcactcacttgatcttggattttaaaatcagatataacctgagagattatcatttttctccrtttaataatgaatcaggccaggcatggtggctcatgcctataatcccaacacctgtgtgggccatgacaggaggattgcttgagcccaggagttcaagatgagcctgagcaatatagggagactccatctttacaaaaaatgaaaaaaattagctagatgtggtggtgcacacctgtggtcccagctacttgggaggctgaagttggaggatggcttgagcctgaggctgcaatgaactttgactgtaccactgcactccagcctcggtcagagtgagactctttgtcacccagttgtatagaatcaactataggtagaggcataaaaaagatgcctgagattgcatctcttgaatttagcttcattgtccctttctattaagtgagattatttgacatgaacattgatattcactatctcagggatatgttagaactattctcatattttctatccacagaggatatataatatggatattttagcacattcccttatagggcagttataccttcctctgtgactcattatacaggcagcgctaagatgtgtattatatgctcatggtatcctttcttactatccttataatagaataaattaatttttatacagaattaatttttgaagaatcaaatgacatatgtgcataaattatttatacatttttatacaattgcttcaacatttcctcttctctgcaatctggtatatctatataatttctatagataagagaagaaaaatatagcttattaaaattttattctgggttttgtaaggaataaaggacatttgtacccttatgaagattaaattttcttgtgttagtatatttctaaaggcttttagtgaattaaatggagacactttaatatactacacagttttaaatctaaatttttttctcaagraagaacttctgtttacacaatgatgcttaaacatgactgaaatatctaaaggagaggttaactggatcagtcaagaaaataatctgtaacatttgattgaagaaaatagcttagaagaagattttttaaaatgttcttttcctgtggagtctcccatgaaattcagattggataatctatagttactgagaaaggaatattcaaaataagagttgatcactgtagcacaaatgcaagtgataatttaaaaagtaaatataatttaacagatatgaaagtgaatcaaaagtcaagagtcttgtttcctcctgaaatatctatataagtacatgagatattttttccagactgagaggagcatgtgaactgatattgttgatgactttttctccattgagtatatcttttaaaatactcagtatttatcataatactctgcagattacaatgtacacattgttaatactacattgttaatttgccttttaaatacttaatatttacttttttcaaaggttatctttgtgtattttgtataaaattctactataatttattccatagctttgtagttttacattatttactgttatataatagaaagtggctaacatcagctaatgctgttttctaaatatttattatcattttcttatgtttttaaccattgtgtattaaaatatttcaaaattatcagtatgaaaactattaggcaaatagtctgggaaattgatttgtgtttcaacgatccaaatattagtgaaaagtcatgataatagagatagtaaaaatcttataagggaactggtaaatatatctttaaagattgtatcagaaacaattctrtgacaatatcttgtttctttacaagtttgaattccagaaatcaagtgaatttcctctgactttgcattttctggtaatttcttttttcttatcaagctatattttaaatgtaaaagtatccaacaatagaattgctaatctcttggtccctcttgtcttcacaggtaagggatattttgtaatatttaaggaattttatggagtatatatacaagcagaatgttagctatttcttcaatagaaaacttggtgatattttcttttgcccatatttattaagtgaagtttactaaattttctaggtcgtgttcaaatcataccatccagtaaacagttgggagattaaaaagtaattaaactaatataaagatagcctggttaataaaatgatattcttttcaacatgattatatttactggaacctaaacattttgtgaaatagtatgtcatatagacaatattaggattttgacttgttatgtaagtacaaaggtatgtattttacaatttttaataattgctttatcagtaatagcaacgtgaagaaatgctatctagatgcttctaatttgaaaatagtgcaaagacgatttaccaaagtcgttctattatgcttttgatttctagaaagctgaaatatccccattacagtttttgagtcaatacaaaaagtagataggtgttatagataaagaaataggttttcatcgatttgaaaattagamctccgagaagaaactcaggtaagaatgccattaaaatagttttagttgtttttgaaaataacatcaacaaaatgtcactattaaacagtgaaattggaataaaaatttgttttatgagtaacacggagatagcatacaaacattccattgactaatacagaaaaaactcaaaagttttaattagatatgtttaaatagagatgagraaagtcaaaactttaactcttaaaagttatttttatcagtttggaaatatataaactcctccctatataaaatacaccagcacaaatttctctagtaaggattggggtttcatgactttagatgtatttttctgtaatattttaatgacgcacttatattgacgcattttaagatagagtttaatgatatattttgactagagataagtgatttaaagaataagaatcatgtcattgaaagtgagaatacttgagaaatattgacgaatataagctaaataaagcaaaacaaaataaaacacttaccctttcatccacatgatgtcgctggacaccggaaggtttttctcccttcccagcctcaaaggaatacagtgagtagattttccttagacagaaagraaaagaaccttccatttttggctgtgccaagaagctcagaaaggygataatataaaaaatatatagttaattsggaattgaatttacaaaatacattgtgtggtgatgcaatagaaagytcataattggaacgagattgagatggtatattcccggagaggaagtctgggatcccggctcctgctgctctggcttctcytygcctactggaaggcagggagcggccagctccactactcgatcccggaggaagccaaacacggaaccttcgttggccgcatcgcgcaggacctagggctggagctggcggagctggtgccgcgcctgttccgggtggcgtccaagggccgcggggaccttctggaggtaaatctgcagaatggcattttgtttgtgaattctcggatcgaccgggaggagctgtgccggcggagggcggagtgcagcatccacctggaggtgatcgtggacaggccgctgcaggttttccatgtggaggtggcagtgaaggacatcaatgacaatccgcccaggttctccagacaagaacaaagattattcattttagagtcaagaatgccagattcgcggtttccgctagagggcgcgtcggatttggatattggagcaaatgcacaattgagatacaggttaaatccaaacgaatattttgacttagatgttaaaacaaatgaagaaraaacgaactttttagagctggttttgaggaaatccttagatagagaagaaacacaagaacaccgtttattagtgattgcaactgatggaggaaaacccgaactaacaggtacagttcagttgttgatcaatgtattggatgctaatgataacgccccagaatttgataaatccatttataatgtcagattgttggaaaatgcaccaagtgggrcattagttattaaactgaacgcctcagatgcagatgagggcatcaataaggaaatagtgtatttctttagtaatcttgttcttgacgatgtaaagtccaaatttataattaattctaatactggtgaaataaaagttaacggggaactggattatgaagactataactcatatgaaattaatattgatgccatggataaaagtacattcccattatcaggacactgtaaagtagtagtgaaactcctggatgtgaatgataataccccagagatggccataaccamccttttcctgcctgtcaaagaggacgctccactcagcacggtcattgctctgatcagcgtgtctgaccgtgactcaggtgccaacgggcaggtgacctgctccctaatgccccacgttcccttcaagctggtgtccaccttcaagaattactactcgttggtgctggacagygccctggaccgcgagagcgtgtcggtctatgagctggtggtgaccgcgcgrgacgggggctcgccttcgctgtgggccaccgccagcgtgtctgtggaagtggccgacgtgaacgacaaygctccggcgttcgcgcagccccagtataccgtgttcgtgaaggagaacaacccgccaggctgccacatcttcacggtgtctgcacgggacgcggacgcgcaggagaacgccctggtgtcctactcgctkgtggagcggcgggtgggcgagcgcccgctgtcgagttacgtttcggtgcacgcggagagcggcaaggtgtacgcgctgcagccgctggaccacgaggaagtggagctgctgcagttccaggtgagcgcgcgcgacgcgggcgtgccgcctctgggcagcaacgtgacgctgcaggtgttcgtgctggacgagaacgacaacgcgccggcgctgctggtgcctcgagtgggtggcaccggcggcgcagtgagcgagctggtgccgaggtcagtgggtgcgggccacgtggtggcgaaggtrcgcgcagtggaccctgattcgggctacaacgcttggctttcgtatgagctgcagccagcgcctggcagtgcgcgcatcccgttccgcgtggggctgtacacaggcgagatcagcacaacacgctctctggatgagaccgaagcaccgcgccaccgccttctggtgctggtgaaggaccatggagagcccccgctgacagccacagccacagtgctggtgtcgctggtggaaagtggccaggcgccgaaggcctcatcgcgggcgtcggcgggcgctgtgggtcccgaggctgycctggtggatgtcaacgtgtacctgatcatcgccatctgtgcggtgtccagcctgctggtgctcacgctgctgctgtacaccgcgctgcggtgctcggcgcagcccaccgaggccgtgtgcacacggggcaagcccactctgttgtgctccagcgcggtggggagctggtcgtactcgcagcagaggagacagagggtgtgctctggggaagctccacccaaaacagacctcatggccttcagtccaagccttcctcagggtcccacctctacagacaacgtgagttttctaatattaacatccatctttccctcccaattttcaaatattaaatgtcacattcacccactttttttgtatttaaaaattatgtcttagtacacaaatattgtggtacacaattattgcactaattcatgtattatatgctttttatgaggcttttctgctggggtaatagattcatcagctttctgtgatattaagtgtttttaaaataatattttatattagcatttgaattttgcatctctaaaaatgtaggataataattgtaagacatagtttggagtcattctcaaagtttcagtttatgactacatgaaaatttattttattttattgttattttttagagaccctttgttgcttagtctgcagtgatctgatcatagctcaccgaagcctgaaactcctgggctcaagtgatcctcctatctcagccgcccaagtagctggactacatgcacatgctaattaaagtttttttttttttttttttttttttttctgtagagataggggtcttgctactttgcccaggctggtcttgaactcctggtttgaagccatgctcccgtctcagcctcccgaagtactaagattacaggattgagcaagagtgcctggcctataaaaatgttttaacaccacccttccaattttgcctttttgtttctattgaatttaaattaattattattttattacactaatttagtttgttttcaattgtatttttgcagcatatggtttatttcaactttgcctaagcagttcacctgtatacccatgatgaatttgataattgtaatttaaaaattatatttttcattttattgattttttgaataggaaacacatatacatggtttactgttctaaaggtgcaaaagaatacagttaaattttccctttcacctccttcatgaagccagaacattctctggtatccttctagagatttttttcatatacaaataaacttccctacccccttaaaaaacatatgagtattgattttaatcttgcttttttcatttactaatgtatcttgatgatcatgaattatcattactgaagtagatttgtttttcttttatctggatctatggtgttccattgtgtaggtatgtgattggttatttttcccttaacattaacatttagtggaacaatgatttaattttctggaaatttgcatatttttcaatatatctaatatatattagatatataaatatctaaaatatctaatatatatctaatatattatatattttatataatatatataataaatatataataataatatatatcagatattttgatacagaattttgctcttgttgcccaaacgagtgcaatggtacaatcttggcctcccaggttcaagcgattctcctgccttatcttcccaagtagctgggattacaggcatgtgcccacacctggctaattttttgtatttactagagacggggtttcaccatgttggtcatggtggtctcgaactcctaatctcaggtgatttacccgcctcggcctcccaaagtgctgggattgcaggcatgagccatcgcgcctggcctaaattattatattgatgaggagtaactgtgaatctcctcagttgtgcaaattctactatattttggttgggaaattttactgcttgttgttacttttagattaaaaaaataaatataccatgatacaaactcccctcttgagttgtttacaaagagttgtttattaaagctgtatgtttgagactacgctagacaggtgtcctctccatctgaaataatgagaaccatttgtctactcttttgaggggaaaagtatggatttataggtagtaaatagtccacactttacatgataaaatgtgaattccctatttctgttgctttgcctgtttcttttattctcatatgcattcaattttataagtacccttctatcatgctatttatatattcctaatatcctgagctactttgaggaagtcctagaaattgagaaatagtttttgtcattctataaatctaaagttaacaatggtcacattttaaaaaatcaagttttgtgatataaactatttatatatctctttatatatcaagtctttatgtatattttgtgcagcttgtcttttttataggaacctcttgttttggggattgtttttggttaagaaattgaaccctttgtttgcccaaaataactgcaatagaaagtcagtgataagaactactaaatagatccaggttaattattttaagatagaatttcacatggaagaaaaggctttgtgtcacaatcatctgtgaggcattttactgtatatcagaattttggagtaaggtgaagatgatcatgtcatttgaaaagtcttattggtgactctatttttctcctttgaaggaggggtttaatcacttcaaatggataacattaaggttaaattaagggcgaagttgatatttggccctgacttttatatgaaggtaacatttttgcaagtaaattgtagacgtaattwaaaaaacccagctaaaacaaaggtggtattgagaaagaggaagagcaagtggtctatattgtcagaaaaataagattcatattggagagtaattgaaaataacctgcaaaaagttgattacctaacatgtgattacatattaggttactagaagtttctcaagtgtcttgcaatttctaggtttagtaaaattcaatgaaagctgtactcataaagataaatatgatagcatgtgaaagacagatggacttaggtggatgtggaataaggcaagccagggaaaaggagtaatttaaaaagtaatataggtgacatgggaaatgctcatgtcattaaaaatatgaatttaaaaatttgaatttggggattattaataattgctcatgccttgctatttaacaaactattttctaggagtcagcatgtataggtgaaagtgacaattagaaacatagaaagaagggatgcagatatggatttttaaatacctcaataaaagtcttattcaaaacttggaagtgagtgagaacaattaaaggaaaggatatgggacagggttgaagttgagagagaaaaacgagatcatttaggaacagctgaagaatcaaaaacagcaaagcacaatgggtagaaattccactagaatttgaagtggtgaagtatatgaaaagaaaatattttaagcaagaatcctaatataagctgcagataaattaaatgtgataaagaatatgctctagaattttatcttccatcattacacagaagaaccttaagagcatctgatatttattgaacaaagaaagcatggacttcaataatctataaggctttaaaaattcaaccaaaatttgataattttaagttacattttttccctagagcactatataatagcatgtcctaggaaagacagatgtgggcaagtttcttttctaccaagagtgtagaatagtttacatttctgatttaaaaagcagttccgttaacacttaaatttgctgaactggttgatattaatgttgcaaatattggtagaaaagttgtttagctgtgaataattagatcccttactttaaattaataaaagaagtcgggataacactgaccgtgcaaattacaaacgtgaggagggtttactataaaagtagagaaaagaagatactgttttaaaaatatatggtatagcactgttacgtgaattgatttcttaccttttggagccgcatgatgtcgctgtctaccatgaagttatagctagccaacattcaaatttcttctattactgcatcattccctgactgttgaatgatggcggacgcagaagaaatggattaataaattccggaacatacagtattttatctttatgcggaagatcttctaatggaaataaaaccagaggtatttgacatggtgtttaccccggaggatagattgggaaagcaatgtctgctcctcccgcttctgctcctcgcagcctggaaggtggggagcggccagctccactactccgtacccgaggaggccaaacacggcaccttcgtgggccggatcgcgcaggacctggggctggagctggcggagctggtgccgcgcctgttcaggatggcctccaaagaccgcgaggaccttctggaggtaaatctgcagaatggcattttgtttgtgaattctcggatcgaccgcgaggagctgtgcgggcggagcgcggagtgcagcatccacctggaggtgatcgtggacaggccgctgcaggttttccatgtggacgtggaggtgagggacattaacgacaacccgcccttgttcccggtagaggaacaaagagtgctgatttacgartctaggctgccagattctgtgtttccactggagggcgcgtccgatgcagatgttggctcaaattccatcttaacctataaactcagttctagcgaatacttcgggctagatgtgaaaataaacagtgatgacaataaacaaattgggctcttattaaagaaatccttggacagagaggaagctcctgcacacaacttattcctgacagccacagatgggggcaaacctgagctcacaggcactgttcagctgctggtcacagtgctggatgtgaatgataatgctcccactttcgaacagtctgaatacgaagtaagaatattcgaaaaygcagacaacggaacaacagttatcagactgaatgcttctgatcgggatgaaggagcsaatggggcaatttcatattcttttaatagccttgttgcagccatggttattgaccactttagcatagatcgaaatacgggagaaatagtgattcggggtaatttggattttgaacaagaaaacttatacaaaatcctcattgacgccacggacaaaggccatcctcccatggcgggtcattgcaccgttttagtgagaattttggataaaaatgataacgtccctgagatagcactgacttccttatccttgcctgtrcgtgaagacgctcaatttggtactgtcatcgccctaattagcgtgaacgacctcgattcaggtgccaacgggcaggtgamctgctcgctgacgcctcaygtccctttcaagctggtgtccaccttcaagaattactactcgttggtgctggacagygccctggaccgcgagagmgtgtcggcctatgagttggtggtaaccgcgcgggacgggggctcgccttcgctgtgggccaccgccagcttgtctgtggaggtggccgacatgaatgacaatgctccggcgttcgcgcagcccgagtacacagtgttcgtgaaggagaacaacccgccgggctgccacatcttcacggtgtctgcgcgagacgcggacgcgcaggagaacgcgctggtgtcctactcgctggtggagcggcgrgtgggcgagcgcgcgttgtcgagctacatttcggtgcacgcggagagcggcaaggtgtacgcgctgcagccgctggaccacgaggagctagagctgctgcagtttcaggtgagmgcgcgcgacgcgggcgtgccgcctctgggcagcaamgtgacgctgcaggtgttcgtgctggacgagaacgacaacgcgccggcgctgctggcgcctcgggtgggtggtactggtggtgcagtgagcgagctggtgccgcggtcastgggtgcaggccaagtggtggcgaaggtgcgcgcagtkgacgccgactcaggctacaacgcgtggctttcgtatgagctgcagcccccggcaagcagcgctcgcttcccgtttcgcgtggggctgtacacgggcgagatcagcaccactcgtgtcctggacgargcggactctccgcgccaccggctgctggtgctggtgaaagaccacggtgagccggcgctgacagcgacggccacggttctggtgtcgctggtggagagtggccaggctccaaaggcgtcatcacgggcgtcggtgggcgccgcgggcccagaggcggcgctggtggatgtcaacgtgtacctgatcatcgccatctgcgcggtatccagcctgctggtcctcacgctactgctgtacacagcgctgcggtgctcggcgccacccaccgagggcgcgtgcacggcggacaagcccacgctggtgtgctccagcgcagtggggagctggtcgtactcgcagcagaggcggcagagggtgtgctccggggagggcccacccaagatggatctcatggcctttagccccagcctttcaccttgtcctattatgatgggtaaggcggagaatcaggatttaaatgaagatcatgatgccaaagtaagtgaattttcataattaacagttaatttttattttaaatttataattgttttcctcatatttgtcttctatatttctgtttttaatttttaattaattttacaaaattacatattttcattttattgtgtttcttattttaatctctttgcttctttaatattcataatttaastgaaattagaaatcactgtccacaatctgcacctcagaatttttgtcttcaaaccaaaatattcttggatatgtcgttttctgttgcattttaattcagaatcatagtagcatttttttctgattaattatatgggattttcatttgtttgcctttgagctttaggataatttttttacatatactcttttttgatcatatattgaaatttgagcaccagtgtatcacttatgtttttacactttccatttcaatgtttttctgtcgacacttttattaagctaacgctttgattttatccattttgtgtaagaactctgatcatcatagtttttatctgtggttcccttttcagacttgtgattccrggaggcaatagtgttcatttattgtcccccttttaaaccattgaggaataaaggacaaaaacaatagttatcagcctgaatacttctggttgttatggttattgatttatttactaccgatctaaataatggaaaaatagtgaytcaacagaatttagaccttgtgatcaagtaaatttatatgaaaactgcattcctctggcattgcggctctcttatttctgtttgaatttcacttgatggtcttctcttcatggagtctaaatctatttctttgtattagtgttttcattgtttctacmcagtaatttaaactattcactattttgtatgtgtgtgtgtgtgtgtgtgacagggtcttgctctgtcacccatgctggagtacagtggtgcaataatggctcactgcaccctcgaatgcctgggctcaagtgattctctcacctcagcctctggagtagctgggactacacacgagcaccaccatgccccccaccttttttttttttttttttttaagagatggggtttctccatgttgcccaggctggtctcaaactactgggtgcaagtgatctgcccaccttggcctcccaaagtactaagattataggtgtgagccactatgcttggctagtcattatttctttgaatgaaaagcagcaaaaagtagtgattaagtgtgagttttggtgttatcctcccttgcctaaatttcatcgctaccaattttgttttgtggatggattgtttcacctctatttcagtttcttctgtaaagttggaatgataaacactagtttcaatgatagaattgtcataaagctttagtaagttgatattgtaaggcgcttataactgtgtttgccaaatagcaagtgcttaaaaaatttgctactagttttccgaagaggaaaagaaaaactttatgtcattttatgctaggaaactctcattacggattccatattgttttcattttacgtaaagattgaatttttgttattcatagtgaggccataattaccaatttaatctgagatgtctctaacattttaaatgccatgttctacattaaaagcaatttaaaatgtgtgtttcaaagttgaaaattgaattaagacttggacagtggaaaagttttatgaattcaaaagacatttaacctgctgagtcctcagtgatttcctggagttggttttgactttttgtgttgtccatgttcccaggaaatattagactacattaagcatgaatggtgtatttgcccacatttaaaagttgcttaagggccattagaggactgagttgtggtttgtgtttcctaatgtgagcattttccattcttgaaatggcagaaactggtagtggtattttctgttttctaaaagaagtacatgataatttttaagcgtgtaattaatattgcactaaaatttaaaaaaactaactctacatacttaagagtggcagaattgtctctgattatactgaagatcaccatttgtgtagctaatgatatctaacagcctcaaaacagcatactttcttaggaagtagagaactatagcgttgctagtgagtaaatgttttttaaaaagttcctaggagggtctttaagagtatcacactgtgcctgctgagaatcatcgaattaacaagacctggcttcaaatttaatagataaataaaggtaagtatcctrcataaatacgatgatagtaaaagcaagaatattgtaagaggtgctagaaaggtacatcatagtgttattggaattggaaaaaaatctttgcctttttcccttgttgaaggagaccgtgaagagtcatgatgttttactggttataaaatggaaagagttttccctgggagaatatggagactaacaggtattcatgagaagagagtaacttaagtgagtayacagaaaattccaaatgtacctagaaatgaggaatagtccactttgggtaaagcacatggttcccataagagagagtgtgatataaagcaagaaaagtaatatgagaaaaaccttttgtataactttgagtactagaygagtaattttgacactcttcaaagtcatttgaaagctgtcaaaaagtgtgaagcaatacgaataaaaagtattaacggaagatgactgcaaggattaaatgaaggagaatgaaataggaatggacaggttacacaataagaagctactgcaatacaccaggagagcagcaattataaaaacttatttaggaaagcatctgaatacagacataattattttacatgccattgggaacattggagtgaaacattccagaaaacgaacacagtaaggtagatccaaaaaggatgaaatacctcaagacttgatcaaagggctgctgtatgtgagatggctgagcactgaaatttatctaataaaataaacttacattttaaaagaaataatacaaatcatatttgagattgtaaaaataggcatatattcataacacacaagtgttcgaaaggatagaatgaggaaacaaatataaaatgatgaactcctgaaacagtatatatagattctgctaaagcaaaaaattcagaatacttcctcctcaaaaagttcacatgatacaaattcttccccttcaaagattccccaaaccttctcttattttgttttcccaagagaagtgtctggatagttgctaatgtttcttgcctcctaaaaagaaaacacacacacacacacaccgctttctaagtttctctttcatcaatcagtagattcttgagatcctgggtccctaaaagagtacaggatttttcttaacaagcgatactgaatcaagaatatgaagtttcctgggatctagatcaaaggaatttaaacttgcagttgtttaaattcatgttgtcacttaggtttctatctttatttaaaactgtgtgaaaaaaaagtttttctaaggcatgaggaagctacagttctggtaacactgagtattcaaaagccatcagtcgcctaagaatgcttctaacaatcatgagaaatgctattttaacctttaacaacaatgaagaaaaaaattcagagtttgaaataaaacttttcatctgattaatagtttgtaatggtttgtaattcttacttacatgatggccacatgatgtcgctctttaccgcaaattctttcrtaatcagcraaaggaagtcattccttttcgcactggaaagacgctccactctctttcactctttggatgcacaacaatggccacacatmgagattgaaatgaagggataaaaacattcctataaattcgaaggcaagttttgctgactagaaaaacaagccaataatttgaaatggtgtgcccgaatggatacgacccagggggccgacatctactgctgtttattataattctagcagcttgggaggcagggagaggccagctccactactcggtccccgaggaggctaaacatggcaacttcgtgggccgcatcgcgcaggacctggggctggagctggcggagctggtgccgcgcctgttccgggcggtgtgcaaattccgtggggatcttctggaggtaaatctgcagaatggcattttgtttgtgaattstcggatcgaccgcgaggagctgtgcsggcggagcgcggagtgcagcatccacctggaggtgatcgtrgaaaggccgctgcaggttttccatgtggacgtggaggtgarggacattaacgacaaccctccrgtgttcccagcgacacaaargaatctgttcatcgcggaatccaggccgcttgactctcggtttccactagagggcgcgtccgatgcagatatcggggagaacgccctgctcacttacagactgagccccaatgagtatttcttcctggacgtgccaaccagcaaccagcaggtaaaacctcttggacttgtattacggaaacttttagacagagaagaaactccggagcttcatttattgctcacggycaccgatggaggcaaacccgagctgactggcaccgttcaattactcatcacggtactggacaacaatgacaaygccccagtgttcgacagaaccctgtatacggtgaaattaccagaaaacgtttctatcggaacgctggtgattcaccccaatgcctcagatttagacgaaggyttgaatggggatattatttactccttctccagtgatgtttctccagatataaaatccaagttccacatggaccccttaagtggggcaatcacagtgataggacatatggattttgaagaaagtagagcacacaagatcccagtcgaggctgtcgataaaggcttcccacccctggctggtcattgtacagttcttgtggaagttgtggatrtaaatgacaatgctccacagttgactctcacttccctgtctctccctattccagaggacgcccaaccaggtaccgtcatcacattgattagcgtgtttgaccgagattttggagtcaacggacaggttacctgctccctgacgccccgcgttcccttcaagttggtgtccaccttcaagaattactattcattggtgctggacagcgctctggaccgcgagagtgtgtccgcctatgagctggtggttaccgcgcgggacgggggctcgccttctctgtgggccactgctagcgtgtccgtggaggtggccgacgtgaacgacaacgccccggcgttcgcgcagcccgagtatacggtgttcgtgaaggagaacaacccgccgggctgccacatcttcactgtgtcggcgggggacgcggacgcgcagaagaacgcgctggtgtcctactcgctggtggagctgcgggtgggcgagcgcgcgctgtcgagctacgtgtcagtgcacgcggagagcggcaaggtgtacgcgctgcagccgytggaccacgaggagctggagctgttgcagttccaggtgagcgcgcgcgatgcgggcgtgccgcctctgggcagcaacgtgacgctgcaggtgttcgtgctggacgagaacgacaacgcgccggcactgctggcgcctcgggtgggtggcactggtggcgcagtgagagagcttgtgccgcggtctgtgggcgcgggccatgtggtggcgaaggtacgtgcagttgacgctgactcaggctacaacgcgtggctttcgtatgagttgcaaccggtggcggccggtgcgagcatcccgttccgcgtggggctgtacactggtgagatcagcacgacacgagccctagatgagacggacgcaccgcgccaccgccttctggtgcttgtgaaggaccacggggagccctcgctgacagccacagscaccgtgctggtgtcgctggtggaaagcggccaggcaccaaaggcgtcgtcgcgggcatcgttgggcattgcaggcccagagaccragctggtggatgtcaacgtgtacctgatcatcgccatctgcgcggtgtccagtctgttggtgcttaccctgctgctgtacacrgcgttgcggtgctcagcgccgtcctctgagggcgcatgtagtttggtaaagcccactctggtgtgctccagcgcggtggggagctggtcattctcccagcagaggcggcagagggtgtgctctggggagggcccacccaagacagacctcatggccttcagtcccagccttcctcagggtccatcctctacagacaatgtgagtcataaataatcttgtttccaacaattttaaaacaattagttcaattggtctccttaaattttctttcataatttcttttttagttgatagctttatgtataattattattttttaatgttatgctgtatttgcactaattatttggaagtacgtttaatatacacttttgttttgggatgcgtaatactatagatcaaaatctatggtttatgttggctactctycatttttggaggaggactttgctaactggagcaatggattcacctttcttctatagtgtatttacaaaatcaaatatttacatttccatattttgataatcaatacctataaatgttatagtaaacaaatttaatatatatgttacctaatattttattctatgtattgtcctcattttataaaatatasctgtgtcaaaatcatctgttcaattttgcctttttatctttagtctagaacttgaattttaagcatttcttttacatctatttatcttctttttatcatatttgtgtagcactgacttctttttaacttactttgttgaratgtatttgccatgttcatgaagaattaatatgaacaatttaaaatagtttaaatggcagtttaatagtattttttattttgttccttgtttgtataagaaatatattcacattcaaaatttcaaagagtgaaatctagtacgtagtaaaaaatctccttgcctcctcaaaccccaaaccatttactttacctttctgaatttctgaagcagtttacgtttttttgtatattcccaagattattattgccaaattatataaatatatttacaatcaccaaattgtaaatcgccaatatatatattttataatttgccccttccttccttccttcctttctttctttctttcttcctttttctttcattctttttcttttttctttcttctttcaagacacgctctcactccatcacccaggctgctgaaatgcagtggtgggattatagcccactgcaacctgaaagtcctgggctcacaggatcctcccatctcagcctctggagtagctgggaatacagtttgcatgtcattgtgcctggctaattttattttatttttgtagagacagggtggagtcttgtttcccaggctggtcttgaactcctggcttcaagcgatcctcctaccttggcctcccaaagtattgggattacagacacgaacaaccacacccagcctgcctttcatctttccttttttttaaaaaaagaagtgattacagtagaaacctacctttctgcactttttggttttccactttaagttatattatatagtgtgtgtgtgtgtgtgtgtgtgtgtgtgtgtgtgtgtgtgtgtgtgtgtgtttgacagagttttactctgtcgccctctctggagtgcagtggtgcaatctcagctcactgcaaaatccgcctctctggtacaagcagttctcatgcctcagtctcccaagtagctgggattaaagacgccaacaaccaagccatgctaattttttttttttttttgtatttttagtagaaacagagtttcaccatgttgccccggctggtctcgaaatctgggactcaagtgatctgactgcctcagcctcccaatgtgctgggattacaggagtgagccaccgcatccggcctaaattatatattgggttttgtggcatattatttcattagcgcttattccttgtttttgattatttgctttcttatttttaaaagtatttgcatcttattttcttttatggatatatcatgatttattcatccagtactgtattagggacattaatgaaacaataaccgaattgtctagacttttaaaaattttttacaaataatttggttggtcaaaaaaatgatagttaacggggcatggtggcacacacctttaaccccaacatttcgggaggccgaggcaggaggattgcttcagtctagtagtttgagaccagcttrtgcatcttttgtagagactttgtaaaattagctatgcatggtgatgcatgtctgtagtttcagctactcaagaaactgaggtgggaggatcacttaagccagggaggtccaagctgcagttatcatgccactgaactccagcctaggtgacagagcaataccttgcctcaaaaataaaataaaatgaaataataaaataaaataaaataaaaacccagaactgacaattttcactgttcctaatattctaatatactttagtaaattattttaggatatgttactgttttcttttcaacgtgaataaggatagaggtatgcaaagtcaaaaacctgtctgataatcaatagaattatttaccattaagccataatatgtcattcacataagcagaccaagtttgctgctcttgttgaaagaatattcagttttgtggaaaaatctataaatatctttgaccttcaaagatggtaactgtaatctgtttttattgctttgyttttatgcttacatgcatgtatatttaaaaccttcctagcatattattaaagttttaaatatcctatttatattgggaaatacctgaagttgataggggatcctccttagccacctaagctgtattcatcaattattatgatgatgatgattattatttttgagacagggtctcactctgtagcccagactgcagtgcagtggcacaatctgggcttactgcaatctctgcctcctgggctcaagtgatcttcctacctcagcctctcaagttgctgggactataggcacacaccaccatgcccaactaatttttgtattttttgtagagatggggtcttaccatgttgcccaggctggtctcaaactcytgagatatcgagaaatactattttctttacaaattgtttgctactatttagagtcaactacagagatttttttgggtaaataatgtgatgacaaatttaaatcatttcacagaaaatacccttattygcctttcctatttaacctacgtttttggtaagaattttgtagaaatttggaggagctcttaattgcctactatgaaggcattcatgatgaatccatggagaatttacttttgaggtggactttgaaagatgaatagaattttgacagaaaaagatgaagtaatagaagaaaaaccttgaacaaagagtgtgccaagaaggagacaacatattttctgtaaaatatgactcctattggaaagtggttagccttagcactgagaagattggctcatggtcacgtagcgtatctcccagatggaagtctaatgtcttgacaattagtcaatagaaagataaacttgttgaagattttagtgaaatcgagtgaaagctgtactaataaggacagaaattatcacacgtgaaaggagagatgggatgtatacaaattttaaatatggtaggcaaaggaaaagaagtcataaaaatacatatgagtaaatgtggagaatcactatgctataaaaattgtgattttttaatgatttgggttttgggtgattattgattagatattcttttaactttggtcgactcattttctaggcaatgttagggtatacaggtaaaaatgtcaggtagaaaatgaaaatagggggttgcagatatggagttaagaatacttcaaataataggctagtttaaagccgtggaaatagaaacgttaaataaaaagttggggaaaaaagtttaaaggcataattctggtaaatactcactttttggagcagaagaaagatgaagaactaacaagccaatgatggcaatactgctagagtttggcatgtcagagaaatcataaaggaaaatgttttaagtgagaggctgaatttaacaagctatagagatatagagaaatagtgtaaagaatatgcacatacatttttattactttagtaaataaaacggttcaggcaatttgacatttattgaataaagaaaagcaaaaatttaacaataagaacacaagaagataaaatgtagaaaagttagaattatatgctcacctcagagtaatatataccagtgtttctggtgaccaaataaatattaatgcatttcttccacacgaaactatggaggacagtttacatttctgatatccatgacatacaggtcatacttaaatttattattaattgatacgatatttgaaatattgggaagaaattcctttccttatgaagaagaaatccctagctgaaactaatgtaaggagccagacagtatgaatgcctctgcaattgataaagttaaggatttactattaaattatgataaagaaatagaaagtgcatagaagaacccagatattgcggaagtaattcatgtaatcattaccttttgaagccacatgatgtcgctgtctaccaagaagttctggttggtcaatgttcaaagtcttttctctgacagcatctgtctctaaaggccgaacaacgggagatgcagcggaattggattaaaagactctgaaagtacagtcgttcatcttyatattaagataatattttctgataggaaacgactatttaacatggattatcactggcgaggagagctgrgatcctggcgactactactcttgcttctgctcctcgcagcctggaaggtggggagcggccagctccactactccgtccccgaggaggccaaacacggcaccttcgtgggccggatcgcgcaggacctggggctggagctggcggagctggtgccgcgcctgttscgggtggcgtccaaaagacaccgggaccttctggaggtaartctgcagaatggcattttgtttgtgaattctcggatcgaccgcgaggagctgtgcgggcggagcgcggagtgcagcatccacctggaggtgatcgtggacaggccgctgcaggttttccatgtggacgtggaggtgaaggatgttaatgacaacccgccagtgttccgggtaaaagaccaaaagctgtttgtttcagaatccagaatgccagactctcggtttccgctagagggcgcgtccgatgcagatgttggakctaactccgtgttaacctacaggcttagctctcatgattacttcatgctagatgtgaattcaaagaacgatgagaataaactggttgagctcktattaagaaaatccttggacagagaggacgctcctgcgcaccacttattcctgacagccacagatgggggcaaacctgagctcacaggcactgttcagctgctggtcacagtgctggatgtgaatgataatgctcccactttcgaacagtctgaatacgaagtaagaatattcgaaaacgcagacaacggaacaacagttatcaractgaatgcttctgatcsggatgaaggagccaatggggcaatttcatattcttttaatagccttgttgaaactatggttattgaccactttagcatagatcgaaatacgggagaaatagtgattcggggtaatttggattttgaacaagaaaacttatacaaaatcctcattgacgccacggacaaaggccatcctcccatggcgggtcattgcaccgttttagtgagaattttggataaaaatgataacgtccctgagatagcactgacttccttatccttgcctgtacgtgaagacgctcaatttggtactgtcatcgccctaattagcgtgaacgacctcgattcaggtgccaacgggcaggtgamctgctcsctgatgccccaygtccccttcaagctggtgtccaccttcaagaattactactcgttggtgctggacagcgccctggaccgcgagagcgtgtcggcctatgagttggtggtaaccgcgcgggacgggggctcgccttcgctgtgggccaccgccagcttgtctgtggaggtggccgacgtgaacgacaatgctccggcgttcgcgcagcccgagtacacggtgttcgtgaaggagaacaacccgccgggctgccacatcttcacggtgtcwgcgygrgaygcggacgcgcaggagaacgcgctggtgtcctactcgctkgtggagcggcgggtgggcgagcgckcgytgtcgagctacrtktcggtgcacrcggagagcggcaaggtgtackcgctgcagccgctggaccacgaggagctrgagctgctgcagttccaggtgagcgcgcgcgacgcgggcgtgcmgcctctgggcagcaacgtgacgctgcaggtgttcgtgctggacgagaaygacaacgcgccggcactgctggagcctcgggtgggtggcaytggtggcgcagcgagcragctggtgccgcggtctgtgggcgcgggccacgtggtagcgaaggtgcgcgcagtggacgcsgactcgggctacaacgcgtggctttcgtatgagcwgcagccagctgcaagcagccctcgcatcccgttccgcgtggggctgtacacgggmgagatcagcaccactcgtgtcctggacgaagyggactctccgcgccaccgtctgctggtsctggtgaaggatcatggtgaacctgcgctgaccgccacggccacggttctggtgtcgctggtggagagcggccaggctccaaaagcgtcatcgaggcagtcggctggcgttttgggtccggaagcggcrctggtggatgtcaacgtgtacctgatcatcgccatctgcgcggtatccagcctgctggtgctcacgctgctgctgtacactgckctgcggtgctcagcactgcccactgagggcgggtgccgggcgggcaagcccactctggtgtgctccagtgcggtggggagctggtcatactcgcaacaacagccgcagagggtgtgctctggtgaggggccaccgaagacggacctcatggccttcagcccctgccttcctcctgatctgggatcagttgatgtaggcgaagagcaagatttaaatgttgatcatggcctcaaagtaagtccatttaaatttagaactcataaattctatttgtggaaattgtagttactttaaaagtgtttcagatttagtttttcaccgtattttatagtgaaaatttaaacattgtttagtttttagaaaccttttataattaattgaattttctcagtggcataatacagtattaatcattctccacaagttgggtctatcttgaaactcaagttatggttggatgatatccattttttactgaatatttattttggcctgccttacagccgtcttctctgaacaatactctaaggacgttcagggcattttgatctttggtgaaagtattcccccaaagcgtttattcttttgtccttaggcactgaactcttaatcttactccatatgctgtactttgaaatgcatgttttaaatatgttgtctttatatttacttttattcactttaagatctcggtttattcatcttatctgactttttagtgtctggtagtcacaaatatctttggtgtttcactattgccgttttaagcagtgtagtgataaaatacagaatgatagtgtttttcaaaatttgatagttttcatattcttcctaattttattataaactagttaaaaagtaaaatcaagagggaagagatttgtaatccttcttttaattcattatttagaccattttaccatttggagacatgttttttattctacatgatttttacagttgtattgtcgccaacttaacattttttgagcctctatgtttaggaaatgattactttattcttgcaagtatcttctaaactctaatcattcaaccctttgttcatgagttggaatattttcaataatattccacattaaagtgatatttaatatatgacttagaaaaatgttttcatcagaaaaactatacatgataatttcattcttgcaaaccaaacatataatttataaatccttattatacagaatatttgggattatcatggcccattagttcgtgtaaaaatatttagtattatgggataaatctttgaaaaatccaagatactttattttggtatctttcaacattttctttcttttatttcttcttgtctttttacacgtttgcttcttgtgactgttggacctgcctggatattaaatacccattagacttcgtgcatattgctttggagagaatggtagaaattgatggaagggaatgaacgatttctgggactctgaattcttacagtttgttattagtattgttttaaatcttttaatcacttatgaacaaataatgtaatcatttatgggcatattttagcccccttgtccaactgaaggtaacctcaaagcagcattgttttgtagtttattttacagttctcttaatgcctgtccatgtttagcattttatttgactatttgaacacattgtgtaaaagcgaattgttttcattttagtcctttaaaaaatatgattgttttcatttaagtccttttaaaaaatatgattatctttattatcctgtttgaataatatgtgttttcctttgtgaaagtaatatttcctatcctgtctatgtctacctggttctcaggtattactttaattactgaattctcctaaacatttaattgacttttacaaaatatcataaataggaggattctttccaccacctagcattgtatttggcaatttatcatttaagtcattttagttctgtttttcttcaactctctgatatttgaatttggggttgtgctttcacagtgagaaagtctaaacctatttcttgtacattaatacttttcactattctaattatggtgatgcytttagctattaagaatttctgggattgaaatgtgtcagaagttagttattargtattgtggattctgaagctctctaaatcaagtcctccctttaccaatttttgtatgtgtagccattggtaaaggatttgttattcagttccttggcattatatgtatgcatgataaatgtgaattctactttatagatttatttgtatcaagtaagttaatagttataaattattaataataaactctggcaagtgataggtacataataaaatttagttattaccattcttaagagaaaagaagttagtgattgcagaaaggcaacctaaaatgtcagaaagtcgttatggccttccatattaatcttatttttgtgtaaaactatcttctgtaaagtcattttttagattaacctaggatgtttcaatattttgaatgttgtgtggtggaatgaaaaaaatctaaaagttattacgagtttaggaaagtcaagttaacaccacctatgtgggaaaacagttttttggaaaggttaaagtccttccaaggaatgtgtagactatcttactttgatagttgtatgtttcccatatttaaaagttgcctgagatcctgcagaggcctgagtaggcgtttgagttctttgtatgtatgagatctttccattaatagtatttttcttaaaaagaagtatacaataatgttttgatgatgatttaaagtcaatttatgttgtagttctatgaattaagtaaaccatttatgtagagtgttgtaaatagccttttaaagtgctttctcttttttcttttcttttctttctttttttttttttttttttttgagacggagtctcgctctatctcccaggctggaatgcagtggcgcaatctcggctcactgcaacctctgcctcccgggttcaaatgattctccttcctcagcctcccaagtagctgggattacaggtgcatgccaccatgccctgctaattttttgtatttttagtagagtcggggtttcaccatgttagccaggatggtctcgatctcctgacctcctgatccgcccacttcggcctcctaaagtgctgggattacaggcatgagccaccgcgcccagcctaaaatgctttcttagcaagtagagaagattgtaataaccagtcttcattaaacattaaataggacccttacagatctctaacagcatatcatcatgtcaggaattattactgagccccagcccctggctttaaaatttgaggtcaaataaagaatatgagtcacacaatgcaaggcaagataatgtaacaggtacaagaggtaaatcagaatgacgttgaagttgaaagacaatcatttcctatttgaatttttgaagaaatacttgaaggggcatggtgtgtttcagtggttttaaaataagtaagttccccccgggagaatattgagaatgatagacatttcttggaaagagaaaacataaggaaagttgaagacacagaaagcatcaatatgacaagtagaaaagtccactttggttaaaacacacagtctgcagagaatgaaagcaggaaaaccaatgtaagaagatctcttgatttctgagtaataaactaaagggccatgagtgattaaggaatttggccactctttagaattaattgggagctatttaactaccttgagcaaaataaatcacgacttttgaaagaaggttgaacgggaagacaaactcagaagctcctgcagtaatcaaggacagaagcaattgttaaatgcacctcttaggctgttatcagtagaaatacgaaataaaagataaatatgcaaaaacattaatggcacaataaacactcacggttttgcctttagacttgagatacactaaaatctagatttaattaatcgacttggacgttggaataagatagtaaaactcacaacaaaactttgtagaacttagtcaggaaaagaatctcaagcatagctttaaaaacagaaattgccccgagtactaaggatgagcaataatgaaattaaaacatattgtaataacattacacaaactatattggagaytacaaagaagagattattcatagattataaagcttggaaagaatcaaaacaacacatttctggaaacagattgtataaatgctacaaaagagaaaaatatattttctccccacgcaacacaagaccttaaagtcaattctcgcttttcttgcaatattttataccttttcaattcatagaattactcaagaaaactacctcagttggttgctactttttgttgattccttttaccagacatgactaagtttctttttcatcagtagatttctgggctcctatattcactagagattgcaactcctggatttctcttacactagaatcctatttcgagccatatgggagattctgaattccagaacaaaagaattttgtaatttaaaattcgtgattgctcaatggaatcattttaattgttacttcatttctgtcgttatttaaaacttaagtggagagttttctcagggataagaaaaccacaatcaaggtcatacaaaacttttagaggcagtcagtctgctaagaaggctccagcaagagaaacgggatcttctgtttcaacaatcattacttaagaaaaaattaagaaaatgaaataagttttgcagaataactgtgaaatttttattcatgaaatatgtacttacactttggrccacgtgatgtcactctttgscgcgatgttctctctgaatccagacaaatacagcccttttcccatgggaaagaggctcaattctttttcactctytctgtgctgaacgatggckaacacagmagaatgggactgacgaaatcagatgatttcttctaatttggaggcaattttcactaattagaagaagactgagtatttgaaatgttatactcaagtcgaggagatccagagggtcagcctctactgctctcgcttctgatcctcgcaatgtgggtggtggggagmggccagctccactactcsgtcccsgaggargccraacayggcamcttcgtgggccgcatcgcgcaggacctggggctggagctggcggagctggtgccgcgcctgttscagttggattscaaakgccgyggggaycttctggaggtaaatctgcagaatggcattttgtttgtgaattctcggatcgaccgcgaggagctgtgcgggcggagcgcggagtgcagcatccacctggaggtgatcgtrgamaggccgctgcaggttttccatgtggacgtggaggtgaaggacattaacgacaaccctccrgtgttcccagcgacacaaaagaatctgttcatcgcggaatccaggccgcttgactctcggtttccactagagggcgcgtccgatgcagatatcggggagaacgccctgctcacttacagactgagccccaatgagtatttcttcctggacgtgccaaccagcaaccagcaggtaaaacctcttggacttgtattacggaaacttttagacagagaagaaactccggagcttcatttattgctcacggccaccgatggaggcaaacccgagctgactggcaccgttcaattactcatcacggtactggacaacaatgacaatgccccagtgttcgacagaaccctgtatacggtgaaattaccagaaaacgtttctatcggaacgctggtgattcaccccaatgcctcagatttagacgaaggcttgaatggggatattatttactccttctccagtgatgtttctccagatataaaatccaagttccacatggaccccttaagtggggcaatcacagtgataggacatatggattttgaagaaagtagagcacacaagatcccagtcgaggctgtcgataaaggcttcccacccctggctggtcattgtacasttcttgtggaagttgtggatgtaaatgacaatgctccacagttgactatcaaaacgctctcggttcctgtaaaagaggacgcacaactggggacagttattgccctgattagtgtgatcgacctagacgcagatgccaacgggcaggtkacctgctccctgacgccccacgtccccttcaagctggtgtccacctacaagaattactactcgttggtgctggacagagcyctggaccgcgagagtgtgtccgcctaygagctggtggttaccgcgcgggacsggggctcgccttcactgtgggccacggccagggtgtctgtggaggtggccgacgtgaacgacaacgcaccagcgttcgcgcagtccgagtacacggtgttcgtgaaggagaacaacccgccgggctgccacatcttcackgtgtctgcgcgggacgckgacgcgcaggagaacgccctggtgtcctactcgctggtggagcggcggktgggcsagcgctcgctgtcgagctacgtgtcagtgcacgcggagagcggcaaggtgtacgcgctgcagccgttggaccacgaggagctggagctgctacagttccaggtgagcgcgcgcgacgcgggcgtgccgcctctgggcagcaacgtgacgctgcaggtgttcgtgctggacgagaacgacaatgcgccggcgctgctgacacctcggatgaggggcactgacggcgcagtgagcgagatggtgctgcggtcggtgggcgccggcgtagtggtggggaaggtgcgcgcagtggacgccgactcgggctacaacgcgtggctttcatacgagctgcagccagaaacsgccagcgcgagcatcccgttccgcgtggggctgtacacgggcgagatcagcacaacgcgtgccctggacgaaacggacgcaccgcgccagcgcctactggtgctggtgaaagaccacggggagccagcgctgacggccacggccactgtgctggtgtcgctggtggagagcggccaggcgccaaagtcatcgtcgcrggcgtcagtgggtgccacgggccccgaggtgacgctggtggatgtcaacgtgtacctgatcatcgccatctgcgcggtgtctagcctgttggttctcacgctgctgctgtacactgtgctgcggtgctcggcgatgcccaccgagggcgagtgcgcgcctggcaagccgacgctggtgtgttctagcgcggtggggagttggtcgtactcgcagcagaggaggcagagggtgtgctctggcgagggtmmgcagaagaccgacctcatggccttcagcccgggcctttctccttgtgctggatctacagagcgaacgggagaaccctctgcttcctcagattcaactgggaaggtgggtttttctagcattttatttatttatataattttttttcttgaaagatattatcrattactcccaggggccgttcaaatagttttattcatttttctagaaatccagcagattttttttctgataaagtaaaccccttaacattggagccgactttgtcttgacttctagtgagaattataaactgtatattaaatagatattttttgggtgctgaatcaattttatttaaatttgtgattaaagtgacattgaatttctgatgctatgctgccataacacttgaaaaccaatttagttgttagtcattcattaaacattaacatcactatcatttatttattgctaaatgatgcatagtattttagtctacttgtattgtttataagaaacccaagcaaaaatatatagcaattgttaccttgttaagtttgtagttctctacatttctctggatggagactgtgaacatctgattgttcagcaaccttcagtatctattattttaataagaaagaaacttcccctaaactttagaaaacagttgctccactttaggaatcaaattatgtcaataaatgttataaacacagccttcatttcaacttatataaaatatgttttaaaatgcctgacaatgtagataattcaagaaatgttgactgaaattttgtctacacttagaacattttttgaaattcagtttacagaaattggagaaaatgctttttaaacaagtgtttcctttcttcaagaagayattctccttttaatygaaattttctccattcagtgataaaatgatcagccatgtgaagattcgaaacttcgagttcttttgaaattcagagtctgtaacttaaaacattacccttatgaatttagatgagaattcacttgttctgtcagtaatccataagacagaaatctgtttttttaaaaatatctttttctcctctcagctcatacataacacaaggcagaaatctggatatgagatttgcctctttaatgtcactacatgttatgtttcctgaattgtagtatgtgactttcaaaatggtggttttccacactctacctttagtgcaagctatttgtttgttttctaatttatagttttaaaaacttcgcttattgagtttttgttatgtggtttatatttttctttctctttcagctattttatttaatattgtgtcagatattttacaaggtatgacctaattaaaaactcagtagagaaagatcagaatggccttgagaatagagccacaaaaataactatgaaaatgccagtaacgtttatttaaaacaaaatattttaatttttaaattttcccttaaaacacacttttggaatatgctacaatattacatgttttttgtctttttatttttctgagacggagtcgttttctgccacccaggctggagtacagtggcatgatcttggctcactgcaacgtctgcctcctgggttcaagcaattctcctgcctcagcctcctgagtagctgggattataggcacatgccaccgcgcccagctaatttttgtatttttagtagagatggggtttcatcatgttggccaggttggtctcgaactcctgaccttgtgatgctcccacctcggcctcccaaagtgctgggattaaagctgtgagccactgtgccaaggcttttttattttttttttttgtcattttctttcaaaacttgagtggtctctgagctcctgtcattaaacctatctatatctgtctatcagcacaactcaccttgaatatagtcttatactttcaagtatctttgtctttgcacgtttttcaagtttcatgtgccatttaaacttggacccaggtatctgattatttgatgtgaatagagggatgctacagatgtcatttgtctcccgccctaagtcctccagtctccttagagctagtacttactaagcatttactatgtcatcaataatcataaaacgtatttttttttttgagtcagagtctcgctctgttgcccaggctggagtgcagtggtgccatcttggctcactccaagctccccctcccgtgttcacgccattctcctgcctcagcctcccgagtagctgggactacaggcgcctgccaccatgcccgcctaatttttttgtatttttagtagagatggggtttcaccgtgttagtcaggatggtctcgatctcctgacctcatgatcctcccgcctcagcctcccaaaatgctgggattacaggcgtgagccaccgcgcctggcctaaaatgtgttctttattattgacggctgtattgatgggattggtaatttagtccttcatattaatctctattctctctcagagtacaagctctcatcatatgcaaattctcagaagggctgtgaacaccttagtaataaatttatcttttgaggtcattagcaaacatgaactcacagggatccasagatggtaaaattcaaaacagcctgtcaagttcaaaacagagaggtgaaagcagaagagacactttcctattttgcctaataggtctccttatatgcatctgtagttaacattcctcaattcaagttagaatcatgaaacaataatgaagctcctcctatgtctcttttcaagttgtaattactatataggaaaaactaagttgtcacccaatatcttagacactttgagagcaaagggggtgctgtaaataagtatacaagatcacagacctaaattgagcctgttccagacaaattggggcctatggtcaacctatccttagacctgctaacgcattagcattagcagcacctaagtcctcattgaatgttctggttcaaggctccacctcagaaattctgaaatgggtagtaagagcaaattttcattttaaagcacacctgagatgattctcatacaaccgaaattttagatccatagccctatttgatacttgacagtgcaagtttctgtaatttaaaaagatgtggtggcctgacacctgcaatcccaacattttgggaggccaaggtgggagggtcccttccttgagcccagcagtttgagaccaatgtagtgagactcatctctgccaaaaaaaaaaaattagccgggcatggtggcacacatctctagtcccaattactcaggaggctgaggcgagagaatcgcttgagcctgggacattgaggctgcagtgaactgtgatggcacaactgcatttcagcccgggwgacagcaagattctgtctcaaaaaaaaaaaaaaaaaaaagagtagtttaactactccctactttttattcaatattggacatctacattgggatatttatgttatcacttggtataaaatgtacattagtagaaattgagtttagtttttattattttgtgcgtggagatgattgatcaatggcaaacttattttacgctccagatagctaaaacaaacrttgatattttgatacataactcattacattttamttcagggtttataaaaaagtaatctctaaaatcagaatttgaatgaattttgatgcaagaggcattccagaggagtagagaagtatagaaacagaatttagtaggacacataaactgatggattaagtgacacccatttctgtcagttttcttattcataaatattgttgctctgtcattcagattttaataaaaaaagtttaaagtaattgacacatttaaaaatattctttagaaaagtcaaaacatcattaaataaaataaattaacccttgcataagaccaatatgtctgttgttaagttttcctttcttggaaagacagaaaactcaagtttttttcagcagcacagatatattacattttcattcctgaatatttgatttcaagaactttgagagagaaaaaaatatttttactgcaagtggtgatgaaaaacttcactgacattgataaaattactagatatatttcagaactgtgtcttttgggcatttgaaaagcgtaaatataacagggttgaaagcatttgcctctgaaagcagaaataataaatttcttaattactttattcagaattataattaagattctttttgcccgtgtaagatattataaaatgaaacttcttgtataaaggatttttctgtaatagtacttttctgttttcttaaatacagaaaccaccactctcagcctgtgcagtagcaataattaaggcattctataggtaataattttgcctgatgagccaaatttggtattgagcctcatgaaaacaaatgtggccaaattgaggcctgagaatagtttccatttatgaagcactcattctccttaaggtactattgcaagcacttactatattataattcactcaaccaccrtattactattaggccaaagttataaaattggaacatgagggagggagaggttaaacgattttcccaagtcatgtggctagtgagtaggataataggaatctaaatggagaaatgtctgatgttgaagctaatgatctctaaattctagtgatgactagatcttcggagttataaacacctcacagatagttgatgcttgacattagtgtctarataaaccttattaaatctcaaaataatgagaaagagaagtaagttaagtgtcagaacttaaatggaactaaagttgtcatttaataaaatattagtatactcagtagtatgcaaatattaagggcattttgaaattcggctattgataatcatgtggttagggaagaaatcactactctgagagtctacatttaagaaaacattgcacgtgggatcaacatttattgttattaactataaagagacgtaatgtgaggctttgaaagtccatagacataaaaatacgtaaaaaaagaattaacatatgaatgaaagaaaagttgtgaactcatggaatcgtacttacacctaaagccaccggatgtcgctgtcgtccacaaaatagctttttagaacaaaggcatcagccagtttctcaaggactaggaagtagcgtcattctgagatctcagccatttcgayaaaaaatagatataagaaataggacagaaaatgtcagatcgtatgtgcgttctagaccgctgattcgtcgatttgtaaaacaagagaaggataagatggtttccagatgtagctgcctgggggtccagtgtctgctgctctcgcttcttctcctcgcagcctgggaggtggggagcggccagctccactactcagtctacgaggaggccagacacggcaccytcgtgggccgcatcgcgcaggacctggggctggagctggcggagctggtgcagcgcctgttccgggtggcgtccaaaagacacggggaccttctggaggtaaatctgcagaatggcattttgtttgtgaattctcggattgaccgcgaggagctgtgcgggcggagcgtggagtgcagcatccacctggaggtgatcgtggacaggccgctgcaggttttccatgtggacgtggaagtgaaggacattaacgacaacccgcccaggttctccgtaacagaacaaaagctctcaatacctgaatccagactgcttgactctcgatttccactagaaggcgcatctgatgcggatgttggagagaacgcattgcttacttacaaactcagtccaaatgagtattttgttcttgatattataaacaaaaaagacaaagacaaattcccagtgcttgttctgcggaagctgctggatcgtgaagaaaatyctcagctaaagttgttgttgacagcaactgatggaggcaaacctgaatttaccggatctgtttctctgctgatcctggtgttagatgccaatgataacgcccctatctttgacagaccggtttatgaagttaagatgtatgaaaatcaagtgaaccaaacattagtaatacggctcaacgcttctgattcggatgaaggaataaacaaggaaatgatgtattcatttagctctttggtcccacccacgataagaaggaaattttggataaacgaaaggacgggagaaataaaagtaaatgatgctattgactttgaggacagtaacacttatgaaattcatgtagatgttacagataagggaaacccacctatggttggtcactgcacggtcctagtggaactactggatgaaaatgataattcacctgaggtgattgtcacttctctgtctctcccagtgaaagaagatgctcaagtgggcaccgtcattgccctaatcagcgtttctgaccatgattcaggagccaacggacaggtcacctgctctctgacgcctcacgttccgttcaagctggtgtccacctacaagaattactactcattggtgctggacagcgctctggaccgcgagagggtgtcggcctatgagctggtggtgaccgcgcgggacgggggctcgcctccgctgtgggccacggccagsgtgtctgtggaggtggccgacgtgaacgacaacgcgcctgcgttcgcgcagtccgagtacacggtgttcgtgaaggagaacaacccgccaggctgccacatcttcacggtgtctgcgtgggacgcggacgcgcaggagaacgccctggtgtcctactckctggtggagcggcggttgggcgagcgctcgctgtcgagctacgtgtcrrtgcacgcggagagcggcaaggtgtacgcgctgcagccgctggaccacgaggagctggagctgctacagttccaggtgagcgcgcgcgatgggggcgtgccgcctctgggcagcaacktgacgctgcaggtgttcgtgctggacgagaacgacaacgctcccgcgctgctggcgtctccsgctggcagcgcgggcggtgcagtcagtgagctggtgctgcggtcggtggktgcgggtcacgtggtggctaaggtgcgcgcagtggacgctgactctggatacaacgcgtggctgtcgtatgaattgcagtcggcggcggttggtgcacgcatcccgtttcgcgtggggctgtacacgggcgagatcagtacgacgcgcgctctggatgagrctgactcgccacgccagcgcctactggtgctggtgaaggaccatggcgagccgtcgctgacggccacggccactgtgcttgtgtcgcttgtggagggcagccaggcacccaaggcctcgtcgcgggcttcagtgggcgtggcgcccgaggtggccctggtggatgtcaacgtgtacctgatcatcgccatctgcgcggtgtccagcttgctggtgctcacgctgctgctgtacactgcactgaggtgctcggcggcgcccaccgagggcgcatgtggsccggtgaagcccacgctggtgtgctctagcgcggtggggagctggtcttactcgcagcagaggcggcagagggtgtgttctggggagggcctgcccaaggcggacctcatggccttcagccccagccttccaccatgcccartggtagatgtggacggggaagatcagtctattggaggggaccactctaggaaggtgggttattacgttttcattttccttttgtgcyttatgaataatattttctcttaccgcattttctcaaatatgtatcagaatatttcatttttgtctacawtccatttatgcttgaatatttctagtgatacctttgtaatataatttattccaggagttttraaatttttttatcctacccagtgtgtcagcctttgattggtacttaaatttttttaaataacaatttattctgaatacactaatattttccaatacaaatatgtgatataggttgcagttctgacgatttactttcataatcacttttcgttacaaatatttgtgagattagtacttcatgttatttcatttccaatctaaattttgatttgattgtatttgcattaccaaaaaattccactgatctatatctcttcagtgaaaatgtgttttcctccatgtgtagaatatgtgtagcgtaccacagcttatactgccatagtagatttcaatgttcagtgattacagctttttctcaatagtgcagtaagtaggtgggcagttcattggtaaaaatttcttaatcttagcaattaagttaaatgctttgaactttaaaaacgttttccatttttattttagttgtagtggtacctgtgtcagtgtgtattattcacttagcagaagaaaatgtatgtttcttttatttacataattttatccagtagctcttcattatctgctcctttatcagcattaggcattgcttatgatattcaggtattagctctttcactttaaggaaggagtcatgcttatgtttaataatgaagagaatttgaacactttttacttttgagactgaaaatactttagtatgaattaatattaaaagtttgaggagaaaataaaattaatgttttctactgatctgatatattgtatagtttaatagcttctctagtcatcttaaacagggttgggttagatgatatagactcagaaatgaaagctaacttagttgcagagtgacaaaactacactatcaattgtgttttcctgaaattggttgttacctgatacccatgatttcatttttaaaaaaaatttattaattctagtgttaccaaacaccaatgccatgaatttgtcatcttgcctatggctcttagcaattacttttttctttcctttctctttgagtatggagattgaatttgttactcagtacgtgcttcacaaatagcttcaaataaaattaaaattattgttcaagtttaggaacaccaaaaaaaaattgtggcaagaatttaagcatggcattctttcagtgttaatactctccatgccctgtctccagctcttagaaattatagatgctaagttaatgcagagtttagaagtgtatttgttattwtatcaaataggtttatgaaatatatacttccccctctgatattttgaaaaaaaatcttccttaatgtcttatattataagtaatataaaaaacttagtaaaaactcatatcaattgtaaaagtctcaggtatacaagtgcattaatctctccatcaatactaacttaaggccaggcatggtggctcacacctgtaatcccagcattttgagaggccaaggtgggaggatggtttgaggccaggagttcaagaccaacctgggcgacatagggatatcttgtactgtgtgtgtgtgtatatatatgtatatatgtgtatatatatatgtatatatatatgatgggctctccttacatatatatmtatatatgtacttatgtatatataagccaggcatggtggtacatgcctttagtccctactgtagtgctacttgggagggtgaggtgggaggacggcttgagcctgggaagttgaggctgcagtgacccatgattgtgccactgcactccagcctggatgacaaagtgagaccctatttcaaaaattgaaaaaagcaaaagcaatagtaacaccattatcctgcaaatatgatctttttcatattaattcacgtgataatacagttggtgcagtagtactttatttaggatgtctacatacaagataaaactcttcatggaattctgatttgtaagacaaacccacctttgaagaggtactgatcatacacaagaaggtataggaaaggagttggaagctcacaaagagaaacataaacatatgcaggaatcaggaacgaagaagataagtgaaataatatgaaatcaaatgcacttatgttttgagcgacaggatattgttgttctccatgaaaagtttttttggtttttttgttttttattttttatttttttgagacggagtctcgctctgttgcccaggctggagtgcagtggcacgatctcggctcactgcaagctccgcctcccaggttcacgcyattctcctgcctcagcctccggagtagctgggactacaggtgcccgccaacacgccaggctaattttttgtatttttagtagagacgaggtttcaccgtgttagccaggatggtctagatctcctgacctcgtgatccaccggcctcggcytcccaaagtgctggccgagtgccaccgcacccggccgaaaggtattttttttaacagaagaaaatcagattattcctagatcagaaagaagctccattgttcctgtactttaaaaactacaaacacccattaagaccacttggaacctcaggaacaaggaccaaaaggtctcagaggaactaagtctttctagtcatgaaatattgttttactaaccaaaagagaggcataattttagctgctagacaaagtggccaggaatcccggagcctacagcactggcttctgctccttgaattttgtgaagcgggaaaggaccagttccactacaccatcctggaagaggccaaggacggcacatagcgtcttcgcggtccctattgcgcaggacctgggtctggagcttgtggagctgataccgcgcctgtttcagttggattccaaaagcckcagaaaccttctggaggtaaatctgcagaatggcatttttgtgagttctctgatagacctcgaggagctgtgtgggaggatctcggagtgcagcatccacctggaagtgatcgtggacaagctgctacaggttttccatgtggaggtgaaagtgaagaacaataaagacaacctgccagtgttctcagcaacacaaaagaatctgtttctgaaacgagagctcttgattatcgtgtttcactagagggtgtctgtgatgccgacgtcggggccaatgctctgatgacttacatactgtgccgcaatgattatttttccctggaaataccaacaagagcaggtaaaaccacttgaaggtgtattttaaaaattctttcagataggtaagtcacttcagagctactcttggtgctcaaagcaactgatgggggcgaagctgagctgacaggcaccaaagcattatatatcacagcgctggatgtaaatgatgatgcccagtgtttgacaaaggagtctatcatgtgaaattactggaaaatgcaagagaaggtacactggttattagacttaaccccttggattttgacgagggttcaaaccgtcacattgtttctttgcaactgatgtctcccctaacatagaagccctttttcgcatagattcagacagtggataaataaatgtaaagataggttttgaggaaactaaataatgaaagattcaaatacaggcagttgacacaggcaattccccaatgtttgatcactgcacagacttgatagaagtcttggacatcaatgatagtgttccagagttagcagtaagtcactatcattccctgtacaggaggacgctccactgggtaccgtcatagccctaatcagtgtaattgaccctaacttcagtgccaagggacagacgacccgcaccctgactcctcacgtctcttcaagctggtgtctaccttcaaaaggcgctgcccagaaactattcgttggtactccacagcgccctggaccaagagagcaaatctatccattgttggtaatcgctcggaatggggactcgctttcattgttggccacagccatcgggtccgtggaagtggccgaacagtgaaccacaatgccctggcgttccagcagcccgagtacatggtgttcgtgaaaggtaacaacccgcggggctgccacgacttcacagtgtccgcgcgggaccgggacgcgcaggagaacgtgctggtgtcctactcgttgatggaacagcgggtgggcgagtgcgcgctgtctagctatgtgtgggtgcacgcggagagcggcaagaggtacgcgttgcagccactggactacgaggagctggagctgctgcagttctaggtgagagcgcgcgacgcgggcatgccgcctctgagcagcaatgtgacgctgccaggtattagtgctggaacgacaactwtgtctgcgytgctggcgccttgggtgggctggcggcgctgtgagtgagctggtgcggtattcagtggatgcaggccacttggtggcgaaggtgcgcacggtggactccagctatgacgcctggttgtcgcaacagctgcatctgtcagctggcagcacccgttccacgtggggctctgcacgggcgagatcagcacgacgagtaccctggacgaggcgaaagctacgcgccaccgcctgctggtgctggtgaaggaccactgcgagctggcgctgactgccaccgtcaccgtggtggcgtcgctggcggagagcagccaagcgaggaaggtcccatcgcgggctttggcgggcgtcgaggtccgggaggcagcgctggtggatgtcaacgtgtacctgatcatcgccatctgcgtggtgtccagcctgttagtgctcacgttgctgctgtacacgacgctgcggtgcttggcgcagctcaccgagagctcgtgcatgccgggcaagcccacgctggtgtaccgcagcgtagtgggatctggtcttactcgcagcaaaggagattttactctggagagtcgcctcccaaggtcaacattacggcttttagtcctagtgttctcccatggttcagattttggagatggacttcaataggaaatttttgagaatataagtactgtaatcctggaaagtatttcattcctattaatgtccctcatagtgacattgataatgttcaccaagttattaatttgattgctttatttattttgcttttgctttttcttttgagatgctttatttaaagtacactggggccgggtgcggtagctcatgcctatttgtaatcccggcactttgggaagccgaggcgggcggatcactcgaggccaggagtttgagaccagcctggccaacatggtgaaactccatctctactaaagatataaaaaaattagctgggtgtggtggtgcgcacctgtaatcccagctactcaggaggctgaggcacaagaattgcttgaacctaggaggcagaggttgcggtgagcctagattaggccactgcactacagcctgggagacagggtgaaactctgtcttaaaaaaaaaagtacattggaagtctagccatcttaatcactttttactacagtcaccatgaacattctttaggaatattcttcagttgataagtataatgataatagtaataatgaattagactgagtggctgtttcctgtaaatgagaaagttaaatcttaccggaaggatcatgatgaataatgatccttatgagaaggtcaaatcttctcaattttgaagcaagttctttattcctattcattttcttattctgatttgtgtcctccattccttattgtttttatgtattcaaaaataccatgacaatatttaatatcataattatttgagtttaaaacatgtttaaatgtttatctttctataatcgataagtttatctctcacaaatggtgatgagcagggttgaggcagcttcgtccacaaacaattttgtttcttcatgatcaatatccatcttttttgagatgttgattgcagtgggtggaattttagccttgcctttaaaggtgattttacttcttaatttttgtcttcaatcttcttataatttcattttaggtcattgtcttcacaatcttcaactacttcagatagccaacaactttgttcttttttaaaaagaaaacaaaacaaaacaatgtcagctctacttaattacctgttgacttaattgctgctgtcctccagtttaagttgttgagctcttctactattttgggaagatttctttgagcaccgattatactcatttttctttcatttttggtacctggctgtatgaaaatattttagggtaggaaaattcacacttatttgggctttaagtataagagagtcttcccatacatgatgaagggtgataccattgtctgtgttcattaagctgcatggtcttcagaatggcattgctgagcttggcagggtgtctcaggcctgtaatcccagcattttgggaagccgagggaggaggatcgcttgagaccaggagtttgagaccagcctcggcaacatagtgagacccccatctctaccaaaaaatgtcattgtttttaataacttaagtataagaaccatgggatattaataaaggcacttccacttgacaattgtggtgttaattataccttagaatttaacattgtatacttttgatatatttgatgcaaaatattttttgccttcacaccatattaatgtgaattgctttctttaaagggatcccagagaacacgtatttatagctgtaaggatgtgtatcaaattatatgtaaaattactttgctctttttggctctaattacaaatgagatggcctttaattctgtgtaaagaaatagtatatttacatattgcaggataaccatgttataggtagggtaaagttaatataaatgctgaaaaggaattagtagtgtctacctagaaaaataacttctgagaagatgatttctatgaagataaacattaaggaaatcttcagaaaagggaaaaccctgtcctactttatggtgctggaattctcttcatccatagctataggacaagagccaatattgatcagtaactcatgataataaatcaccattgtttgagcagtttattaatatatttgttagacatcatgaagggacttaaatacattatttcatttaatacttataacaatttctaaagtacatatgactgttccaatttgaaagataaaataagagaagctgagatgtgtatctattttatccagtgccagtacatggtggagatattattcaaatgtgtatctttcaggcttcagactcattcttttatccactataatgtagagctttctttagtaagtcatttctctgctcaaacatggtctcggctaggaaaatcaagcacaaattgtgtacaggcaaatctttctttctgttgtgcttagaagaaacttcatgattgtcttcatcattaattttgtacaatgtgtgattgagatggcactaagtttttttatgttaagtgatttttttcttgtaagagttcgtgatcatcattatcatttgttttaatcaatgccacactgagataggtattttggttatgtaattgttaagtaattaagagttgccttataagaactacgtatctgttgtttggaagtgatataagtaagaatcgtttaacatgtaagaaaagtcagaaaactgtggtttccaatatccttgtggaacacctaaactaaatactatataccaaaaatgacacccttctttctttactgtgaataaagacagtgtttgggacaagtatagatgttgatattattatttcagggaccctgaacttggccaaaggattcaagaaatgtttacaatattgcatacttcaataacaattttaaagacatagattcccatgaaaatcttcaaatgtgtgtaggtctttcagtcttcttcagtcttattgttggctgggaagctcataacaactgacaaatgatttgtgaccaaataactgtttttacttgactaagccatgatagagcagaattagcatcacggrataaatcctataattttgttaatacagtggttggataatgtaattctaatctgttggttttggagaacctcctggggttctgacaacggtgtcaaaatttatttatgtgttttcaagaaataatagcactaggtctgttagaatatcagtggatgaygtgcactagtaagacattaaactatgcactctaatacttatatgactaacaggacatacaggcagattgtatgtcctgactgatatagtaaaagtcaggcacaaagttccttaatcttcaattgattttacaaaatcagttaacaataactgtattgaaatgacttcttggtattagcctatacccagatattaggctgatcctcaaagatgagttcaaagggcgcataatctcttcactaggggctggttgagatggtgacatctgaaatatcacagccaaaatgcaaaagatgggtcattgattcatacactatatcaaactcttttatgacttggcgtttgttcagtactactttatatattcacaaaatactgtattgttggaaattaacacctaaattaacatattgttttaattcaaatatgtgatattatcatttttccagagtaaaccttctaaggttcatttccctacctcgcaagactccacattccatgtaacatcttcatccccaattcccataataaggtgattgaggatctgttgtttccttttgttcaaaataaacctgatgtgcttcaaatatcatgttgaatatactgtcatctggtctaatgttatgttttgattagaggctactatgattgattattttacagatgcgtaatggaattaacggttataaaagttgatatgtctcctttaattttttaatacagaattttgcatttacctgaattagagttctagtgttatgacaacattgggaaaagagtaaatatgaaaaaagtagaacaaaatctcaaattaatagttgaatatatrtataaaatattagcatacacatatgataactttttcatatgcccttgcagtatttttagattggagataaaccatcaaaactatagaacaaaatatttaagctagagtgatatttattctaaatcactttctactctaaaattttgttgcatcttctttttttcctcctaaatcctaagggtatatgaaaagacaaagaaaattcaagcaagttacaacttcaggcaaagaaaactctsataagcaattcctgtattttacttagcattttctatgaaattccatttccacaagcactaaggtaatttaccatttagttgaattgtttgattaattttctatgttttaagcacaatatcaggtacttacagaaggtataattaaaaatcacttcccttgttttccatgaacttctgctcccaaacccaaaattctttcaacaagaaacaaactattttcatgaatataactgaattagattaaggaaaccaatgttggtgacttggaaataccaatatggcacaaagatgttcagggtgattttatttattttataaaatgataataaaatttattttatagttgaaaagcctatttctgtcatatcattgattctgttacataaagtgctaaattttgatayctcatattatgctactatggcttacattagaaataatatatgtcaaataaaawctcatctagatcaatagacttttcctttgtggattcttttttaaaactaccaagtttgagaatatgaatatatttgtttttcatattgttctgcaatgaatataaagtcacttataatcagaaagcaattaaatgtaaataacagtaaagaatgagaactatagaaaatagatatgaaaatgcaagcccacagagatgagaatagatcatgtggaacataaacactaaagagctgcttttataaaacttcaattttttctttgagttccctagcagccaaagtaacaagggagactgaaagtaaaacaattcaaatttgatagtatttttatatgaggaacaacactttcaggaaatgtttaaccctagtttttcatgaggccaccttaacaactgaattctctttctctctcactctgtgtataagtattttagataagtaaaagaacaatgttataatgttaagtcaaacatagacacaataatttaaatttgatgttaatcgagaaatacaatgccatttccatatatatttagtttcaatatgacttataatctgaatattccataaataagcacgttggaaatatttgggggaagaaacccaaaacacgtgaaattctgtggtggtaaatgcagtgcacagtactcacagttttaggcgcaaggtgtcgctctttacttggtggaaagttcatttaaaggttggtctgaacagtgaggcactyccatacaaaggaactccatcataccggatgccaccgtttaaggatcctttgaaacttcttaagaattcaacgagatttttaacctgaractgaagaatctggtactgtaagtgtaaagaagcttattttggaagccaatttcgtatgcgatgtttggttttcagagaaggggattgggcaccccacgactacagctctggcttctcctcctcgaattctgggaggtggggagcggccagctccactactccgtctcggaggaggcyaaacacggcaccttcgtgggccgcatcgcgcaggacctggggctggagctggcggagctggtgcagcgcctgttccgggtggcgtccaaaacacatggggaccttctggaggtaaatctgcagaatggcattttgtttgtgaattctcggatcgaccgcgaggagctgtgcgggcagagcgcggagtgcagcatccacctggaggtgatcgtggacaggccgctgcaggttttccatgtgaacgtggaggtgaaggacattaacgacaacccgccggtgttctcgctcagagaacaaaagctgctgattgcggaatctaagcaatcggactcgcgttttccactagagggagcttctgatgctgacattgaagagaatgctctattgacctacaggctaagtaaaaatgagtatttttctttagattcaccaacaaatggtaagcagattaaaagactgtcacttattttaaagaagtctctggatagagagaaaactccggaacttaatttgctgctaacagctacagacgggggaaaaccagagcttactggcaccgttcggctgttagtccaagtcttggatgtcaacgacaatgatccagagtttgataaatcagaatataaggtgagccttatggaaaatgctgctaaagaaactcttgtgctcaaactaaacgccacagaccgagacgaaggagtcaatggagaggtaacatactccttaatgtcaattaagcccaatggaagacacttatttacactagatcaaaataatggagaagtgagggtcaatggaactttagattatgaagaaaacaagttttataaaattgaagtacaggctacagataaggggactcccccaatggcaggtcactgtacagtctgggtggaaatcttggacaccaacgataactctcctgaagtcgccgtgacttccttgtccctcccagtacgagaggacgctcagcccagcacsgtcattgccctgatcagcgtgtctgaccgtgactcaggtgtcaacggacaggtgacctgctcgctgacsccccacgttcccttcaagctggtgtccaycttcaagaattactactcgttggtgctggacagcgccctggaccgcgagaacgtgtgggcctatgaactggtggtgactgcgcgggatgggggttcgccttctctgtgggccacggccagggtatccgtggaggtggccgacgtgaacgacaatgcgcctgcgttcgcacagcccgagtacaccgtgttcgtgaaggagaacaacccaccaggctgccacatcttcacagtgtcggcgcgggacgcggacgcgcaggagaacgcgctggtgtcctactcgctggtggagcggcggttgggcgaccgcgcgctgtcgagctacgtgtcggtgcacgcggagagcggcaaggtgtacgcgctgcagccgytggaccacgaggagctggagctgctacagttccaggtgagcgcgcgcgatgcgggcgtgccgcctctgagcagcaacgtgacgctgcaggtgttcgtgctggacgagaacgacaacgcgccggcactgctggcgactcaggctggcagcgcgggaggcgcagttaacaagctagtaccgcggtcggtgggtgcgggccacgtggtggcgaaggtgcgckcagtggatgcggactcaggctacaacgcgtggctttcatatgaattgcagccggcggcgggcggctcgcgcatcccgttccgcgtggggctgtacacgggcgagataagcacaacgcgtgccctggacgaggcagactcgccgcgccaccgacttctagtactggtgaaggatcacggtgagccggcgctgacggccacggccaccgtgctggtgtcrttggtggagagcggacaggcgccaaaggcctcttcccggactttggcgggcgccgcgagcccagaggctgcgctggtggatgtcaacgtgtacctgatmatcgccatctgcgtggtgtccagcctcctggtactcacgctgctgctgtatacggcgctgtggtggtcggcaacgcccactgagggcgcgtgcgcgccggggaagcccacgctggtgtgctcccgcgcggtggggagctggtcatactcgcagcagaggcggcagagggtgtgctctgaggagggcccacctaagasggacctcatggccttcagccccagtcttcctctaggtctgaataaagaggaggaaggggaaagacaggagccagggtcaaatcaccccggacaggtgagttttctacagattccacctatcaggaagtgtatgtgaaattatttaaaatccagttttttttcacggattttttaagggaaagttttatgaataaccagtgttttgaatattgttttagataacaatgtctgttcataaaataccaaatgatacacatcttcagtcttttaatcatatgaataatctggcttctttaaccaataaatgtcctatttctcttaatatttggttagcaaatcctaaaagaaatgagatgcaagagtgactcttctgtagtcacttgagtagaaataattactattttcactaaagtacccatgccccttcatctctaaacttcaattatgaccataataactatggattatttaaatttgctcctctttgtcttttagcagagttttgccttgatatttccacattgttagatcaactggctttgtttttctaaagggaggaggtcttcctatgatgtccaggttggactgcagtggctatttacaggtgacctgtagcctggaactgctaagctcaaagaattctcccacttcagcctccagagtagctgggaatgcagtgccactgcacttagtccattggctttcctaacttcaggcttgtatcaaagctagaatactccattagtatgacatgatttacttttcttttttttttttacagtgttaaacgttcatcataaattcattatatatgaaacaatctttacttttgtctttattcctgtgataatacttgttttcatattgtttgaagaaaaaagttaagccttgcattcttatatgctgctttatggaaataatatgactaaaattctacatgttcttgccaggcaaagtggttcaggcctgtaatcccagctatttgggaggctgaggcaggagaattgcttgagcccaagagttcgaggcctgcctggacaacatagcgagatcctgtctctataaaaaattaaaaaattagccagacctagtggtgcatgcctgtagtcccagtttcttgggaggctgacatgagaggatcccctgaacccaggggttcagggctgcagtgacctatcatcgtgagacccccatctgaaaaaataattttttttgcctgttcttgattttgttccatgaaaaggcaagagatttgtcaactattggatactcaaacaaaatggcatgatttatgattccaaaggaaactaggtaaataaaattattcaaattatctaaacttgctaaagacatgcatatagggctatattatctataatatatgctagttggcattcttccataagtttttcagattcatctagcagagaaaaaattaaatatattaatgtgagtacctactgacaattatcagtttcattcatctcactttgtaactgctctatcttgtaatgccttatctctaatgtttttgaaattttctttccacgtagtatcatcccatctgaagatttgagcaaagatcatttacttctgagtcattcttcatatttagttattcttactacaygtagagtggtggtattacagactttcttgagaatcatatctagctatttcccccccgtatagaggcataacataccatttggcacaatattcaaagagtctatgctgaagcctattcatagactttagatcgagagcttttgtatcataatattcattggctaaaaacattctttaagtattaaagagaaggcaacaatataaaaatataaaatatttcagactcaaaagtgattaaaccatcataccacttatgaaactttataaatataataaaggtgaatattagatagggcatacattactcatctccagatgaartttttggaataactgaagatctttkaaagacttgggaatgttttcagtacaggttaaaattttgtaaattattattttatatcacataaataacaaatttgcattttagataattcaaattacttggactgatttctgcaaagttgtgtcttttatacttaatgccaagattgcattctatggtataaaattataatttcaatttattttctagtttggttgtttaagtattaagctaaacttagatgttcctattggcttaacaatttgtttaggtcaaagagtatgtgagaactacataacacactattattatttgtttctttttgagatagagtcttgctctatcacccaggctggtgtgcagtggcgcaatctcagctcactgcaatctccacctcccatgttcaagcaattctcctgcctcagctttccgagaagctgggactacaggcatgcaccaccactcctggctaatttttgtatttttagtagagatgggttttcaccatgttggccaggctggtcttgaactcctgacctcaggtgatctgcctgcctcagcctcccaaagtgctgggattacaggtgtaagtcactgagcccagcctattttttaaaattaaagttccttagcatgtatggtacattgaccacttttgaaaatgaaaaataggaaagaaacttggtgatgatattagacaatttaaataattagcctgatgacatcaaaattcaaatatgtttttaattrcttaacgttttatagtttatttaagttatcttatacttgtagagccattcttggttactctttcctggtgttgtaaaggtgtcatatttcagttgccyttattattatatgcagtaggaatgaatggcaacaaattattggtttaaagattttgacttgagtattaatagacttacaaaatctatgtgtacttgttcacaatgagttgtaggatcttatctgtttttttctcttaaagctgatcttgaattaatgaataaactcatgaaaggtcttttgatgcccccttgcataacagtcaccattctgattttctgaagagaagcatgtcctaactactaaatgacctgtaggggaagatttagagaaaaagcaaaaggttgatatcaagttcacattctcttgactttagtcaatgagattaggctccaaaaccctttaagagatctttcgcattttagtgctccattgttgctttgggatagtgtgaaatttggaggcttcaactaaacattttacattaaagtgctttacttttgctagagtaaaactttccagaatctattcctgagatttgttttaacatgttatggaaatgagagcagttatgtgaaaagttatcacattcaagcatcaaggaaccaaacaataacgctctccatatttatgatgaattctaactttcatcagatttatgaataagacaatttatataaatgaaatattgtttggtattagacatattttagtttcttatcctttgttaaatacaaattcctaactttctctaaaatcttacgatggagtgcttgtgaaggttaaaagttattgaaacagcggaattgtaagctatataaggggaggggtgctgtatattattctgtatatcattttccatgataaagtgtaggttctggcctactgtatttgaaagatttctactttgaagcagaaaacatttttaagctacagcgtaataaaattgttgatgttttgttactaatatcatgtatattaactaaacccgcatttataaatgatccgtgaaaaataacccaaagtcgaaacattagaattaagagtgacccaggaagtggctaaaccgaaaagaacctcaggatctttcttgtacttacataatcagtcacatgatgtcgctctacactcagaaggtgaaacaggaaaatttttttctccgcacccacattccaatcattcacggaataggatcgactccataatgactgtgatgctggaaaaaatttactaaatatgtacttacagaaaagggtgaytgctcataaaatacctcaggcaagcgatcccttaaaactgattgtcccaactcagaggccctcattttctgcaatggtgattatcggaccaagaggcccgggatcccagcgtctgctgctctcgcttctgctccttgcagcctgggaggtggggagcggccagctccactactccgtctacgaggaggccaaacacggcaccttcgtgggccgcatcgctcaggacctggggctggagctggcggagctggtgccgcgcctgttccgggtggcgtccaaaagacacsgggaccttctggaggtaaatctgcagaatggcattttgtttgtgaattctcggatcgaccgcgagaagctgtgcgggcggagcgcggagtgcagtatccacctggaggtgaycgtggacaggccgctgcaggttttccatgtggacgtggaggtgaaggacattaacgacaacccgccggtgttcagagaaagggaacaaaaggtacctgtttctgaatctgcgcctctggactctcattttcctctagagggcgcttctgatgcggatatcggcgtaaactctcttttgacctatgcgttaagtctaaatgagaattttgagcttaaaataaaaacaaaaaaagataaaagtatattgcctgaattagttcttcggaagttattggacagagagcaaacgccaaaactcaatttattgctgatggtaatcgatggcggtaaaccagaactaacagggtstgtccagattcaaataaccgtcctggatgtgaatgacaatggtccggcgtttgataagccmagctataaagtagtgttgtctgaaaatgtccaaaacgacacaagagtgatccaactaaatgcttccgatccagacgaaggacttaatggagaaatttcctatgggatcaaaatgattttgccagtgagtgagaaatgtatgttttcaataaatccagacacaggtgaaattagaatttatggtgaactggattttgaagagaataatgcctatgaaattcaggttaacgccattgataaagggattccttccatggcaggtcacagcatggtcctggtggaagttctggacgtgaatgacaatgtccctgaagtaatggttacttcactgtcgctccctgtgcaagaggatgctcaggtgggtaccgtcattgccctgattagcgtgtcggatcgtgactctggagccaatggacaggtcatctgctcactgacacctcatgttcccttcaagctggtgtccacctacaagaattactactcgttggtgctggacagcgccctggaccgcgagagcgtgtcggcctatgagctggtggtgactgcgcgggatgggggytcgccttcgctgtgggccacggctagagtgtccgtggaggtggccgacgtgaacgacaatgcgcctgcgttcgcgcagcccgagtacacagtgttcgtgaaggagaacaacccgccgggctgccacatcttcacggtgtcggcatgggacgcggacgcgcagaagaacgcgctggtgtcctactcgctggtggagcggcgggtgggcgagcacgcactgtcgagctacgtgtcggtgcacgcggagagcggcaaggtgtacgcgctgcagccgctagaccacgaggagctggagctgctgcagttccaggtgagcgcgcgcgacgccggcgtgccgcctctgggcagcaacgtgacgctgcaggtgttcgtgctggacgagaacgacaacgcgccggcactgctggcgactccggctggcagcgcaggaggcgcagttagcgagttggtaccgcggtcggtgggtgcgggccacgtggtggcgaaagtgcgcgcggtggacgctgactccggctataacgcttggctgtcctacgagttgcaaccggcggcggtcggcgcgcacatcccgttccacgtggggctgtacactggcgagatcagcacgacacgcatcctggatgaggcggacgctccgcgccaccgcctgctggtgctggtgaaggaccacggtgagcccgcgctgacgtccacggccacggtgctggtgtcgctggtggagaacggccaggccccaaagacgtcgtcgcgggcctcagtgggcgctgtggatcccgaagcggctctggtggatattaacgtgtacctcatcatcgccatctgtgcggtgtccagcctgctggtgctcacgctgctgctgtacactgcgctgcgttgctcagcgccgcccaccgtgagccggtgcgcgccgggcaagcccacgctggtgtgctccagcgcygyggggagttggtcttactcgcagcagaggaggcagagggtgtgctctgcagagagcccgcccaagacggacctcatggccttcagcccaagccttcagctgtctcgagaagattgtttaaatcctcccagtgaagtaagttattaatattatttagatatatttgtttccttgaagaacttccgtttaggttataactacattctctcatttttctttatgattctatcctttaaactatcgaatgtctcatctttcttggtcattcttactcattttgaacttttatgtatttgtctaayattaatgaaggaaatatgtaggtacaatggaggccatggagcaccacacttaatatttttctttttctataatattttatatgactgatgaaccttgaaaaaaacagtatattagattaaaaagtggccagatgtttgataacttaaaaatttaatttgttcataatttcaagattacaggtaagttgcaagaatggtacaaagagttcctagatcccattaatggattctttaactcttcctcacgtgcttaggcttttaaaatagccttcttgatcactattctaatttcagtacaatctagacattttcacattatattccaggtattatcacaataatataaatgatatgtctgacatatgatgaatgattttcttcattgctcacaaaatatcttctttatttcaagtaggaatagatactgtactattcttatttacatgaaatataataaaatcatttctcaatttaaaaatatttaaccatctgtacgatacagtacagttggtaaccaactgtggctcaaaccagtttcagatgatcccaaacttatcatagtataccactgccctgtgcctattaccaagtgaatcttctaatgtgcattttacatattttaactttctatttctacaaaaatatccagaggcttctctttaaccagggaataaagtcttacataccccagcctggtagtaaaggcattaaaatttccagccttatatctactttcttacatatctttagtttaggatctggaatatagtatatgttcaatcactttttaaaaacatatgggggtcttgctatgttgcacaggctggwctwgaacttctgggttcaactgatcctccatttcagcctttcaagtagctgagactacaggcaggctccaccactcccagcttcaatcaataattttaaataaatatatggtattgaaatgtattacctggacattcccctctatcttagaaatgagagtatgccctagaaatcagataatgttttattgaagagtgtcttgaaagatagacaacattttaccaagaaagtgttaagagagataagtaggaacaactgcacagtatatggtgtaattgaaggattagagcaggggagattgtgaaggcaggaaagctatttcttttttaataaattaggtatcaagtaatggagacttaaattatggcagtagaaatgaattgaaaaagacatatacaagaggcactggcaaagtagaagcagccagataatgacagactcaatacaaatgataagagaaaaacaaaagtagaagttgactctcacttttttagtttgttcarctgagaagatgacattgccattaaccaacctgcagaacaaggttggagaaacagtttgtgtgtayttgagcaggtagggaatggagatgaacatttaagaaaatgttactttgaagtcctaagagaataccgttgtgattggaaatatgggtctggatctcagaagagattattgatatagattttgggaacaactcctttagagaaaaaaataatccatgaaagaataaaattgccaagacagacattgaaaagtgaaaaacaatgtgtccaggtacttaggtgggtaagtgtgtcgcttcctgtggctgctataacaaacgaacacaaactgggtgctgtaaaacagcaaaagtttattatttctcagtattggagaccagaagtccaaaatcaaggtgttgtcaaggctatactctctttggaggccccagggaagaatctggtttttgtttcttccagtttctattggctgttggtgttccctggcttgtggctgtaccactcccatctcagccttctcagctttcatggtcacattgcctcctcctctccatgtctctctctatgtgttggttttacaaaggtacatgtgattgtatttagggcccatctggataatccaggataaactcctttcaagatccttaacttaatcatattattcaccatataaagtaaaatccacaagttccagggattaagatgtgggcataactttttggggaccacaattcaacctattatagtaggcttaaaatcatagaaggatagacaacaggaagctgaaataaagctcaaagtgcaatatatcaagtatatgttagaagttaaacatgaagggaaaaagataaacagaagaggttttccaccagaagtagaacatttaaattagtgtatgtgcgtgtgtgtatgtatacatattttagttaaagaagtttgactatcttcatagtgtgagtgaaagaaacaagtaaaaaataagatactaaaaataagacaggcagcaggtgaatttagatgaaaaccatgagagaatagaaaataatttttaagagcatatggttgaccttaaaagcgggaacagtttttccttacaactagtagaaaatgaaaacagataatataaggaaaaatgacacaagaagagagcaattgaatttctgtttggtcacatctctcaatgtgtgaatcatctgaaagtgaactgatggaaatgaggttgagaatttgagaagagaggaaagagaatatggaagaatctctgtaagcaagagggaggagttaattatcaattcacttgagagcccaactgaggtaaaggtgagagtaaatttgaagagaatagtcatggttaagtgacaatgttgagcagcttaataggaagcatagagaaaatggattgtcagtgtaactgcgtgttggaggctaaaaagaatgttagaggagtaatataaataggtgaatgactctagagtrtctggaagggcatattttaaatggttgactatgtagtctaattatgtgaagaggtaaataaagaaatgtagggccagatagaaagaattagaagagaaatactatgttagtaaaagtaatggagcaggagaggatgatgagggtaagagaataccaaatactctgcctaaattttcagaggagagcagagctatggaaataaacccaacagtcatttcctatagagttgtgcacagaacaggccagataattattggagctatgatatatttttcattacaccatttggcctgggattttgtggcttggtagagatagttataacaatagataaaagtaagatcctcttcctcttttccttgctaaagatatgttaacatctttgtctagctgttgtttcttggaaaattaaagtcaatttaaatgacggcaaggttttactcagtgatgatgaagtaagatggagagagaaaatggaaactttaacctcctggttaaattctatttaaccaggacgccgattcgggctacaatgcgtggctttcgtatgaattgcagccggcggcggtaagttaaattctattaaatcaataggatattagttccaggcatattttataaaaacagaatccaaaaccttagagcattgttgtggctaaattattgtgtttatgcacatacacacactcacatacaaaatcccacacatattgactgaacactttcttttgaatataaatatcttatctacatctcaagtcacattgagggaaatttattaatatgatgtgcttattcaaaatctgatatatcagttaccaatatttttcaccytcaccgattttattcttatgtgattgttatgtttccttttggagtcaatggctgttgtgtgaggaggtcttgaaaaatattacaggaagaggacagtaccacaaaaacctacatgactatgcagaactaccgatcaattgtcccaaaacgagtgtcgaatattctttgtcttaaagttctgcatggaattcttacacatggaaaaataaatttgtggcaaaatgaaactcatcaaccaattgtcagctaatataaaatgttgagcagaatgcagtgatttgctgtttctgggaaggtaaacatttaatcttcaattacatatttgcagtgaaaatgtcaggaaatgcaaggggcaaaaaaatactacatcaatggaaaatatgaagactgagtcatacttacacttacacgttcatgcgcatggtgtcgctcttcactgagmacgtttccgcgaagaaagccgccgtttctttcttcctgcagaaaatatagcagaaagcggaatacctcttgcgaatccttccgcactaggaagccataaaaattgggccttgagagacagtttgaggtaaggcgttgtatatattgcagatagctctgaggtttttggagtgtaccatgctgtcttcctggcaaggaggcccaagaccgcggcaactactgctctggcttctgatcctcgcagcctgggagacgggtagtggccagctccactactccgtccccgaggaagcaaaacacggcaccttcgtgggccgcatcgctcaggacctggggctggagctggcggagctggtgccgcgcctgttccgggtggcgtccaaaagacacggggaccttctggaggtaaatctgcagaatggcattttgtttgtgaattctcggatcgaccgcgaggagctgtgtgggcggagcgcggagtgcagcatccacctggaggtgatcgtggacaggcctctgcaggttttccatgtggaggtgaaggtgagggacattaacgacaacccgcccatattccctgaaagcaagaaacgaataatcattgcagaatctagacctccggaaactcgatttccactagatggcgcatccgatgcagatattggagtaaactcggcattgacctaccgactggatcccaacgattatttcactttggacgcacaaaacagtcttgagcaaatgtcttcattatcacttgtactgaggaaaacactggacagagaggaaattcaggaacatagtttattactgacwgccagtgatggaggtaaacccgagctgactggcacagttcagctgctcatcacgattctggacgtgaatgacaacgccccggaattttaccaatccgtttataaagtgacggtgttagagaacgccttcaatggaacattagtgatcaagctaaatgccacagatcctgatgatggtacaaatggagatatagtttactcatttagaaggcctgtatggcctgcagtggtatatgcatttaccataaatccgaacaatggagaaattaggacaaaaggcaaactagatttcgaagaaaagaaattatatgaaatatccgtggaggcagttgacaaaggaaatattccaatggcgggtcattgtacccttttggtggaagtactagatgtaaatgataacgccccagaggttaccatcacttctttgtcactccccatcagagaagacactcagcctagmgccattattgccctaatcagtgtgtccgatcgtgactctggctcaaatggacaggtcacctgcaccttgacgccgcatgtccccttcaagctggtgtccacctacaagaactactactcattagtgctggacagcgccctggaccgcgagagcgtatcagcctatgaactggtggtgaccgcgcgggacgggggctcgccttcgctgtgggccacggccagcgtgtcggtgggggtggccgacgtgaacgacaacgcgccggcgttcgcgcagcccgagtacacggtgttcgtgaaggaaaacaatccgccgggctgccacatcttcacggtgtctgckcaggacgcggacgcacaggagaacgcgctggtctcctactcgctggtggagcggcgggtgggcgagcgtgcgctgtcgagctacgtgtcggtgcacgcggagagcggcaaggtgtacgcgctgcagccgttggaccacgaggagctggagctgttgcagttccaggtgagcgcgcgcgactctggcgtgccgcctctgggcagcaacgtgacgctgcaggtgttcgtgctggacgagaacgacaacgctccggcgctgctgacgcccggggctggcagcgcgggaggcacagtgagcgagctgatgccgcggtckgtgggtgcaggccacgtggtggcgaaggtgcgcgcggtggacgccgattcgggctacaatgcgtggctttcgtatgaattgcagctggcggcggtcggcgcgcgcatcccgttccgcgtggggctgtacactggcgagatcagcacgacgcgccctctggacgaggtggacgcgccgcaccaccgccttctggtgctggtgaaggaccacggtgagcccgcgctgacggccacggcaacggtgctgttgtcgctggtggagagcggccaagcgccacaggcttcgtcgagggcgtcggcaggcgctgtgggtccagaagcggcgctggtggatgtcaatgtttacttgatcattgccatctgcgcggtgtccagcctgttggtgctcacgttgctgctgtatactgcgctgcggtgctcggcaccgcccaccgagggcgcgtgcgcgccgggcaagcccactctagtgtgctccagcgcggcaggsagttggtcgtactcgcagcagaggcggccgagggtgtgctctggggagggcccgcataagacggacctcatggccttcagtcccagccttcctccttgtctgggttctgcagagggaacaggccagagggaggaggactcagaatgcttgaaagaggtaagcttatattttaaaaaattgtcttagtaaacactttagccttccttgcagttgtttgtttaagacatctttcctgccaatttcaaattattctttwctttaattttaattttgctagttgttatcgaatttaacaactctgctgtggacattatgtgttggattatccttcagagtgaaatcttaactcacaaaccataatgaaatgtgcaaaacaagaatattttgtttctgttgtattcttaatagttctaagtatttatcttgcaattgagcatttacaaaaaattcctcacgttgtgagaacttaaacatttagaaaatgtttgttttaatgaggctaatcgtaatcttaaatttaaaaaatttttagtttaatgtatacatatacccacaagatattattttaaagagccccataacttttcacataaatgctttttttaagtgcacttttctttctttctttttttaaactgttttgattgtctctacttttttgtcctctaggcacatcagtgttcccctctcatatatcccatgaaaaatatcttgtgattctgctttcaattttttatttgcattcagataattactcatacatrtatatatacatatatagagagagacctggtaggctttttgytattatttcttttccaaagtttgaagggatttccaaaaggtactggtgactgaaagtaccttttggcagtccctgcaaatctaatggttttaatagctgtgtagtattccacagtgtaagtgtgcaattatatattatttacctaatgatgggcaatcactttgtgtcaagtgttctgttatcttcatgaaccatgctgtgctatcatttcatatatttcccaaaatattggtgttatttctacgaaattgattgtcagatgtggaattgatgcatcaaagatattaataattttaattataaaatatgtcactggattgccttccaagtattttggaaccaaccagttatgagcactctttctatctcaagaagcaatagtggttttactttctgctaatgtgatctctgtgaaatgatatttcactgttactttaattttaaattcctgtatagtattagtgaatttgagcatattgtcatatgtattttgttgatttgtatttgatcttctttgatttatccattaagttatttgcctacttttctattgaaaaaaaatttttagtttcagtttggaaaagttctctgtaccttatagatattaactgtttatctattttttgacatttttaattaaaatttttattttgagataattatagattcgcatgtggttgaaagaaatagtaaagggagatgctatgtattcttcactaagttttccccaatagtaacatcttacaaaagcgtagggccataccacaacctggatattgacattgatacagtaaagaagtaacatagttccgtaacaaccagattcttgatatcacctttttatagccacatctgcttccctgcctaatgctggcaagcagtaatctgttctccatttctctaattttgttacttttacttcagaaataaataaaagtatctctatttatagataaaattttttaaaattatttttatatttatttattttttattacactttaagttctgggatacatgtgcagaacgtgcaggtttgttacataggtgtacatgccatggtgtgcttatctattatctgcatcacaaatatgttttcctcctatattatttctattcatttgtttgtactaattttgtcatatataaatgtttttaaaatgtatgaattaaaatatatctttttccttttatggattttaaggtctgcatattcagttagaaaggtcttcccagctgggcacggtggctcacgcctgtaatcccagcactttgggaggccaaggtgggcggatcaggagatcaggagtccgagaccagcctggccaacatggtgaaaccctgtctctactaaaaatacaaaaattagcgaggcatggtggcacgcgcctgtaatcccagctacttgggaggctgaagcaagagaattgcttgaacccgggaggtggaggttgcagtgagatgagatcatgctactgtactccagctctgggtgacagagcaagacttcgtcttgaaaaaaaaaaaaaraaraaagaaaggtcttcccaactcctatattgaacattcattaattaaatgcatttaataaatacttattgagtgttctctatgtgccaggcatgttctacacattagacatttagcaacgaaatttattattttgtaaatccaaatttccagttggtatcactttcctactgcctgaaaaatttctttaatattttttatagtgcatatgttctggcaacaaattcactcagcttttgtctgagaaatatctttatctctttttttttttttgagacggagtctcactctgtcgcccaggctggagtacagtggcgtgatctcggctcactgcaagctccacctcccgggttcacgccattctcctgcctcagcctcccgagtagctgagactaccggcgcccgccaccacgccctgctaattttttgtatttttagtagagatggggtttcatcttgttagccaggatagtctcgaactcctgacctcgtgatccacctggctcggcctcccaaagtgctgggattacaggtgtgagccaccgcgcccggctctttatctcatttttatttttgaaaaagtattttcactgggcatagttgacagttttttaaaagatataattcagttgtcttctggcttgcatagtttctaataagatgtttgcttttttatatatgagtcttcctctccccacccctcatggttactgttaaaacttttctttttatcctgacttttgcagattgattgtgatgtgctttagtatggttttctttatgttagtctgttggggtttgttgatattcttggatctgtggatttatcattttcatcaaattcaggaaaaaatcaaccatacttcttctaatagttttttctttccttccatcctttctgagactccagtaacacatatgttacaatgacacaggtcattgaagcgttctttatttttgtccatttctttctctgtgcctcattttgaatatcttttattgacatattttccaagttcactaatttttccttttgtagtatcatatctgttaatcctaaacagtgtattcttcatttcagagaccatatttatttcttatctgtataagattctttttgtctcttttaaaatttattttacatgtctccaccgaatagtcatctttttatctatatgtttgagcatattagtacatgtataatagatgttttaactttcttgtctgctaatttcaacatttttgtccttagtttgcttcttttaatctatcttcttctatggatatattttcttgctgttttgcatgactggtaatctctaataagatgctagacattgtgaattttacattgtcggatgctggattttgtgtgtgtgtgcatgtgtgtgcgtgttcctttaaagcagtagttcttgataagaaacagttttgtcccctctaccccctacccaggagataatttggcaatgcctggatacatttttggttattacaactagggaattgctactggcatctaataatggagctctgagatgctgctaaacaccatccaattgctgccaaacatcctaccgtgcacaggacagccgcccaacaataaagaattagctcaaaatgtcagtagttccactgttgagaaactctgctttaaagagtcttggacttagttctgacgtgaagttaagttgctcagtaccaatttattcctttcaaggcttcattttaagatttgttagtacacattcagagcagcttttagtgtagcactaattcggccttctattacagcaatactttcctgaggacaccacctaatgccctgtgcattaagaggtctctcttctctgattggtaggaatgtgaaatatttccagccctttgtgagctctaggaattattctacccacttttttttttaattttgaagggatagcctgatctggggaggttgatcagtgatctgtgatctgtgatcacatcactccactgcagcctggtgacagagtgagaccatgtctcaacataaaaattaaaacattagaattgaggtttaatgttatcaaatattttatctgcatcttttgagggaggtataaattttttctttggcaatgttaatgtgttgaatttatgatttatgattttcttatggcaaaccaacctctacttccttggataaccgtaatttgattataatttataatccttttaatatactacttattttgttaaattttcaaaacaattttttcatctttattccaggtgatactgatatgtcctagtttttcttcctaatttcttctttgttaagtattcaagttataaataagaatctagcataacttgaatacttaacaaagaagaatagtctttgaaaacttccagaaaattttctgtttcctgtaaaagtttgtataatctttgaattacttcttatttgattggagaactcactgttgaagttatctgtatcaggattttgattggtgggaatatttctgattactgactcaattttaatagtataaggaccattcagagtttaatttactcgagtcagttacgtagataatattttttcaggtattttcctgtttaatctaaattttcagttatatgctcatactttctacagaatctatagtgatatttccctttccattcttgatattatttttgcttcctgtctaatttacttttcttcagaattctgctttctgatttttgtttttgctttgaaatatttttatattaattatactgattcatttctcttcttttratttgtgtttgcaggagatgtcctcttcccagccttttattttaaaccttttagtattatgggcatattccacaagttctttgctactgtctcactgagtagcagagtctaatttttctttccttgaactttgactggtcttaatattggaagtaacattctgggatttatgaagtcaggtcataagaagtcttacagtatgctttggtctctgagaatatttgttttgggggaagcctgccaccatgtaagaattctgactaccttgagattgtcatactgtaaagaagctcaagctggacttgtgagaagccaaatggatagaaaaattactatccagtctccagttgtcttagctttccaagcttaggtgccagaaaaatgtagaaggcttcaggtgactgtagtgtgttggagctggctcttttactggcttatgagaactgataatgcaaatttattcccaactctggattcaatgatgtcactttggtagcttgaaattggccatggtaggagtatttctgccacagaaataggcaaatgctacaaaacagagttttttgtttttcttttttcccagagacctagttgttaagcatttaccagtacactactgcacctgattgcaagcaagaaccactcagttgagtcagaaccaggagaggtaatattaagttgttttaagatattaggtagttgggatggtttactatatagcaatggataacctgaacaagtactctttcttagataatctataaattttaacttgaatatttatttagtttatatttacaatacctagtgatatctttaggcacaaatatttcaattttttgtgcgttatttttgtctcaccatttttatgtctctatttccttcctttgttgatcttcttttgaaatgactgagtactttttattgttccatttccttctgtattatttggaagcccttttccgaatagctagtgcttaccctagaaaattaagcatgtatccttgatatatcaaaatcaaaagttaactgaaacccttcctccttctgggaaatgcagggaccttacatttttaaaatctttttaatcccttttgacttatatactatttctgtcatgctttaaaaatattttaaaaccccataagatattagtattattttatacaatcaacattgttttaaatgtacttacatatttaccagttttgtttctcttccttacttcttgcccctctgacctttcatcagggattattgtctttccatgttagaataatttgagagtttcctttagtccaaagatgctggtgaggaatgatttcaggttttgtttttctgaaaatgtctttatttcatcataattattgaaaagcattttttctgagggtataatcttaggtgtgacccccacagcacatagtaaatattattccagtgtctactggtttccattgttgctgtcaagaatttagctgtcaatctaaatgtcattcctttaaaggtattctgtttattttcctttggctgcttttcagattttctgtgtgtctgatattttgcagttttaccatgctgtgtctttataatcatcctgttctggattcagtaggattttttttaatttttaatttttccgtaagttattgggggtacaggtggtatttgattacatgagtaagttctttggtggtgatttgtgagattttggtgcatccatcacctgagcagtatacrttgcaccatatttgcaatcttttatccctcgccaccccccactcttgcccccaagtccccaaygtccattgtataggatttttgaatttgtgaattaatgcctttacatcactttgagcatatcctcagctataatgttctccaatgttgcttctgttccattgtatttctatagtattattttagtactctaattaaacatattttaatcttattactctatcccatctatttctaccttttattttaacaccttttgctctttgggctttattgtggatagttcacccaccttaaagtttaataattctctcttcttgctgttgtctgaatttgtacccccaaattcatgtgttgaaaattcaatcccttatacaacagtgttgggaggtggggaatttcaggaaatgtttagattatgagggatctgccctcatgaataaattaacggcactgtaaaaggacttgatggaaggagcctgtccctctcttatgcttttggctctgtcatgtgacgatgcagcaagaagatcttcaccagatgctggtgccttgatcttggacttcccctaggctccagaattgtgagaagtaaatttccgttctcataaattactcagtctgtggcattctgttatagcagcacaaatggtctaagatacttttatttattctttttcaaatttattgttactttgtataatttctagtttcctctcgaaactttcaagcttggcatttatatctggaacacaataagctcatggttttagcgtctatttctgatatgtccagtaactgggatcctcatgggtctattcctgtggtgtgttttaaaattgtatctttatggtgttttgtctccacataaacctggttatctttgattttgtgctgaaagttgtattaaacacttcttcctggaaataatttggggcttataacattttctttctccagaatggattttaattgacttttgccaggcatcttggggcactagcaatcatgggtaatcttaatctatttcaagcttcaggtattctagataaaacctcattatctaaaatttacatgtattctttaagtacggttattcagtttcctagccaaacatgagagattgtttaagaagttccaccatgactggtagactcaggattctgacttttgtttctctagtccttggagactgtcaaaagtatatctcagtattcattcacctatttttttccttttatttccagttggtacataataattgtacatatttataggatacagagtgacattttgatacatatatacaatgtataataataaaatcagggtaattagcatattcataatctcaaacatttaccatttttgcatggtgaacatttaaaatccactcttctagcttcttgaaaatatgtaagaaattatagttaaccatatttatcctacagtgctacagtgctgcaaaacaccacaacccattcctcctgtgtagctataatttcgtatccattaaccaacctttccccatcctccttttccttcacccttcccagcctctgataagcacaatactacttccatgagctcaataaaattttgtagctgccgtataagtgagaacatgtatttatttttctgtgcctgacttatttcacttaacatatgccctccaggctcagccatactgccatgaataacaggatttcattcttttttatggctggataatattccgttgtgcatatacaccacattttctttatccactcatctgttgatggatattgaggttgattccacatagtagctattgtgaatagtgctgcagtaagtatgggaggtgcaggtatcactttgacatactggtttccttttctttggataaatgcccaatagtggaattgctggatgatatggtagttctatttgtagttttttgagggactcccatactgttttccttagtggcagtgctaatttacatgcccaccaacagcatttatgggacagtggctcatgcctgtaatcccagcacttagggaggcagaggcaggaagatcgcttgaagccaggagttcaagaccagcctgggcaacatagcaagaccctgttcttcacaaaaaagaaaaaaaaagcagttgtagaactcctttaagtatttcttgtaggacttatctagttgtagtgtacttcctcagtttttgcttgttkgggaaatacttyatttctccttcatttctgaagtatagctctgcttggtatagtatttttggctgatagttttaaaaaatttcagcactttggatatatcatctcattctatcctagcctgtaaagcttctgctgagaaatctgctgttagtctgatgggaattttcttataggtgacttgtcacttttcttttaccgtttttagaattccctccttgtcttgagtctggtaccgtagactactcagccatcctgatgccctacctcttgtatagaaacaacccagatccaaagtggccagaaagttactttaccttctgaatttgtggtctttttcagaatctctacctgttaattctscatgactttattagtcattagatacttttataattttaaaatatctccaattgtatggttggttcaaattaccagttctgcatactggtaatgtaagtcctctgttgaattgatttttaaatacatttattttattccagtatcttctagctcctggtgttgcagatgagaagtttcaaataacttgaaataattcccttctatgtaattatccctgattttgactttctttccatagttatatattttttctatgctattatattctcattttaaagatgttgaatgacaatgtaattttcttttctttacaagtggtagcttatttacaagtatttttgaagtttattttcctggaaagttttcttaaattatagattttagtatttcttctgttttattacttcagatttcttcttcaatggctccaattatatttgtattagatattctttgcttttcttttgtagctaacactcctaaatcctacctagctcttttttaaaaaatattttactttttattcttgttttcatcttatagttttctttaggcattatccatagtgtttatatgctgttatgtgccttctggtttagtgtttacttctgaaaaaattattttccttttttttaatattttactgagttttctcatctctcttttcaaagcttttcttctccaatcatatcattactgagtctctctaattctgatttgtgtattcttgcatagcttttcattattttctaaaaatgtttaagttgttttcaaatattacrtagcaatttgtggaattttttttcttgtgtgtatttatttcctttagtgtaattatttgtcctctcctttaaaaataattttatatcagatttgcccataatccttttcttatgctcatttttatatgaaaagtgctcccccataattttagaagaaacagaccaggataattttcctatctttgttgctctatagatttctattcagctattgtcatgaaatgataaaaatataattttttaatgtcttactttgtgacatcctttaccctttttacttggacctttttcctttgtttaattgtcccccacccacaccattctgcttcatatggactcaattcctatcagttcctcctcagtataggggtttttgctacaagaagacatttgttagttgacaagttcatagggctaagacaggtttagcacaatccaatctatttgtagtcccttctgctaagttttgaatttgcttttatttctaatattttactgagttttctcatctctcttttcaaagctttcttttttttcttactcagggataattgaattaggaccttcgatttccccccttccacccatgactattgttctcaaattgttttactatgctttccagtgagtacttattggcactttttggagttcttcaattctcaacaccatcaaaagccccataaccttcttttgcttcctcctgagactcttttcatgtgcttattggtcatttctttatcctcttcggagaaatacctattcagaacttttgcccaatttttaattggtttattcgtttttcaattgttgagttgtaagagttctttatatattctagatgcaattactttattagatatataatttgcaaagattttctcattgagggtgttgtcttttcacattcttttttagctcccacttataagtgagaacatgtagtatttggttttctgtttctatattaattcacttgggataatggcctgcacctccattcaatgggctgcaaagggcatgatctttttctttctttatggctgcatagtattcaatgacgtatatgtacaatactgtattgtattgtattgtatttttttcagacaaagtctcactcttgtaccccaggctggagtgcaatggcgcgatctcggctcactgcaacctccgcgtcccgggctcaacaattatcctgcctcagcctcccgagtagctgggattacaggtgcctgtcaccaggcctagctaatttttgtattttaagtagagacagggtttctccatgttggccaggctggtctcgaactcctgacctcaggtgatccgcctgcctcggcctcccaacatgctgggattacagrcgtgagccactgtgcctggccaatgtactgcattttatttatccagtgcaccattgatgggcatttaggattattctctgtctttgctattgtgaatagtgccatgatgaacatacacatacatgtgtctttatagtagaatgacttatattcctttggttatgtacacagttatgggatttgctggcttgaatggtaagttctttgagaaatcttcaaactgctttccacagtggctaaactaatttatattcccgccagcagtgtataagcattcccttttctctgcaacctcaccagcatctgttatttttgactttttagtaatagccattctgactggtgtgactgcaacctccacctcctgggttcaagcggttctcctgcctcagcctcctgagtagctgggactgtgcaggcacacaccacaaagcccagctatttttcttttttttttttgtattttaagtagagatggggttttgacgtgttggccaggctggtctcgaactcctggtcttaagtgatccacctgccttggcctcccaaagtgctagtattacaggcatgagtcactgtgcccggccctttgcccattttttgatgaggttgtttgttttttgcttgttaatttgtttaagttccttatagattctggatattagacctttgttggatgcatagtttgctgatattttctcccatcctgtaggttgtctgtttactctgttcatagttgtttttattttttaattttatgggtacataataagtgtacatatttatggggtatatgagacattttgatacaagcatgcaatgcacaataatcacatcatggaaaatggaatggccattcccttaaacatttattctttgcacaaacaaaccagttatgctcttttagttatttttaaatatacaactaaattatttagaccatagtcaccctattctgctgtcaaatactatgtcttattcattttttctattttttatcctcattaaaaatctccactttctgtccacaccccactaaactttctagcctttgttaaccattcttctactgtctatctccatgggttcaaaaaatatatttttttattatactttaagttttagggtacatgtgcacaatgtgcaggttagttacatatgtatacatgtgccatgctggtgtgctgcacccattaactcgtcatttagcattaggtatatctcctaaagctatccctcccccctccccccaccccacaactgtccccagagtgtgatgttcccttccccttcctgtgtccatgtgttctcattgttcaattcccatctatgagtgagaacatgcagtgtttggttttttgtccttgcgatagtttactgagaatgatgatttccaatttcaaccatgtccctacaaaggacatgaactcatcattttttatggctgcatagtcttccatggtgtatatgtgccacattttcttaatccagtctgtcattgttggacatttgggttggttccaagtctttactattgtgtatagtgccacaataaacatacgtgtgcatgtgtctttatagcagcatgatttatagtcctttgggcatatacccagtaatgggatggctgggtcaaatagtatttctagttctagatccctgaggaatcgccacactgacttccacaatggttgaactagtttagagtcccaccaacagtgtaaaagtgttcctatttctccacatcctctccagcacctgttgtttcctgactttttaatgattgccattctaactggtgtgagatggtatctcattgtggttttgatttgcgtttctctgatggccagtgatgattagcattttttcatgtgtcttttggctgcataaatgtcttcttttgagaagtgtctgttcatatcctttgcccacttttkgatggggttgtttgtttttttcttgtaaatttgtttgagttcattgtagattctggatattagccctttgtcagatgagtaggttgcgaaaattttctcccattttgtaggttgcctgttcacgctgatggtggtttcttttgctgtgcagaagctctttagtttaattagatcccatttgtcaattttggcttttgttgccattgcttttggtgttttagacatgaagtccttgcccatgcctaagttctgaatggtaatgcctaggttttcttctagggtttttatggttttgggtctaacgtttaagtctttaatccatcttgaattaatttttgtataaggtgtaaggaagggatccagtttcagctttctacatacggctagccagttttcccagcaccatttattaaatagggaatcctttccccattgcttgtttttctcaggtttgtcaaagatcagatagttgtagatatgcggcgttatttctgagggctctgttctgttccatttatctatgtctctgttttggtaccagtgccatgctgttttggttactgtagccttgtagtatagtttgaagtcaggtagcataatgcctccagctttgttcttttggcttaggattgacttggtgttgcgggctgttttttggttccatatgaactttaaagtagttttttccaattctgtgaagaaagtcattggtagcttgatggggatggcattgaatctgtaaattaccttgggcagtatggccattttcacgatactgattcttcctacccatgagcatggaatgttcttccatttctttgtatcctcttttatttcattgagcagtggtttgtagttctccttgaagaggtccttcacrtcccttgtaagttggattcctaagtattttattctctttgaagcagttgtgaatgggagttcactcatgatttggctctctgtttgtctgttattggtgtataagaatgcttgtgatttttgtacattgattttgtatcctgagactttgctgaagttgcttatcagcttaaggagattttgggctgagataatggggttttctagatatacaatcatgtcttctgcaaacagggacaatttgacttcctcttttcctaattgaataccctttatttccttctcctgcctaattgccctggccagaacttccaacactatgttgaataggagtggtgagagagggcatccctgtcttgtggcagttttcaaagggaatacttccagtttttgcccattcagtatgatattggctgtgggtttgtcatagatagctcttattattttgagatatgtcccatcaatacctaatttattgagagtttttagcatgaagggttgttgaattttgtcaaaggtcttttctgcatctattgagataatcatgtggtttttgtctttggttctgtttatatgctggattacatttattgatttgcatatattsyatcccagggatgaagcccacttgatcatggtggataagctttttgatgtgctgctggattcggtttgccagtattttattgaggacttttgcatcaatgttcatcaaggatattggtctaaaattctcttatttggttgtgtctctgcccggctttggtatcaggatgatgctggcctcataaaatgagttagggaggattccctctttttctattgattggaatagtttcagaaggaatggtaccagttcctccttttacctctggtataattcggctgtgaatccaatattttgttttgtttttcctttttgagacaggtcttgctgtgtcacccaggctggagtgcagtggtattaacagaactcagtgcagccttgacatcctgggctcaagcaatcctcctgcctcagcctcctgaatagctgggaccacaggcatgtgctgccatgcccagctacttttttgattttttttgtagagatgaggtctcactttgttacccagtttggccttgaattcctgggctcaagtgatcctttaacctcagcctccaaaagtgctgcagttacaagcatgcgccaccatacctggccttgttttgatttttaggtaccacaaataagtaagaacataygatatttgtctttctgtgcctggtttatgtcacttataatgacatccagtttcatccaggttgttgcaaatgactggatcttgttttttttatggctgaatagtactccattgtgtatatgtaccacactttcttttctgtttttttagacagtctcacttttgtcgcccaggctggagtaccgtggcgcaatcttggctcaccgcaacctctgcctcctgggttcaagcgattctcctgcctcagcctcccaagtagctgggattataggcacgtgccaccacggccggctaattttttatttttagtagacacggagtttctccatgttggtcagactggtctcaaattcccagcctcaggtgatctgcccacctcggctttccaaagtgctgggattacaggcgtgagccacggcaccggcccattttctttacccgttcatctgatgatggacatgtagattgcttccaaatcttggctattgtgaacactgctgcaatgaacaatgggagtgcagttatctcttcaatatactgatttccgttcttttggaaagaaaggaaatcctacctagcagtgggatttctggatcacttggtagctctatttttggctttttgaggaaactccaaactgttctccatagtgcttgtactaatttacattcccaccaacaatgtacaaagkttccctttttttcacctctccagcattttttattgcctgtcatttggataaaagccattttaactgtggtaagatgatatctcattgtagttttgatttgcatttctctgattatcagtgatgttgagtatcttttcctatacctgtttgctattagtatgtcttcttttgagaaacatctattcaactcttttgcccattttaaaattagattattagatttttttttctatagagttgtttgagctccttctacattctggttattcatcacttgttagatgggtagattgtaaatattttctctcaatctgtgggttgtctcttcactttgttgattgtttgcttttctgtgcagaaggtttttaagttgatgtgatcccatatatccatttttttcctttggttccctgtgattgtggggtattactcaagaaatttttgcccagactgatgttccggagagtttccccaatgttttcttgtagtcgttttatagtttgatgtcttagatttaagtctttaatccattttaattcaatatttgtatatggtgagagataggggtctagtttcattcctctgcatatggatatctagtttcccagcacagactgtcttttctcgagtttatgttcttggcaccttcatcgaaaatgagttcattatagatatgtggatttgttttttggttctctattctgttccattcatctatgtgtctgtttttatgccagtgccatgatgttttggttactatatctctatggtataatttgaagtcaggtaatgtgattcttccggttttgttctttttgctcaagatacctttaggtattatgggtattttgtagttctatatacattttcagattgtcttttctatttctgtgaagaatgtccatggtattttgacagggattgcattgaatttgtagattactttgggtagtatgaacatttttacaatattgattcttccagtccataaacatgcaatatctttccatttttttgtgtcctcttcaatttctttcatcagcattttatatttttcattgtggagatctttcacttctttggttaattcctaggtatatttagttttattcgtggctatcgtaaatgggattactttttaatttcattttcagattgttcactgttgggacatatagaaatactactaatttttgtatgttgattttgtatcctgcaactttactgaatttattgttttaatagttttttggagtctttagatttttttaaaactgagattatatcatctgcaaacaaggataatttgatttcttcctttctaatttggatgtcctttatgtcttctctctctctctctttcttttttttttttttttttgagatgaggacttgctttgttgcccaggctggtctcgaactcctgggctcaagcaatcctcctgcctcagcctcccaaagtgctgggattacaggtgtaactcacttcgcctggcctaggaagccctttatttctttctcttgtctaattgctctagctaagagtactatgttgaatactatgttgaataacagtggtgaaagtgggcatccttgtcatattctagatcctagagaaaaggctttgagtttttgcctgctcagtatgatactagctgtgagtctgtcatatatggtttttattatgttgaggtatgttccttctatacccagatttttgagggtttttaagatttcaatagttttgggaaacaggtcgttttcagttacatgggtaagttatttagtggtgatttctgagattttggtgcacctgtcacccaagcagtgtacaccgtacctaatatgtgtagtcttttatctttcactcccctcccacccttccctccaagtcccccaaatccattatatcattcttatgtctttgcattctcatagcttagctctcacttgtatgtgagaatatacaatatttggttttcgatttctgagttacttcacttagraaaatggcgtccaggtccacccaagctgctgcaaaagctattattttatttagtttatggctgagtagtattgcatggtgtatatataccacattttctttatccacttgttggctgatgggcatttaggttggttccatatttttgcaattgtgaattgtgctgctatcaacatggcttgcacatgtgtctttttcatgtaatgacttcttttcctttgggtagatacctgatagtggcattgctggatcaaataatagctctacttctaaatctttaagaaatctccaaactgttttccatagtggttgtgctggtttacattcccaccaatagtataaaagagtgtccttttcaccacattcatgccaacatctattactttttgatttttaaattatagtaattcttgcaggagtgaggtagtgtctcattgtgcattaggaaatttagtatacaataaagacagcatttttattgaggaaaggatgcattttaaaaaacaagtttttcaaaaatatagggaggattgtggttacttctagaaacagtagtgcagtcaggraaaattcagcacaatatgtatcagtggaattcatctgatcaaacttaaaatattattccttgcattatagttctgagcaggtaccatagataatagttctattgtgttgttcactttaaactagagcaagaaacttttctaataagtggaattgggagctgtctagctggtgttggcctgataaatgcttaatacacatgaatgtgcatgcatatgtatgcatataccatatacatatattataaatttaactgatataaaagatgtttggtaaatagtttaaaatagtaataaaatatacaattctccctattatcaattattacagaatgtttcccttgatttttgctgaacttttctatccataaactatctatggttgtaattgacaagtatagttctcacatgaatgtctgttggtattttcatttatcttaacaaataatatagagtaaaatgacaaagacattgaatcttgacctgtttgtcaatgatgtgacttccttgctgcattggataatacctcttaaatactggaaaattatttgttgatttttggtctattcacaatgtaacagctacaaatatgatacactttaaaaaataatggtataatttaactttttaatttttttatttcaatgggtttttggggaacagtatttggttacatgaataactactttagtggtcattgctgagattttggtgcacccatcacccgagcagtatacattgcacccagtttgtagtcttttattcctcacccccttcccaccctttccccctaagtccccaaagtccattgtattatacttatgcctttgcatcctcatagcttagctcccacttatgaatgagaamatgtggtgtttggttttccattcctgagtttcttcacttagaataatggtctccagttccatccaggttgctgagaatgccattatttcattcctttttatggctgagtagtattccatggtgtattatatatataatacatatattttatatatatgtatattacaattyctttatacacttgttgattggtggctatttggtctgattccaaatttttacaattgtgaattgtgctgctataaacttgtgtgttcaagtatctttttcatataatgacttttttttcctctgggtagacacccagtagtgggactgctggatcaaatagtagttttacttttagttctttaaggaatctccacactgttttccatagtggttgtactagtttacattcccaccagcagtgtaaaattgttcccttttcaccacattctggccaacatctattatttttttattatgaccatttttgcaagaataagatggtatcacattattgttttaatttgcattttcctgataattagtgatgttgagcatttttttatatgtttcatatcttcttctgagaattgtctgtttatgtccttagctcactttttgatgggatttgtttttcttactgatttgtttgacttccttgtaggttctggatattagtcctttgtctgatgcagaatttgtgactattttctcccactctgtgggttgtctgtttactttgctaattcttttctatgcagaagctttttagtttaattaggtcccatttatttatttttgttgtagttgcactttcttttgggttctcagtcatgaattgtttgcctaagccaatgtctagaagagtttttctgctgttatattttagaattttcatggtttcaggttttagatttaagtctttgatccatcttgagttgatttttgtgtaaggtgagagatgaggatccagtttcattcttccacatgaggcttggcagttatcccagtaccatttcttgaataaggtgtcctttccacactttgtgtttgtatgctttgttgaagatcagttggctgtaagtatttgactatatttctggttctctgttctgtttcataggtctgtgtgcctatttttataccagtaccatgctggtttgataactacagccttttagtataatttaaagtcaggtaatgtgatgccttcagatttcttctttttgttttgtattgccttggggatgtgggctcttttttggttccatatgaactttaggattgtgtttttctagtcatgtgaagaatgataatgatattttgctgggaattgcattgaatctatagattgcttttgacagtatggtcagtttcacagtattgattcctgtcatccattaacatggaacatattccatttgtttgtgtcatttatgatttccttcagcagtgttttgtagttttccttgtagagatctttcacctccttggttaagtatattccgaagtgtattagtcagggttctctagagggacagaattaataggctagatgtgtatataaaggggagtttattaaggagtattaactcacacamtcacaaggcccaacaataggccatctgcaagctgaggagcaaggaatccaatctgagtcccaaagctgaagaacttggaatccgatgttcaaggggaggaagatccagcatgggagaaagatgtaggctgggaggctaagccagtctaatctctccacgttcttctgtctgcttttattctggctgcactggcagctgattagatcgcacccacccagactgagrgtaagtgtgtctttcccagtccactgacacaaatgttagtctcctttgataacaccctcacagacacacccaggaacaatactttgcatccttcaatccaatcaagttgacactcagtattaaccatcacaagtcctccccttgtcaacttgaacccatacacacctcctgaaattatagataatcttcaaattaagacaataataaggtcataattattcccaacatgatacaactatccttcatacaaccaagaatgcaccaattcccaacccaaatgctattacataaagttaacatttaaattttcatatgaagtcaataaatcttatgtcacatgataaacaagaaaggaaataaaatgaagatattttcttagtacaaatgtataaatgcacaaacatgtttttaacaaagaaggaggaaatactcacgacaattaaartcctcatttctgcaactggttgtgtggttcatagctggtattgatgactaccttcctctactactcattctgtattccctttgccttcagcaagcacctcagcaggtagtggttttttcctggtgtagtgacccaaaccttcattcctgaaggatctgggccatttgtagtcctgcctggattgtgctgttgtagtttcccattgacacagggcatggtaatactaagagacaccctaagggatcttgtgtattccatgcatactcttccttacctccactgtggagtagtagactgatttcatcttgagagtctgggtcagtcaccccagccaacactgtaacttccttcttagattgttggtttaaaggtaggaggagcccaaaaagtgtcccggtgtcaatcttaatttccagtttaatggaatcgtggttgtgtcttctggtggcagcattcctccctctggaactaagamctctaggccagcagaacataatgtcacagggacagtaagcaaaaattttactagtgggtcactaggggtgatggtaagtggtgccacttccacttccacyccttgattcctggacctgtgaattccggctatgggagaaacagtaccatatattggatgctgattcagagcatacacaaccttctggagaattttgccccagccctgcaaagtattgtcacctagttgacattgtaattgtgacttcaaaaggccattccatcattctatcaatccagctgcttcaggatgatggggaacatgtaaagaccagtgaattccatatgcatgagcccgctgctgcacttctttagtcgtaaagtgagtgccttggtcaaaggcaatgctgtgtggaataccacgatggtggataaggcattctgtgagtccacagatggtaatcttggcagaagcaatgtgtgcaggataggcaaacccatatccagagtaagtgtctattccagtgaggacaaatcgctgccctttctatgatggaagaggtccaatataatcaacttgccaccaggtagctggctgatcaccctgaggaatggtgccatatcaagggctcagtgttggtctctgctgctggcaaattgggcactcagcagtggctgtagccaggtcagccttggtgagtggaagtccctgttgctgagcccatgtgtaacctccatccctgccaccatggccactttgttcatgggcccattgggtgatgacaggggtggctggggaaagaggctaagtggtgtccacagaacgagtcatcctatccacttgtttattaaaatcctcctctgctgaggccagccgttggtgagcactcacatgggatacaaatatcttcacagtttttgaccactcagagaggtccattcacataccttttccccaaatttctttgtcaccaattttccaatcatgcttcttccaagtccttaaccatccagccaaaccactggctacagcccattaatcagtatataattgcacatccggccatttctccttcatgaaaagtgcacaaccaggtgcactgattgaagttctgtccactgggaagatttcccttcactgctgtccttcaggtatgtcctaggaaggggctgtagtgctgcagctgtccactttcaggtggtggacatatcatgcagaaccatctgtgaaccagtccttagtcttctcttcctcatcaactgatcatagggaactccccatgaggccattgttgcaagctggggaagagaaggaagggcggcaggagtggagaccatgggaatttgagccactacctcatgtaacttacttgtgccttcaggacctgctcgagcccgatcacatatataccacttccatttgatgatggaatgctgctgtgcgcaccccactttatggctagatggatcagaaagcacccagttcatgataggcagttcaggttgcttggtgacttgatgacccatagtcaaatgttcagtttccaccaaagcccagtaataggccaagagctgtctctcaaaaggagagtagttagctgcagaagatggaagggccttgctccaaaatccttgaggtctccactgtgattcacttatgggggcctgccaaaggctccaaatagcatccctatctgccactgacacctcaagcaccattggatctgctgggtcatatggctcgagaaacagagcaacttgcacacagcctggacgtgttgtagagtcttctcctgttctgtactacattaaaaagtgagagccttttkggttactcgataaatgggctggagtaacatacccaaatgaggaatgtgttgcctccaaaatccaatagtcccaaataagcctctttcgtggttgtaggaggggccaaatgcagcaacttatccttcaccttagaaggaatatcttgataggccccactccactggacccctagaaattttactgaggtagaaggttcctgaattttagtcatttattttccatactctggcatgcaaatgtctcaccaataagcccagtgtgtttgctacttctcactcactgggtccaatcagcaaaatgtcatcaaggtaatgaaccagtgtgatatcttatggaagggaaaatcaatcaagttctctccaaacaagattatgacacaaagccrgagagttgatatacccctgaggtaggatggtaaagatatattgctggccttgctgactgaaggcaaattgcttctggtgggccttatggacaggaatggagaaaaaggcatttgccaaatcaatggttgcataccaggtaccaagagatgtgttaatttgttcaagcaatgaaaccacatctagtacagcagctgcaattgcagttaccatttggttaaacttatgataatccactgtcattctccaagatccatctgtcttcttcacaggctaaataggagagctgaacggggatgtggtgggaatcacaacccctgcacattttgagtccttgatggtggcactaatctctgcaacccatccagagatgtgatatgttttttgatttactatttttctaggtagaggcagctctaattggtcttcctattttgtcttttccatcataatagccctcactctaccagtcagggagccaatgtgggggttctgctagctgctaagtatacstatgccaattatgcattctggcactggggaaatgaccacaggatgagtccagggacccactggacccactctaagtcagacttcagctaaaactccataagcccctactttaactggaggaccaccaggacgttttcggtcccctggagtcaacgtcagcttagagacactgttcagtagtccctgaaatggcaatcatttccctttccccaatcacagttactctggtaaaaagccgtaggtctccatggggaaggatgggagaaagactaacagcataaattgttgtcagtgtcatccttgtatccctgggataaatcccacttggtcataataagtgatcttttaacagcgtaaattgttgtcaaggggaaccagcctccccttcatttaagggattctaggtctgtaaactggtttaagtctggaaattgattgaggggaaattgatcctctgtttttataattcaaattagtcttttgtccacttgacctggaagttttctgcttatataaattaaataagaatgcaataggcttcctatcattttcacttctaggaacaccatgattaatcaacagatgccagagatctacatgagtcagactattgtgattgctgctttgcctctgctgtccattatggtagctatgcccaccttgcctttgacagttgactggcccctgccacctcgagatccaattattcccattgcatttaagttttgtagttgagtgactgtggttcctactgtaaaatctggcatacagagaagagcaatcacaaagctcttcaaggatgcaggtactcccctcacaaatctattttgcaaagtattagtcaaggatatattttctggatcctcccagctgggatgagtaggtctaaactgactaatccactccaccatcccaatctccctaaaccttttgatcccttcctctacattaaaccaagggagatcaggcatttccagcttgctcacagtgggccatcttttaatccatatttcagctaaccaagcacataaattatcagaacctttttaaactccccaagctgcaacattaaatgcagaatccctgcttagtgggcccaaatcaataaattcagcctgatccaatgccttggatctatgttccatccaccattatcccacacccttaatatccattcctatgcctgtcctccagatttttgcttatataaataagaaagctcaagcagttcttttcgagtgtagcacacctcctcatgggttatactctgaacctcacccctagggccctcctgggactttagtctagttataggtctagaagcaaacaggggtggtggggggtgggtcctgaggagaatcaacattatcttgcctggcaactgcctcaggggaagccatcactrttgcctcaggcagtgcagggtttttctcctcagacaaatgtggaaaggctgatggcagtgtgggttggggaggacatgttgccactactggggatgagaaagctgtttcttctggcaaaaaaagtttcatcagaatttayaatctcagtgtccccagcttcatcagggtccttttacatatccccattccaagtttcaggatcccattcttttccaatcaatgccctcatttcaacagtagacacctggcaaggctgtgcatgcacctttcattgcaggtcagccactggtatgataagaacttgtgtccaatttcccgcaatttyagctctttctctacaggagataagactctcactcagggcaatcttagcaggtttgaggttcagtatctgcttctgaagctaggaattagaatccctaagttcatcattttctttcatcactttgtccagtgaacttaggaggaaccaaccaacttcattatgttccttagttccccacatatggtcaaaggtattacatatagagttactaaactccttgcctctcacgaaccgtgcatcaggagtgtcaaatgaatttattttgtgtaactctgtaaacagttcgtgccaaggactatcagtgttctccatactattagaagtacagtccttagcatttttgggtctaatcatattaagcagccttctccagaaaccccaaaaccaatgaaagaactccatccttaatagtctgttcttctggaaccactcctgggaccaaaatctgtattagtcagagctctctagaggacagaactaataggatagatgtatatataaaggggaggttactaaggagtattaactcacatgatcacaaggtcccacaataggccatctgcaagctgaggagcaagcaagccaatccaagtcccaaagctgaagaacttggagtccaatgttcaagggcaggaagcattcagcacaggagaaagatgtaggctgggaggctaagtcagtctaatctctccatgttcttctgcctgtttttattctggctgtgctggcagctgattagattgtgcccacccagattgagggtagatctgcctttcccagtccactgactcaaatgttaatctcctttgatgacaccctcacagatatacccaggaacaatactttgcctcctgtaatccagtcaagttgaccctcagtattaaccagtacactaagtatttttttttttttttgcagctgttgtaaaagggattgagttcttaatttgattctcagcttggttattattggtgtatagcagtgttgctgatttgtgtgcattgattttgtatcctggaactttactgaattcatttatcagatctaggagctttttggatgaatctttagggttttcagagtacatgatcatattgtcagcaaacagcaacagttttaacttcctcttttccaatttggatgccctttatttcttcctcttgtctgattactctggatgagactttcagtactatgttgaatagaagtggtgaaaatgggcatccttgacttattccaggtctcagggggaatgctttcaacttttctccattcaatatgatgttggctgtgggtctgtcatagatggcttttattactttgaggtatgtcccttctatgccaattttcttgagggtttttatcataaagggattttgaattttattaaatgctttttcagcatcaattgaaatgatatatggtttttggtcttcattctgttgatatgatgtatcatattgattgatttgtgtatgttgaatcatccttgtatccctgggataaatcccacttggtcttttaactgtattgttgaattcagtttgctagtattttgttgaggatttttgcatcaatattcatcagatatattggcctggagttttattttattttgatgtgtcattgtttggtatcaggataatactggcctcatagaatcagtttggaagttaacccctcctctactttttggaatagtttgagtaggattggtattagttcttctttaaatgtttggtagaatttggcagtgaagccaatgggtcccaggctttactttgctgggagactttttgttacaactttgatctaattacttgttattggtctgtttaggttttaatttcttcatagatcaaccttggtaagttgtatgtgtctaggaatttatccatttcctctagatttttaaatttattggcatatagtggctcatcatagccactaatgatcctttgaattcctgcagtatcagttgtaatgcctcctttttcagctccgattttatttacttgggtcttctctctttttttcttcattagtctgtttaaaactttgtcaattttatttatcttttcaaaagattgactttttgttttgttgatctcttgtattttcatcatttcaaatatatttctgctttgatctttattattttctctactaattttggattcagtttgctgctgcttttctagttctttaagatgtatagttaggttatttaaaatgaggttttcattcttttccaatgtaggcaattacagctacaaatttccctctaatagtactccttttgttgtatctcataggttttggcatgttgtgtttccattatcatttgtttgaatcaaattttcaatttccttttaaatttctttattgacccactggtcattcaggagcatattgtttaatttccatgtgttcatgtagtttccaaaattccccttttttatttctaattttacttcattgtggtcagagaagaatcttgatatgatatcatttttaaaaaaatattttaggacttgtattgtgactagcatatggtctatctttgagaatgatccacgtgctgagaagaatgtgtattctgcagctgttggatgaaatgctccataactatctattaggtcaatttgttctatagtgcagattaagtctgatgtttctttgttgagtttttgtctgtcagttctgtccaatacggaaagtggggtgttgaattctccacctattattgtattgtgatctctatctctcttttagctctaatactatttgctttttatatctgggtgcttcaatggtgggtgcatatatatttataattgttatatcctcttgctgaattgaccccattatcattgtacaaagaccttctttgtctctttttggagtttttgtcttgagatctattttatctgttataagtgtagttacccctgctcctgttttgtttccattagcaaggaatatcttttcccatgtctttattttccagtctatgtgtatcttcataggtgaagtgtttcttgtgggcaacagatcaytgggtcatgttttttcatccattcagccactttatttctttttattggagagtttagtccatttacattcaatawtttcatttaagtaggaacttcctcctgccattttgtaatttgttttctcgtggtttcatggtcatctctcccttctttccatcttctttttcatgaaaataattttctctggtggtatgatttaatttcttgttttttattttttgtgtatccattgtatgtttttccatttgaggttacatgaggtttatgacttatcttatgacccattattttaaactgatggcaacttaacagactgcataaacaaaaaacaaacacacaaaaggaagactaataaaagttctacactttaactgtatcctcctgcttttaactttgtgttgtttctctgtgtcttattgtactatgttgtgaaaagttgtcttttttttttttttttttctgagtcagagtcttgctctgctaccaggctggagtgcagtggcctgatcttggctcactgcaacttctgcctcctgggttcaagcgattctcctgccttagcctactgagtagctgggactatgggcacgcaccaccacaacacccacctaatttttatatttttagtagagacggggtttcaccatgttggccaggatagtctcgatctcttgacctagtgatccgcccatcttggcctcccaaagtgctgggattacaggcatgagccaccatgcctggccaggttgttattatttttgaccagttcatcatttactctttctacttaagataagtttacataccacaattacagtgttataatattctgtgtttttctgtatgcctattcttaccagtaagtgtctcggcattgaagagctaggtatttcttatagtctttgcagtctgggcttgtttatccctgtccttcttgagaaggttttccagaaggtttttatttgaaggagcttgggcctcaatcccaataatactgtggtttttgcagactagtagaggtaccatcttggaggtcttgaataagatccagaatgattatctggattgccaggcaaaagcacttgttcttttcccttactttctgtcaaacagtctctttctgtctctctctctctctctctctctctctctcaaggtgctgggccatcttgaactaggggtatggtgatgcaagcactcctgtggcccccactttggattgtgctgggtcagacctatagccagcacagccctgggtcttgtccaaggcctgctgtaaccactacctgactaccacctatgttcactcaaggccctagggctctaagatcagcagggggtgacaccagccaagtttgcatccttccctttagggtagcaagttccccctggccctgggcaggcccagagatgctacttgggagtcagggattggagtcaaaatacttagaaatttgcctgatattttatttgactayggctaagctggcactcaaaccacaagacaaagtctttcccattcttccctcccctttccacaggcagaggtgcctctccctgtggccagtactaccactggtccacagggaatctgcctggccactgctgatgttcacttaaagcttaagggctgttcagttgtgttgtggtgaatgctgccaggcctgggactcttcaaggaagtgggcacccctctgccctggggaagatccaaatatgctttccaggagccaaagcctggacttggggaccccaagagcatgcttgttgctctactccacgtggccaaactggtaccaaaggtgcaagacaaagtcccctttactttttcctctgtttctgtcaaacagaaggagtctttcactgtagccaccacaactaggaatgtgctggatcacacctgaagtcagcacatctcagaacctaaggcccacagtatactacctggatatcactgctggttatttggtgcccaagggctctttagtcagcaggtgattaatcttgccaagactgggtccttcccaccaaggcaatgggttttctatttgtccagggtgtgtctagaaatgtcatccatgagctagggcctggaatgcgggcctcatgactctactcaatgccctatcctactgtggctgagctggtatccaagatgcaagacaaagtcctctttactctttkctctcctctccttaagcagaaggaaggagtgacttttgttgctgcaagcttcactgcctgggattaggggaggggtggcacaagcactcccttagctgccccagctgatgacttcctaggtcatgtgccacccctatccctctggttctgagcccagcccagcactaggagttacctaggaattgcaatccttgtgtcctagactgtctttcaagtttacctagaacctcagagcacttaagcatatagtggtgaggcttgctgagttctgactgctgggatgagtgattcgcctctggccaggcctgttccaaaatctcccttcatgtgcagctgctggctgagtccagcacagtgttgttccctgctacgacagcaccgagtttaatgtaaagttccccagttgctgtgctttacttcctccaagtgcgcagactccccacgttgctcagctgctgctgggggatatgggagggstgatggtggtgatcccagagtgtctctccaaccctcttcaatgcctcttttagtgatacgttgttaaatctaggtactacgattgctcacctgatgtttggtttttgtaatgacgcttttcygtgtgcagatagttgttacaatttggtgttcatgtggcgggggrggggggggatggtgtaggcttctgttccactatcttgctccacctcaatagtctgatgtgcagaagytctttagtttaattaggccccatttgccaatttttgtttttgctgcaagwgcgtttggcatctttgtcatgaaatctttgccagggcctatgcccagaatgatattttctaggttttattctacggtttgtatagttttaggttttacatttaactctttaatccatctcaggctgatttttgttcatgctgaaaggaaggggtccagttttcagtcttctgcatatggttagctagttatcccagcaatattgagtaggaagtcctttctccattgcttgtttttgttgaagatcagataattgtaggtgtgcagctttatttctgggttctctaacctgtcccattggtctatgtgtctgtttttgtattagtaccatgttgttttggttactgtagccttgcagtatagttgaagttgggtagtgtgatgtccttcttgttctttttgcttaggattgctttgactatttgggctcttttttttttccatatgaatgttaggatagtttgtttttctaattctatgaaaaataatrttggtagtttgataggaacatcattgaatctgtgaattgctttggacagtatggttatcttaacaatgttgtttcttcctacccatgagcgtggaaggtctttccatttgttttatcatctctgatttctttcagtagtgttttataattctttttatagagatctttcacatccttgattagccatattcctaggtattttctttttgtgtatgtctattgtaaatggcattgtgttcttgatttggccctcagcttggatgttgttggtgtacagaaatgctgatttttgtacattgattttgtatgctgaaactttgctggaggttttatcagatgtaggagctttttggcagagaatatagggttttctaggtataaaattatattgtctgctaagagagataggttgacttcctctctgcctatttggatgccttttatttctttctcttgcctgatttctctggccaggacttccagtaggatgttgaataggagtggtgacagtgggcatccttgtcttattccaagtctcaaggggaatgctttggatggtaccaatccttttaaacttattgaggattgttttagataatgttccatgtgcaattgagaagaatgtatattatgctgctattggctatatgttctatagatgttgctatgatatgaatgtttgtgttccccaaattcataaattgaaacctaattctcatgttgatggtatgaagaggtgagacctttcaaacataattaagtcatgagggcagagccctcatgaatgggattggtgcccttataaaagaggcccagagaggtgccttgcctctttcaccatgtgaggacacagcaaraatgtgacatccatgaaccaaaaagtggcccctccccagacactaaatctgctggtgcctgaatcatgaactttcaagcctctagaacagtgaaaaataaatctctcttgtttattaactacacagcatatggcattttgttataatatcctkaacagactaagacagatatcgtttaggttagttggtttttagtgttgttcacatctttcatttcctagtgatcttctgcctagttgttgtccattattggaagtggagtattaaagtctccagttatgactattgaattgtctatttctcccttcatttctgccagtttttgcttcatgtgttttggggctctattattagatgcaagtatgtttttagttgctatatcttcctgattggtccttttgtcattataaaatgtccttcttgatttctagtaacrctttttgtcttgtctgttttgtctgatattagtgtagtcactccagctatcttgtggttgctgtttgtacaatatatgttttcccattcttttactttcaatctgtttgtatctttgaatctaaaagtgtctcctgcagacaacacatagttggatgttgttttcctaaaaactctagactgacaattctgccttttgattgggttctttaatgtattcacatgatgttactattgatatatttggatttatgtttgttattttactcctttttctatatgttttaattctctttttttcctatacttttcatttactgatttatattaagtgaatattttagaatgtaacatggtaatttttaaaataaattttaaactgtatcttttgagttattttcacagtagtttctctagagtttaccatatatattttagcttattggtatctgcttcagatttatattaacttaattctagtgagatataaatatgttacttctagatagctttatttctcttctgccttttgtattactgttacacatattacatcttgtggtggattgaattgtgggcctcaaaaatatatgtccacatagtaacctttggaacctgtgacctcatttggaaataagtctttgaagacataattatattagagatttggggatgaaattaccctaaattttcaggtgggggctaattccagtgaaaagtttgttttgttttttaaataagagatagaagatgagaaaacagacacagaggaaaaggccatgcgaagatggagacagagattggagtgatgtcaacagccaccaacacctggaaaaggcagaaacagattctccgtagagcctctaaagggagtgcaaccttgccaacatcttgagttttaattctcctctccaaacctgggagaaaaactgtcttaagcaacccagtgtgtagtaatttgtcacagcagccacagaaaaccaatgcacatttatagtattatatacccaacaatacatcgctataataattattactttatgtaatcttatattttttagaggcactaagagaaaaaaggagaaaattatatatttatggcatttcttatttgtcattgctagttctattcatttattcttgtggattcatattaccatctggtgtctttttttaatcagatacagctgttctcccacacacctcttttatactgtaattgacaaatttgttatatttctgtatgtttttggtccaacaatagagttctacatactgttttatgcaattcgttagactcaggttttctatttcaccttcgaagtgtggcccttaggccaggagcagtggctcacgcctgtaatcccagcactttgggaggccgaggcggatggatcacaaggtcaagagattgagaccatccttgccaacatggtgaaaccccatctctactaaaaatacaaacattagcttggcatggtggtgtgcgcctgcagtcccagctactcaggaggctgaggcaggagaattgcttacacctgggaggtggaggttgcagggaaccaagatcacgccactgcactccagcctggcgacggagcaagaccaaatctaaaaaaaaaaaaaaaaacaaacaaactgtggcccttagaacttaaagtcatattttggttctcaaatcagttccaagagtaggtgatctagccctttcattctaaacactacacatgtagtactagagtayaatattgtatttgcttattttttcagagtcagggtcttgctatgttttctagactggggtgcagtggggcaatcatagctcactctaaccttgaactcttgggctcaagagaatcctcctgcctcagtctcctaagtagctaggactacaggtgcacaccactacacccagctaatgcatttttttttaacacacataaagcacagttttttcacaatagattgacaacgataattcacgtcttttttgctagatgatattaagccacagatcaaaaagtcctagacttttatacttacttgaaaaaaacctcaaatttgctgaatgccattgtattaagagctaatctgtctggtccaatcacataatatatttgcctatattcaagtttcatatttctacatatttgataaacattcacactagattttcctctgtgctgcagacaaaaattttcttcaatggtgtctgaaaagggaggcctgcaaccactaccaaaccactctacctgagattagtttattagatagtgcctaacctgaaataaaaatctgctgatagaacattctgcaaaaaaagctctattatgttatagtagagctcatactatattatggtttcaaaggtaataagaaaaatatcatcagatcatcattatggtagctattttaagggaayttaataaaaatttaacagttatcatcaaacactggccacctcaattttaaacagtaaacacacgaattactcccataaaaattataagcataacaggacacttcttggctactattcaatactgacttggatgttctagataacacaagataagatacatgtgtgaatatctatacacatatagacatatttatagatgtgtgtgtatatatacagtatatatataagattttagaaaggaggataaatatatattacatgataaaacttatagtcaatataattttacacttgtaaaatcccagaraaccaaaggaaaaaatagaactaaaaaagagttcaatgaaatgattagtttaaaaaaataaatataaaaaatgtaattttcccacataccttcaaaatgtagcaatcccactaagcaaaaagtggtatttctaccaactatagataaatgaaaattcacctttaaatgtctcttatcctccatgaaactcatcaaaaacaacaaaaagtacagcagacaaaaaaaaagtcttatctttaatgaaactttgtaaaacatttgaacctcaaccatgatgtgtatgaagataagttactaagtgccatgaagattggaccaagatatgaaaatgctaggagaggatacctttcactgaagatcttggaaagggttggtatattggtattttctagagtagtgattctcactgagatgcaaaaccaaagactccttgttttggattaaaaagatctaggtacagaggctgagggcagaactctctcattatcctatttgtcaacacaaaataggagagaaggcaggactaaatctgagagtgagcagatgcaccattatttcaagattgaacctaaggatgtggcaaggtaaggagaaaagtcaggatgacaagttgccctgyagccgccagttctcatcagttgaagatatattaaaactatggtacacataagccactccatcaaacagtaaatatggctatactgcaagcagtaaaaaagtgaacaggctctgcttccatacagtcaagaacaaaaagaaacacttgacaaggttgagaaaaataaatggaaaaaaataaagaatttaaaagaactggagagaaaactgtagctttggaatacagaaaaaggagatacagcatactgctaatagatgtcctcaaagagaccaaatacatagacaaggggaaaaaatccaaagacatcattcaagaaaaaattttgagatacaaataaacttcagacttttacttccagcaatggaaatccagtttgtcttcagccagtggcatatctcagacaataggcaagccatgagaatggttgttggactgcagtttcggactctattactacatgtatagtatttagaataaaagagctaggtctcctcatgtcagcacttatttgaccaatgggagtatgattttaagtttttagggtcacactttgaaggtggaatataaaaaaaattatagaaagataaatttttgttcagatgcatctactgcagcaatttgggaggctaaggtgaaaggatcgtttgagcmsrrwmgtttgagaccagctgggcaacatagtgagaccttgtctctacaaaaaattaaaaattagctgggcgtgggggcgcttggcctagaagttcaaggacagtttgggcaacatagtgggaccctatctttataaaatatttttaaaaattagttgggcatggtggtgtgtgcctataatcctggctacttgggaggctggggtgggaggatcacctgagcccagagaggtaggggctgcagtgagccatcttcacaccactgcactccagcctggatgatgaagtgagattctgtcccaaaaaaaggacaaaatgaaatatcagcaatgaaaggtcctgctaaagagaaggtttgttaattcataattttaatgtttatctggtcatcttatccaaaaggcaaaaatctttagcctcccttatctttgggatatcgttctctcttaaatgttgctttctcacaaatcccaatttacttgaataagaatgcaatgttatgccaaaagttagggaggcatatggtgggacaaatcctactgggtggatggtttcttcattcttttcacaaatgaaatcttctgaaaatagacgtcagtggcagtttaaatagagaaatgggaaaaagggaagccaaaaatctgagaagcgtgtgaaagaggaggagtttctgtgaagatttcccatactgttctctgtatgcatttttccttttttcctcacgccctaatctatacccacacatactatccctctaggtgcagctcagaattcctaaacctggtataattggaggcatggctgcagacctaaaagttcggtacatctttacagttgtatttcatctgtttaaggcagaaagaataaattttcattccaaagcagttagcttgcttagcagcattaatttaaaatgaagaaatgcacatcctaatctctggcactgaagcagaaaattagttttggtttagaaatttggtgaagaataagttcaatttttatgggctgttttgcatcctggtgagatctaatgaggtctgtacttgtgactacctaataggctgacatgtttcctcctttaattttatctgagacttggtgtcaatgattttttggtttcttaattcaaaaaggcaaactagccaaggggtatttactacttatattgccttatatcacagtgtgccctttctagttccctagaagagataacgaatgggtttgtgtgtttagggaggtaactggtttttagtggaacactggcattatcaatcccactcttagtgttaaaaagagaatgcccgagctacccctctccccaccattttaatcagcaatttttaaatgttttcaaatattatagaaatatgcaggctgatgccaggtgcggtggcatggggctcacacctgtaatcccagcactttgggaggccgaggcaggccaatcacttgaggtcaggagttcgagaccagcttgtgcaacatggcgaaacctcacctctaataaaaatacaaaaattaaccgagcatggtggtgcgcgcttgtagtcctagctacttaggaggctgaggcaagagaatcgcttgaacctgggagggggaggttgcagggagctcagatcgtgccactgcactccagcctgggtgacagagcaagaacctgtctcaaaaaaaaaaataaaataaaataaaataaaataaaataaaataaaaagttaaaaaaaaaatgcaaggtgagtgcagtggctcatgtctgtaatcctagcactttaggaggctgagataagatgggaggatcgcttgagcccagaagtttgagaccagactgggcaacaaagcaacacgctcatctggaaaggaaggaaggaaggaaggaaggagggaaggaaggaaggaaaaaaaatttcaaacatacacaaaagttgagagaattgtgtaattgaccccaatgtaccatcacccagcttcaataattatcgatacttttaggcaggtttctaccagaaaatatgtcctggaaactttaattcttgatctgtgttcagattttgcctttcaaatgtttcattattggggctttggacatattgcacctgtattaaaagaaggatttgagtgaggratttagtgcttcatagtcaatagtcaatgagtctccttttggctcgcctccttcttagggaaaggaactggttgtagggtgttaggcagaatttgggtgtatctgttgtggctcagagatgtttctcatagaactgatcactgtcccaatatccacgcaaaagaccaaattaaaagcgaggagaaatacctaatgtaaatgacaagttaatgggtgcagcacaccaacatggcgcatgtatacatatgtaacaaacctgcacgttgtgcacatgtaccctagaacttaaagtataataataataataataataataataataataatawtaaagcgagggtgggtatctagcctattcttatcctgcctcatggtgttttctaaatatttacagaaagaaaatttacagagtagtttcctggtcaaactctaatgagtatctcagtactttcccctccacttctcacgtcttctttggggacgggtcgtcaagtctttgagtttctagttattgctattgactggtttataacctcctctttcacccagatcgtcaagggccgtttgcaaagcactcccaagtagagcctcttggagaaggagaaactgctatcacgcaaaaaaaaagccttgagctcgctggctccgctgcctcgaaaagccagagtccggaggcagtttgatgcggacactattccccaaccttcttcccctccttgtcgtctctattgccctcttggcagctcctgggatacaagagggtgcaggacagacttcaacccgcagcaggatccagcgcggaaagctctgcagcaggatccagcgcggaaagccccccgcagcacttctttcggggggctcctgtttccttaagcctagaaggtgtggtcgctcacgttcaccgtcccgcctctcgccgcctccgctcggcagctccacgctgagtcccgccctctccgccggagaggtgcgccggggtcagagcgccgggacccgacgcgcggctcccaaagggcggcaggaagagcccagctgggctcagccacagttatcagcaatctgcgggcagaggatgtggaggttaagatctgggcagcctcagggcgttgtcctagaaaacaccgtttaaggagagaagtgttagtgtctcggggcgtctcccaggctccgccctgcgcccgcagccagcgtkgtggtcgagaccccagcccgctgctactggagacagcacctctcgcgcccgggcgggcggcctcgtctctgcacccctaggcggcgctgcgctcctcaacacccggccggctccgctttcccagacggctgcccagcctccagcctagcaagcccggctcccagctggccagccccggcaatgccggcgttcgggaggcgcaacgtcggcggtcgctgagtatccagcccgcagcagtgacggccggcaggagcgtgctcttccccgcggctcgtgctctccaggagtccggagcatggtcctgggtcaccgttggtgtagcgtgttggtggaacgtggacgcctagagggaggatggtgggctgtggggtggcagttttatgtttgtgggtttcctgcggcgctgcagcgggacagctcgagtactcagtgccggaggagacggagcggggcgtagccgtaggcaatctctccgcggacttgaggmtgccagcggccgctatgtyctcgcggaactttcgcttcctttccagccaccgcgagctctacttcggggtggatctacccagcggcaatttggtggtcagagagccggcggaccgcgaacagctgtgcagggccaaagctgcctgcgtcttgacctacgacctggtgctcgaggacccgctggagctgcacaagattcggattcacgtcctggacaccaatgacaactcacctctctttcctgccggcgacgtgcagctgcacatccccgagttcctgacgcccggagcccgytttactctcccgaatgcccaagatgacgacgagggaagcaatgggatactaagctacagcctaagccccagtcagcactttcgcctggacatgggatcrcgggttgacggcagcgaatacccggagttggtgttggagaaagcactggatcgcgaacagcgcgccacccacctgctggtgcttacagctcgggacggcgggctacctgcccgctcaggagacgcacaagtcaccatcattgtggtggacacaaatgacaacgcgcctgtatttgagcgctccgtataccrcaccaaggttccagagactgcacccaatgggactgtgttattccgagttcaagccttggatccagatgaagggtccaatggggaagtccartactccctaagcaacagcacgcaagcagagctgcgacaccgctttcacgtkcaccctaaaagtggggaggtkcaagtagctgcttcactaggyccgcctgaaacgctcttggaggcatacattgaggcgagggacgaaggtgtctttggtttagctagcaccgctaaactgctggtggaggtgactgacgtgaacgatcatgcccccgaactggacttcctgactctttcgaacccagtacctgaggacgctgcccctggcacagtgattgctctctttagtgtaaaggatgaagacctcgattctaatggtagggtcatttgtggcatgtctagtgcaggcccttttcagctgacggcttcctttgacaactactacagcctgctgattgatgggcccctggaccgggagcagatcagtgaataccaagtcctgatcacggcctcagatagtggctcaccsccacttagcacccgaaggacaatcactgtgtcagttgctgatgtgaatgacaatacaccaaactttcctcaaccccrgcaggaacttttcgttgctgaaaacaatggccctggggcctctctaggccgagtgtttgcccaggaccccgacctggggaagaatggccttgtctcttatgagctgttggatgttatctctgaagggccatcagcctctarcttgstggcagtggaatcatccagtggggccatcactgccaaaacttcctttgactttgagcagctcagggggtttcatttccaagtagaaggccgggatggtggcattcctcccagaagtgcaacagtgactataaacttgtttgtggtagataggaatgacaattatccggttatcttgtttcccttgcccagaaatggttctgtcccagtggaaattgtgccccgctctgccaggactggacacttggtcacaaaagtggtagcagaggatgctgacagtggttctaatgcctggctttcctaccacatctcccgggcgtctgactctagtctctttagaatttcagccaatataggtgagctccgtactgctcgcttagttcttcccactgatgcagttaagcagagggtggtggtagtggttcgggaccatggagacccaccactttcctcctctgtcactctgggtgtgctgttgagcaactctgtccctcagttacttccagactttgaagatgtctgggaaccaggagggcagctttctgcccagaacttgtatttagtaattgccttggcttgtatttcctttttatttctggggtgcttacttttcttcgtgtgtaccaagttgcaccagagcccaggctgttgckctcagagctgctgtcgctctacagaggatctgaggtatggaagtaagatggtttcaaatcyttgcatgacatcagccaccatagatgtcactacagttgagagactttctcagacttatctctatcgggcctctctgggacttggttctgataataacagtttgctgttgcgtggggagtacaatgctgccgacctgcgaaatcttgccactggggtaggactgaatttgccaatatcctgtattcagattcggaataggaaaggggatcacgctaatgtcaatgccatggtaagcaaattttatggaatttgattcctttggcccggagatggctgctagctgtgttttgaaatatttcttagacaagcctttcacaacatttcatcaattgaaytaaacactccttcttagcacttcctgtgccaagaaatctggaagtatagaagtattagaagattgccctaggcctcaagggacttatagtttatttttgagaaacaarggcaaaaattaaaacctatttaagaacaataaaagtaatatgacataaaggtctaaaattaaaaataaaataccaaaatattttataagcaacagatgtgtaaggcactctaatatttaaagtgaagaatgaaaaatatgtaagagtctgctttatatgaatataatatggaaggtgaaacatttacttaaactattgcaatgcattattaaaagatgacgataaccacaaaagatgtaaaaataaattacaatgggggttaaaagaagggagaaagggaacataagagaacatttgagtgaggaggaaggagtcagagaaggctttgtgatagagatcacagatttagttggatctttaataygatataccatttaataaaaaacagtgtattctctagcctatacttttaatgaataccattttggtgaaggtgtcttctttgggaatgacaccctaaaacatagctgatagctccatagcagtgttttgtaactgctttggagtttttgcttacacaaaaactgtaagcctctctcataacatctatttatacwgataggagatcatattgttggatataggacttgacaaccttttgttttgtgtttctattgataatattttacaaagaggaaagatgagtaatttttatgtcagaaatatttatgtgttcaaaggtgcacttaccatccaaagtccattcaacttggatttaatttcttttattttaggggacaaatacacttaacaaataagtaaatatcatatttgagagtaatgtatctaatgaaagttaagtgattcaaatatttcaatttatctgttagtggcccttggcatttcaaaacttcttttttttttttgagacaggggtctcactatgttgcccaggctggtctcaaactcctagcctcaagtgatcctcccacctaggcctcccaaagtgctgggattacaggcatgagccactgcagctggccctcaaacttcttgagtgcagttaggacaacattttgaagcaattctacggtattactttttgacttctcatagaaatcctagatgcaagagaaggaggtgtgtagaaattaaggaaggaaaatgaagcattccttgttttactattctaggcaataaggggaaaagtggcttgtaagttattcttcctcaagtaatgatgttaactgcaaataaaataaatttacatatgttaaaattttctgtacttaatattttcacaatataatrgaatccagcatataagatatgcttagtaaatgctgactgaatgaataaatatgtgcatatatgaattggatggtaacactgttcaacacagagggaaaaactttaacttacttttctactttagatgtgtatatgtggttaacagtttaaaggtcactttcaaatgtactgtttcaatgattattttcttcctcatgacctacactaataacataacagaggaattttctgattgtagagctagcaagaaaaacttcaatgctgtgtctgggactaagtatgagtccagttctacagatgacaaaggaattaataggtatgcacatcattacattgtgatatttgcagtggatactatttaatagaatctcagttaattttagggaaggaaattggtgcactacaatgctagtatttcaggtatcagagcacttaatatgtgaacacttttcctaccaagaaatttcactatttatttcttttattttcattgctttctgtaacaaaaagagaggagaataccagtaatggctgtaaagtttgggagtgaggaattttttttagaaacacattttcactagactagaaaggaaacataagtaagcgataggaaggctgatgaatctagaagttagaaggaaaattagctatttaaaaggaaaaatataggaatgacagaggaaaaaacaacccttcaaaccaaatttttaaacatatatgaatgattaacaaaataatagagatatactgttcatatgtgcaggaatattgtaccatcccattcattcagttgaacagtctttttccatcattgttgatattttgctttttaggtagctcattggtctgctaataattgttgtgggctggatatttccttataaataaatgaattgtgattcataaaaccatgaataaaataacttctataaatatggggtatttgtaattcacaaaggcatttgttatttacttcttcctgttcaattacctattgatctgatcttaattctttagaaaagaattcttgtcatagtatcctgaatgccttaataacaacaggattctagaaataaaatatttattgctttcattttatttcaaatcatttgaaaagcatgacatttaacaatgattataatgtgtgtctgagtcttacagaatcatgttgatgcatatgtgtttatattttgctcaaattctaagttctttcattttagtttacggtaagtttacagtatatattaacatagcctgtaatactaaaaattatcagtttaagaaattcaggaaaacatggtttttatctctgtatttccaattgataatatttaagatataaacaaaattgattcactgattgtataacaattagacaatgtgtacctcatgtccatttttttctgttaatattcttgatgggcaatttaaattttttagaatggtatctaagagggtacctctgagatataaatttctacttattaaaaactgcattgacaatttttaaaggtataaatatattaatgtagcaaaaatgcatgaaacacttaccatacaactggccttattaaatttccacatgaaagttatacatagtttcaacataccaatgttatattagtgtattgttcacctggaattaaagcatcttcttttttgccagggtatataggaaataggatatctcctctttgcaatgtcatttgttaacagtagtagaatgtttgtggcattcaaggtgctttatttaacatacattccacaagtagactttcccatagggtaattagatgttttgtatatctattttgactttgaagctgataaccacactaaaaaactttagaatgatgaaactaaggaagtttgcatgacatatgaaatatattcaaattaaaaaactcatatagacaacacaataatattgtataatatagaccctcaaatcagtaaaaaggaaagaaaaagaacattataatttgagtggacataagagaaaagcaataccttggaaacatataagtgggaaagtattgacaatgtgtctcataatgttaatgacttattgtcttttgttgtcttcaatattttcagttagagggaaacaataatatttcaacaactaaattaacttagctaggttggaatgaaggtggactaaattgctgaaaggtttttacaatgctcaaatgcatgtcatatgaatatcggaaatattaacacttggcagaacttcaagtgaatatggattacagtccaggatcctgactaaagtattatgggaagtaaggaatttgttggtaaaggttgttcttaagaaacaaagctaaataataaaggtagatagccactcattttgttcccaattttaattgatggcataagataatggttcaggatataaataaattacatgtctgttatattgcatttatgaaaaagaaaggactataaacacaaaaggttattatatattcatttggaacttgttttggaatctggaaataaatatgcaatctcgtattctcctgtgctgtagagaaagataaacactttatttctaacccatcccaaattccttggctgttcctagagccatctggttaccatctacagatattctgtgttcataggggcactctaatgacataccttcaaaatatactctgaattcaaacacattatggttattctttagaattgttaagcaaagactacagctgttttgtttaaactcaaaataatgttaatataaaataaaaaccaattaagaagtcttaatagtgggtttttaggttgatttgtctttttcttttcttattaggttaggctggccctgttaaacaagttggaaatcctgtctctctctctgtctctctcacattttttttcctattcctcggacacatttactgagattggtgatacagctttcttaaatatttggtagaattcactagtgaagctctctgtacctacagttttctttgtaggaaaattttaattgagatcaaatttctttgtatttttattgctcctatttcattcctgtacctttaattttttcagatatatgttagttttatctgtacttttgaatattttggcataaagttgtttataatgtcctgttgtgactttttttcacatctgcaggatctgtagtgatgtttcccttttcaatcctggtgttagtgtcacctctcatttttcttgactagacttggaagtagtttattaatgatattagtctttccaaggctaacttttggtgttttgggttcgctttgttgtatgtttgctttctattttattaattttcatactttattaatttatttccttccttatatgtttatatttcagtgtgcaacagaagtactctaaacatacttttcatttctatttcctcacacaaaatgtttaaaagatttgtacttaattgtggagatttatcaaaattaataataatcagtgcttcatcaagggcattcttactggtatttttcttactgcaaatgtccaatcatgaatgtaataaccaccagtacagtgtggagccactgctttgactccttctgtggttctatggtggccagctttacccaccaatgcttttgcattatcaatgcaagtgtaaatatagtgaaaaatgcaaataatgttttaacattattttgaaaattatattcacctcataaacacccaaagsgtccatagaccacacttcgagagctaccgttctaattctatcatttcttcttttttttaattaattgtaacatttctgtaatgggtcttcaactatttgattagcctgaggtacagttcacacaggaaaggcaggataaatgtttgattcttcccctttgtttagcagtattcaaaacaatgaattgatkcctggccatcttacaaaaaggaccaaggccttttttaggtgtcattatgaactcattgacttaaacatatttgatatggcccaatccatgtcaattatctttttaatgatcaaattatgctaactttggcaagttgggaactgttcagctttgctcctgagtctttgtgagtgtgtttgtgtatcttgttttaaaccttttattttggaataattatggattcacataaagttacaaaactagtatagagagatcccatgtgcttgtcacccacttttccccagtgataacaccctgaatccttttcatgtgagtcttaatagtcttttgaatgcttccttgatttctggtattacaagatgttcagattatcttgtacatttcctttcccagaatcagccatttttcaaagagctttcacttatttttagtgaaagatgatacttagagatataatctcaacaacaggtgtgcttattgctgctgggtcagttgctgtttctaggtatcttcagctactgagctaagggatgtctattttttaaaagataaaatacatcacatgtttatactaatctaataaagttcagcactccgaggtttttacttaacttcatcaatcttacattcctatttctcccatacgtcaaatcccagttttcattaacgtcaacagaattactcatttgttatcccacgggactcaaacaatggacttagraaacaatttcagcactacagaaataatatgatactgtagcagtttaagtttttgtcattcttttcatttataaggcacatccttacaaatgcccagtaggcatgtacagtcaaattattgtgttttaaagtatcttggaaaagttcctctctgtgtagttaagccaccagctagatacagagctaggcttttttcaagtcgctttcaaatttagggcttgctttttaaattttaattttcttttataattatgtgaaatatttacatggctccaaaataaacttataaaacaaaatatatttagagaagtctagtatctattattccatacaatacacattcttccccactttgagttttttcacttaaaaatataaacgagattatttcatagtagtatagtatttacacatattccatactkcttaatggtgtcttttgattagcaattaatgagctccaatttatcaatattatcttttttttttttttttgagacagattctcattctgttgcccaggctggagtaaagtggtacaatcttggctcactgcaatctctgcctccygggttcaagcgattctcccacctcagcctcccgagtagcggggattacaggcacccaccaccacacccggctaatttttatacttttagtagagacagggtttcaccatgttggccaggctggtctcgaactcctgaccttaagtgatctgcccgccttggcctcctaaagtgctgggattagaggcctaaaccaccacgcccagccaaagttgtcttttttatttagtattctttctatccttttaaagaaaacatatcctgcttcaagtcatgaagatatattcctgtgttttcttctataacattgctatccaatagaactttctgacatgctataaattttctctatctgcatatatggaatgtgtagctactgagcacttgaaatgtggctagtgaaactgggctactcaatttttaatgttactaattttaattaatttaagcttaaataaccacatctgtttagtggttgctgtagttctggaagctttcttgttttaacttgcacatttagatcttaaattacctgaaattgcttttgaatatagtgcaatgtagaagtcaagatttatattttccacttgtaaatccagttagattgcctactttcctcgctgctactgtgcagtgctacctttgtcataagcaacgtgactttatatattctgtttctggactgtctattctgtttcattggtcaacttgtctattcttgtgccaatacattctgtgttaaatatagtaacttttcatttgtattgatatctaattgtgtaagttctctcactttgttattctgcttcaagattaacttagctatttttggccctttgcatttctatataaattgtagattcagcttctcagtttctattttaaaaaaccctgctttgattttaattggcactatattgaatctgtagaaaatatggggtatattgaaaatatcttattttgatctttattgaatctataaaaatatgaagcttgttaacattgacaatattgagacagacaaccgattaacaaggtatattcttccatttatcttttttttttttttttgagacggagtctcgctctgtcgcccaggctggagtgcagtggcgcagtctcggctcactgcaagctccgcctcccgggttcatgccattctcctgcctcagcctcccgagtagctgggactacaggcgcccgccaccatgcccggctaattttttgtattttttgtagagacggggtttcaccgtgttagccaggatggtctcgatctcctgacctcgtgattcacccgcttcggcctcccaaagtgctgggattacaggcgtgagccaccgcgcccggcttcttccatttattttattattttatcttaatgtttatgtgtgtgtatgtgtatataggggtattgcacaacttttattagatagctgatattttaatgctattttaaaagtttaattttataatacaaaaattagctggacatgttggcacatacccgtaatcccagctactcaggaggctgaggcaggagaattgcttgaacctgcgaggcagaggttgcagtgagctgggatcgcgtcactgcactctagcctgggcaacagagtgatactccatctaaaaagaaaaagaaaggcagggcatggtggctcacgcctgtaatcccagcactttgggaggctgaggcaggcggatcacgaggtcaggagatcaagaccatcctggctaacacggtgaaaccccgtctctactaaaaatacaaaaaattagtcgggcgtggtggcgggcgtatgtagtcccagctactcgggaagctgaggcaggagaatggcatgaacctggaaggcggaacttggagtgagccgagatcgcgccactgcactccagcctgggcgacagagtgagactccgtctcaaaaaaaaaaaaaaaagtttaatttgataattggcttttgttgaaagtatatagaaataatactgattttatgttaactttgtatccaatgttcttgctaaatagtaaaatctcatatttttatattttgggttttctacatatactgtcatgctattcccaaataatgttagttttattattgtattttttactttctctctttttttaaaaaaatagagatagagtctcactacattgcccaggctagtctggagctcctgggctcaagcaatcctcccacgccagcctcccaaagtgctgggattacaggcataggccaccatgcctggtcttttaaaaactttctaatcacatagttttcttgctttctgtcattgcctatgaaattcagtataaaattgaatagaagtaatgttaatggataatcttgtcttattcctggtctcagagaggaagtttttaaatatttaatatgaaatacattgtttgattgggtttatttgcaaaaatcctttatcagatttattaagttccctttgttttttaatttattatgttttttaaaaatcatgaataggcattgaatttatcacatattttctgttattgaatggataatatggatttttatccttttattaatagcatgcattatattggttgatttgttaatgataaaccaatcttgcattcttggaataaactcaggttgcttatgatgtataatccttctttatatcattagacttagtttcctaacattttctttacagtttttaaatatatgtttatgatagaaacgcgtttctacagaaaaaaataattatttttaaaggcatagttattgggtactagacttagtacctgaatgatgaaataatcggtaccacaaacccctgtgacatgagtttgcgttataacaaacctgcccatgtacccctgaacttaaaagttaagaagcaacacacacacacacagatgcgcacacacacacacgcacaagaaattggcttttaactttccattcttataatgctctagtcggagtttggcatcaaggctatcctggctttatatagtaagttaagaagtgttacttttcttttacttattcggaagagttgtcttagtccatttgggctgctatatcaaaatagcataaactgggtggcttaaaaacaatagaaatttatttttcacaattctggaagctggaaagttgatgatcaaggtcctggcagatttgtgtctggtaatggcccactccctggttcataaaacagaatgtcaccttcttgctgtctcttcaccttctggaaggagcaaggtagctctctggaacctcttttatgagagctgtgccctcgtgatctaatcatctctacaaaagccctacctcctaatatcataatcttaggggttagcatttcaacttatgattgcaaaggaggagggaacacaaacattcagatcatagcaagtttgtgtaaatcagcatttttttcttccataagcatttgaagaattaagagtgaaatttataggcctagaattctcttcatgagaatgttaattataaattcaatgtctataacattaatagttatagaattatacagagcctctatttcttgttgtattagtttggttaatcaaaatggaaaattttaacataccttgctcaaaaacagaacaaggagacaaaagaaaatcaataagggtactgaaaacttcaataacaggaataaccaacttgtatgtatgtgtgtgttgctggacattatcatttgtgagatacatttatattgttgtgtgtagctgtgtatcattcattgtcattatatagtatttcagggtgtgaatggtcaatttctataaatgttctgcatgttcaagaaaaagcagtattctgacattgcttgttgttgtgttctgtatatgtccattaggtcatctttgctagttgtgttgttcaaatattctgcattcttttttattctttttgtttgcttattttatcagttactgagaaaattatgttaaagtgttccacgatgaatagtgaattgtttctccttggattttgtcaattttttgtgtcatatgttttaaggctattttattttattagattcttaaccaaatataaatatgtgatatctttctgctaaattgaaacttttagcgttatgtattatttacctctatttctgctagtgataaactattatagtttttgtttgcctgaaatgtcattcttgatagatatttttacatgggtgtaaaattcaagattggcatttatttcattttggtacattaaagttacctcctcaatatcttctgggttccactgttgtctcattgtgctgcttcatcagtaatttattatctttcttccaattttactaattttgtcttcttgtgtgtccaacatgctattaaaagtattccttgagttgttaattttggttattgtgtttttcattttaaaaattataattattactgatcaagtcwgccatgatattttttataggtttctgttccctgcaattttttttttcaagacaagtcttgctccgtcgctcaggcgtgatcatagctcactgcaatcttgaattcctgggctcaagtgattctcctaccttggctcccaaagtgttgggatttcaggcatgagccgctgctcctggctcctgcaaatattcttaagcttgtcatttatttatttaaatatattaaatcttcatctgataattccagagtctgaagtctgcaagtgtatacctgctgtgtgctgtttcagctggacagctccatatttttatgtgtgccaacttttatttgacttttgatggtccatatcctgaaaatgatatttgccaggatatcctgagatcttggatggaaatacctttcttcaygatagatttttatacaccttccagtgagtgaatactactgctagtaaaccactttaaatcaagttcaagacttgaagctccttggctacttaractacgtattctcagataaaaatatgcaggatatctggtatctagttacaagtttataggattaaattttcctttcctattttccttctggcctttttggtgccaagtcaaattccccagcagttttctgggctggagagtaggtgggtttagttttcacatactattactggaaagattagtcctttgaagttccagcttaatgtagtttggaggccccataagactccccatcttgaacatcctgcttctttttttttctttctttctttctttctttctttctttctttctttctttctttctttctttctttctttctctttctttctttctttccttccttcctttctctttctttctttctttttcttctttctcttttttttttttttcagatggagtctcgctctgttgcctaggctggagtgtagtgacaggattttggctcactgcaacctccgcctcccggrttcaagcaattctctgcctcagcctcgggagtagctgggattacaggcgcccaccaccacgcctggctaattttttgtatttttagtagagacgaggtttcaccatcttgaccaggctggtcttgaactcctgacctcgtgatccattcgcctcagcctcccaaagtgctgggattacagccatgagccatggtgcccagcccatcctgcttcttaatttctgtcttcctacaacttatgtccaattttatgtcaagttcaatattctgtttacctctttgggcttagctttcctccacaatttgtcctagcagttccccattatcttatcagattttcagtgcttttaagataattgttttaatgttttacccaagaatatttagttgatttcagtaggatgactgctgtaaataatttaggctgccattacctgatattccctatcatagagttctatcaccagtgactagcatctaagtaacattgaaatgcttttatgtatatcttaaaatatttgaattacttttgttttgaaaacaatagtatctttactttccctaaaccttgataagggattcatatctcttattatyaattttgggaaaaaataattcataaacctggtctattatgaaatgtttgctaattgagccaagagagcacatgcattcatctaaaacattcatataatcaaactttattaaaggtgatatttgtggctttacttgacataaaacagcttccatatttctctattccagacattttatttaaaatacatttttgagcataagatatttaaaatgtgtaggcaaataagatatccatatcattaaaagatatctaaagctggtaatggtggctcatgcctgtaatcctagctacttgggaggtcgaggcacaagaatcacttgaaccagagggaggcggaggttgcagttaacggagattgcaccactgcattccagcctgggcgacagatgagactctgtttaaaaaaaaaaaagatatctaacaataaacaagtaaactatcaattataatacaatcaaattcaagctacaactgaaataaatacatggtatctaggaaactcagaggggaagcaactaactcagtatggtggggggtagggggttgaggcagaaaaatcttcccatataggatgtcacatataattatagtgtttatatttgccaattgtaaaaaaaaaaatggcaaaagagatctcattcagaaaagcaataagcacaaaagttttaggaataactttaatgagaaatatgaagtaaaagtatgaaattttgttgaaaaatattttaaaatcttgtataaatgagatggcataatgtatttttaggcagaatattacaaaggcatgttttccacaaactagttggatttggccctgtgtcaataaaaattccagtaagatgattattttgctttagcatgacaacttttttcctaaaatttatctctaagaataagcgtgaagaaaaaaaaaattgaaaaagagtttaaagtgtagacgttctgttatcagaattaaattttggggctgggtgtggtggctcatgcctgtaatcccagcactttgggaggctgaggtgggtggatcatttgaggtcaggagttcaagaacagcctgaccaacatggtgaaatcctgcctctactaaaaaatacaaaaattagccaggtgtggtagtgggtgcctgtagtcccagctactctggaggctgaggcaggaaaatcgcttgaaccctggaggtggaggctgcagtaagccaagatcatgccactgcactccagcctgggtcacagagtgagactctgtctcaaaaaaaaaaaaaaaaaaaaraaagaaagaattaaattttgggaagtcattattagcaatattgtgtagtatccattggacaggatgagagtagaggaaaggagatcattaaaatatacaggtaagaaattatggatatttaaattcagactagaggcaagggctttaatatgatataaaggatagaattgataaggctaaatgtgggagatacagtaaaataataaatagatgctatcaaggttcatggaaatgttgagttcagtatgcaaaatgtcatgtaaatagacgtagacaataatcaktttaatttgttgatctgagtggggctgaattctaaatatagactttgattcatctgcataaggaagctggattatggataaaaccatctatgaacaatgtataaagtgtgaaaaaaagggataaggtcaaaatattgtggaacacatttaaaggtctgagagaatgaaagtccacagtctaaaagcagtaggagatgtaggaaaaaaactaggaagtggtcctttatgcaaagcaaaagaggaaagtttgaagaaaatgagttgattgaagttgtaagatgtcacagaagtcaagaagaggtctctgaagtgttcattggactggtcattatgatgtcatgagcactttagcatgagcagctttagaagtgtggttataggagaagcagtgaattaaagagttaaagtaattaagaaaacagagacagaactactgagtaccccccaaaagcaattatcttcaaaatatggaaaaccagattgggatacaraaaggtttcttgttaaagataaaggaggcctgagtaagtttatatctcatgggaaaatggtaccagagaagaaaaggttgaagattagaagagttgaaaattaaagggccaaggctggttttttgttggtttgtwttgttttgttttgtttttaaagagggttttactctgtcgctcaggctggagtgcagtgatgtgatcactgctcactgcagccttgacaccccgggctcaagcratcctcctacctcagcctcctgagtagctgggattacaagcacgtgccaccacacctggctaatttttaattttttatagagatggagtctcactgtgttatccaggctggtctcgaactcctgatctgaagtggtctgcctgcctcggcctcccaaagtgctgggattacaggtatgaggcactggactgaggcttcttaaatggtggcaaggaacatattttgtgctttaaatgatttaagtatttaaagatcatagttttcctggcaacttactgtagagatcacttcagaatttccctgggtagagtagtgtgctgtagaagtatagtgttgtaagccagtgtggattgggagtccataccccttatttatctattctgtgtatcctattaataacagtaattatcaggttattttgcctttgaacacsttagtaagtctgagcatttacatggaaaaaatgctgggtttattcctcctgttattgtattttacaagtctgtcgagggtccacagtgatctttgccccataattgtaaaatgagatattaraatcatccttatttatcttaaccacctactccactgtacagttcctataattccacaaacwtctctttatattggtttatgccttctttagatgattgtgaataagagtattatcttaacctctctggtgggtctacttctgtaacggwtgtgggtcatgaattattttttactcagacataattatctttggtcttatataaagaaaaccctacagactccacmaaaacactcttggaactaataaacaaaataaagttgaaagataaaaaatcaayktacaaaaatcaatagcatttctatacactattgaactayctgaaaaataaatcaagaaaaccatgctatttacaatagctatgagaaaataaaaatacttaggaataaatttaaccaagaggatgaaagacctgcaagttgaaaactttaaaacattgatgaaagaaattgaagaagacacaaataaatggaaatatattttatgttcatagcttggaaaaattaatactgtttaaaatgtccatattacccaaagcaatatacaaattcaatacaattcgtatcaaaatttcaatgaaktttttacagaaatataaaaaacttccctaaaatttgcatggaaccacaaaacaccycaaatacccaaagcaatattgagcaaagtaaataaataaataaaacaaaacatacaaacaaaaaaatraagctgaagacatcatactacctggcttcaaaatatacttcaaagctataataatcaaaacagcatggtactggcataaaagacatgtagaccaatggagcagaatacagctcccagaaataaatccacacagttactgtccactgatttgcaacaaaagtatcaagaatatacaatggaaaaaggacagcctcttcaataaatggtggtgggacaatttgatatccagatgcagaaaaatgaaactagacccttatctcacactgtatacaaaagtcaactcaaaatggattaaagacttaaacatagacctgaaattgtaaaactaacaaagaaaacacagtgggaaagatgaaagatcaataacactgatctgagcaatgatgttttttatatgaccctgaaagcacaggcaataaaagcaaaaatagactaatggattgcatcaractaaaaagctcctgcrcagcaaagaaaacaagagtgaagggacaatccacagaatgggagaaaatatttgcaaaccayagatctgataaggagttaacataccaaatatataaggaactcaaacaactcaatagtaagaaaacaaataacacgatttaaaagatgggtaaaggatgtgaatagacatttctcaaaagaaagcacacaaatgaccaacaggtatactaaaaaatgctcaacatcatgaatcatcagaaaaatgcgaattaaaaccccaatgagatatcacctcacacctggtagaatggctattattgaaagaggaaagataacaagtgatggagaggatgtggagaaaagggaactcttgcacacggttggtaggaatgtaaattagtacaatcatagaaaacaatatggaggttactcaaaaattgagactaaaacaactatccagcaatcccactactgggtatatatccaaaggaaatgaaatcagtatgtcaaagacctatccgcactcccatgttcattgcagcattattcatgatagttcagatatagaatcaacttargtgttcatagtggatgaatagataaagaaaatgtgaaatatatatatatatatatataccaatggaatactcatcagccattagaaagaatgaaatcctgtcattcgtgacaatatggatgaatctggaggwcattatgtttagttaaataagccaggcacagaaagacaaatactgcatgatctcattcatgtggaatgtaaaaaagctgatcttatagaagcagagagtataacagtgattaccagagatggrtagggcagtagtaaggaggagagattgaggagaggttggtcaatgggtacraagttacaattagataggaagaataagttctggtgttttattgaacagtagagtgtagttaagaataatgtatatttcaaaatattatagaatagaggattttgagtgttctaacttcaaagaaatgataaatgtttgaggtaatggatatactaattaccctgatttgatcattacacagtgtatatatgtattgaaacatcagactgtagcccataaataggtacgtgtcaattaaaataataaaaatagtaaaatgtatagttacttccacggggtagaaaatgtggtatatattcatggtatactacacagccttaaaaaaagaaaatcctgtcatttatgacaggaaaaaaaaataagataatccaatgtaccatttgttgaaaatacttkttctttttattgcattatcttgacatctttgtaaaaagtcggttgaccataaatgtgtgggcttaattctggactctatttcactcctttgatctatatgtttatcctttcactaaaagtagactgtcttgatattgtagctttataaatttgaaaatcasctgtgaaatcctccaaccttgttctacttgtaaacattgttttggctattataggtcatttaaattttcatataaattttagaatcaacttttcaatttctacaaagaattccgctgggatttatattgggaatgtttttaacatttagatcaatttagggaagatttggtatcttaacaatattgagtcatcagatcgtatgaacatatatacctccatttacttgggtctttaaaaaattgtctcagcatgttctgtagttttaagtattgaggtttcaaaagttttttgtaatacctattcttatgtattttatggtttaaaaaattctattgtaaatggattttaaacagacttttaatttgcagagactatttcttcctttccaatattaatatttgtttatttattttgtcattataatggctaggacttccaggacaatataaacagaagtggtgagagcagacattcttgccttaaccctgatcttatgagaaaagtgttccatattttacaattaagtatgtgctactcataggtttttcccaaatactttattaaattkaggaagtacccttttcyggtttgctcagagttttatcatgattcattgttgaatttcatcaattttcttttaatctattgatatgagcatatgatttttcttcgttttactaatatgttggattacactaattgatttttgaatgttggaaaaaaccttccattcctagggtaaatcccacttagtcatgatatattatcttttcaaacattgttagatttaacttgtattttagtaaatatttttacatctgtgttcatgtagaatatctgtaaataattttgtaaagaatatcttttcttcttgagggrtaatgttttcattaggttttagtatttctaacctaataaaatgacttaggaggtgttccttcctctattttctgaaaggttgtgtaatattggtgttatttcttccttcagtgaaacattctgtgccagggattttcttttagggaaagtttctgataataaattcaatttctttcatagactttctattaaaaatgttaacactatttatattttatttcatgctctgtcaattttgttaagttgtattttttaaaggatttgtcagtttcattcaatttatcatatttttggcacaaagttgttaataatattctctcatcttttaacgtctgtataatctgtagtgataacatctttttcatttttgatattggtgatttgtgttctatcctcttttttatcaataagtctagctgagaatttatcaattttgytgatttttttcgaatagccagcttttggctttgttgatatattttctattgtttggtttctatttcattaatttctgcttttgtctgtattatttgccttcttatattacttcgggtttactttgctctcttttagattttaagtggattcttaggtaactgattaggtaactgacatttcttctaatataaaaaaattaaagccacgaatttattagtatgaactgctttatttgcattttactaatttttatatgtgatgtttttatttttattcatttaaaagtatgttctaatttccattatgatttaactctttcacccatttattacttaggagtgtgatcaagtttacaaatatttttggttttcctagctatcttgttgcttttgatttctaatctaattctcttttggtcagagaacatactctgcatgatttcagtcttttaaaaatctgtttagacttgttctgtggcccagcaacagtctatcttgatgaacatatcacgtgcacttgaaaagaatgtatattctgtaattgttgggtgtaatgatttataaatataaattattgttatccagattttctgtgtctttatttttttgtctagttgtcctatcaattgctcagagagcagtgttaaaaatcacctatcatcattgtgtttatctctttgtgcccatttttgcttcatgtaatttgaagccctgttattaggcacacacattgatgattattataatttcctgatttattgatccttttatcttcataaaatatcgatttgttgctggtcatactttttttcttgtagtagcttttgtgtgatattaatgtggccattctagtctcatgttttctgttttcatggcatattgctttttgttcattttacttttgtttctttaaagtatgcccttgtwgaagcgtattgttggatcttgctgttttacccattttgataatatctgctttttaactgaagtgcttagcccattcacattagtgtaatatttgatatgtttagatttgtgtccttcaatacattatttgctttctatttgtcccctctgattttgttcttctgtttccgcttatctgttgtcttttgaattatttgggtattcctcagaatctcttttaatttttagatataactatttttagattttttttaatttgcattttttagtggttgctgtaaggattacagcatacatacttaacttttctcagtccacttaatagtgtacaaccttcataaaatatagaaaagttacaaccatataagactatttagctcttcctgtgccattgcttatgctatagttttcatttgtattaaatctcatacaatacaaaacccacaagacacagttataatttttgtttaagcagttattatgtactttagagaattaagaaggaaaaaaatagtcatttctgtttacctagtcatttaccatttctagtgccattaatttgttcctaaagagctgagtttatccataatgtctttttgcttcaacctgaaaaactttayttagcagtttttgtaatgcatatatgctgcagtgatttatcttagttttcctttatctgaagatctatttatcttccatttgaatgatayagaattctgggggattgacagattttattttcttccayktaaaaaaaatgttattctactgtcttctaatgctcatagtttctgatgagaagtgtgtagtcatttaagtcattattccctgtgtgcgatatgattgtttttgttgctcttgcatggctggggggacacttattttaaggttttctacttacctttggtttagaagtttgactatgatgtgcttatttatgcttttctttatttttatcctgtttatggttggctgagtttatcaaacatgtacatgtatattgttaaccaaatttgacaaatttttgttccttatatccttaaattttttaatcctaatttctctctatcctttctggactccaattacatacatatggtactttttaaatattgtctggttttaccatagtagggttaaagtttggtcctttaagactatacatttctttcatattcttgtatattctatattgttcaataggtctctgagatttattttatttttattttatttcagttctttttcttttcttcagattggatcatttctattgatctattttcagattcattgacttttgcctcttttagctccatttttcccaagatcaggcagtgagttttaatttcaaatattatatttttattgctaaaatttccattggctttyttatattttcctttttttctgataagatttcctttattttcattccttaccaataagttttcctttatcttattgaatawdtagtagctactttaaagtcattgtccgctaattcccacatctgtgtcatctcaggtttggattcttgatggtctttacctttaggaatgcatcacatttttctggtattctatgttaggtaattttggattatatcttgatattattaatgtgttattcttgagattcatcattctgtttgtrttagtccattattgcactgttataaagaaacacccaagactcrgtaatttataaagaaaagaggtttaattggctcacagttccacaggctgtaggaagcatgatgccggccatctgcttggcttctggggagccttcaagaatcatggtggaaggcaaaaggaaagcggctcatcttacatggccggtgcaggagcaagggasggggggawgtgctacgcacttttaaacaaccagatttcacgagatctctctcactgttatgagaatagcaccaagggggaaacctgccccatgatctaatcacctcccaccagggcctgcctacaaaattggggattacaatgtgacatgagctttgggcggggacacagatccaaaccatgtcattctgccactgccctcaccctccycgaaatctcatgacgttcttacattgcaaaatacaattatcccttcccaatggtccctcaaagtctgaactcattccagcattaagccaaaagtccaaagtccaaagtctcatctgagacaaggcaactctcttctgcctatgagcctgtaaaataaaaaacaagttagttactcccaagatacagtgcgggtacaggcattgggtaaatactcctgttccaaaagggaaaaaccagccaaaagaaagaattataggccccatgcaagtccgaaatccagtagggcagttattaaatcttaaagctccaaataatcttcattgactccatgtctcacatccagggcacactcgtgtgagggrtgggctcccaaggccttgggaagctccactcctgtggctttgtggggttcagttcctgcagctgctctcatgggttggtgttgaatgcctgcagcttttccaggcacagtgtgcaagctgcttagaactgctggtggattcccattytggggtcttgagggtggtggccctcttctcacagccattkcactccagcctgggcaacaagagtgaaactccatctcaaaaaaaaaaaaagaaagaaagaaatttcctctgccagrtaccctaaactcatcattctcaaatttaatgttccgcagattcctacagcacaggcataatacagccaggctctttgctaaagcataaggaaagtgacmtttgctccagtcctcagtaagttcctcatctccatctgagacctcctcagmctggacttctttgtccatttcactatcagcacttcggtcccaatcattcaagtagtctctaggaagttctaagctctccctcatcttccctccacactattccaacctgtgcctggttacccagttccaaagtcactttcacattttcaggatctttatagcaatatcccactctcagtatcaattttctgtactagtcttttctcacactgctataaaaacacctgagactggataatttagaaagaaaagaggtttaactggctcgcagttctgcaggctgtacaggaygcatgatgctggccatctgcttgtcttctggggaggcctcaggaaacttacaatcatggtggaaggcaaaggggaatcaagctcatcttacatggcatgagcaggagcaggagcaagagagagagaagggggaagtgatamacacttttaaacaacaagatctcatgagaactctctcactattatgagaacaacattaagggggaaatccacccccatgatccaatcacctctcacaggccccatctccaacattggggattacaatttgacatgagatttgggcagggacacagatctaaaccgtatcactgttatatttctatgaagggtgttgacatttttgttttagtagagaataaacttgattagactaaaaatgcaaaatctttcttgcttctgcttygtagcagttcaaacttcagtttagttcttttagctttagcctttgctctttatatgtgattcagggacggcagagatgtgggaagaatttgatcatagaatttagggctcaccttcttttgttctgtgcactcaaggattctctacccctctcagttgtggattacagtgctgttgctcctggctcctcccctttgtccttaagctggagaaactagggattatctgtcagagttttaacttcctcatgctgtgtcacaaccttgatcagctattaggccaaagcaacaaaaacrggaaactcacttcatgctgattcttttctccaagttttagtgccctsctctcccaaaactgcctccttttgtttattccccagagtccttagatatttgctttatgtattttggccagragctatagttgttatctctggaagggtctgtttattatgagcttactttgatctactagactgagcttcagacattgtgttttgaaatttttgcttaacattacatttatccaagaattaaatttaatatttatttatttttttcttcaacttttaagttctgaggtgcatgtgctagttgtgcaggtttgttacccaggtaaacatgtgccatggtggtttgctgcacagatcaacccatcacctaggtattaagcccagcatccattaggtattcttcctgatgrtctccctcccattgctcccccaacaggccccagtgtgtgttgttccccttcatattttcatgtgtactcatcattcagctcccacacrtagtgggacgatgtggtatttggttttctgttcctgcattattatgctgaggataatggcttccagctccatccatgtccctgcaaaggacaagatcttgttcstttttatggatgcatagtattccatggtgtatatgtaccacattttctttatccagtctatcwttgatgggcatttgggttgatcccatgtttttgctattgtgaatagtgctgcaatgaacatacacatgcaggtatctttataataggatgatttatattcctttgggtacatacccagtaatgggattgctgcgtcaaatggtatttctgcctctagatctttgaggaatcgccacacagtctyccacaatgagtgaactaatttacaaccccaccaacagkgtaaargtgttcctttttctccatctgttgtttctggacttgttaataattgccattctgactggtgtgagaagatatttcattgtggttttgatttgcatttacctaatgatcagtgatgttgaggtttttttcatatgtttgttggctgcatgactgtcttcttttcagaagtgtctgttcatgttctttgcccactttttaatgggcttgtttgggtttttcttgtaaatttgtttaagttccttgtagactctggatattagacttttgtcagatggatagactacaaaatttttctcccattctgtaggttgtcttttcactctgatgatagtttcttttgctgtgcagaagctctttaatttaattagatctcatttgtcaatttttgcttttgttgaaattgctttaggcacttttgtcatgaaatctttgcctgtgcctatgtcctgaatggtattgcctagcttttcttctagggtttttatagtttcatacttttatgaattamgtctttaattaatcttgagttaatttttgtataagatgtaaggaaagggtccagtttcaattttctgcatatggctagccaattctcccagcaccatttattaaatagggaatcttttcctcattgcttgtttttgtcaggtttgttgaagatcagatggttgtaggtgtgtggtgttatttctgagttctctattctgttccactggtctacacgtctgtttttgtaccagtaccgtgctgttttggttactgtagttttgtggtrtatatgaagtcaatcaagtagcatgatgcctccagctttgttcttttgcttaggatcggcttggctataaaggctcttttttggttccatattgatatggtttggctgtgtccccacccaaatctcaccttgaattgtagttcccataatccccacatgttgtgrgagggacccagtgggaggtaaytgaatcatgggggcaattatcccatacagttctcatgatagtgagtgagttctcattaggtctgatggttttataagggcttttycctttttgcttggcacctctccttcctgccaccatgtgaagaaagacgtgtttgctttcccttccaccatgattctaagtttcttgaggcctccccagccatactgaactgtgagtcaattaaacctctttcttttataaattacccagtctcaggcagttctttatagcagtgtgagaacarattaatacacatatgaattttaacatagttttttcgaaatctgtgatgaatgtcaatggaagtttaataggaataccattgaatctataaattactttgagcattattgccataacactgattctgtctatccatgagcatggaatgtttttctatttgtttgtgtccactgtgatttccttgagcagtggtttgtcattctccttgaagaggtccttcacttccctttttagctgtattcctaggtrttttattctctttgtagcaattgtgaatgggagttcattcataatatggctgtctacttgcttgttgtttgtgcataggaatgctagcaatttttgcacaytgattttgtatcctgagactttgctgaagttgcttatcagcttaagaagcttttgggctgagacaatggggttttccagatataggatcatgtcatctgcaaacaaagataatttgatttcctctcttcctatttgaataccctttatttctttctctttcctaattgccatagccagaacttccaatactatgctgaataggagtggtgaaagagggcatmcttgtcttgtgctggttttcaaggggaatgcttccaggttttgcccattcagtgtggtattggctgtgggtttatcatatatatggctcttattattttgagrtatgttccttcaatacctagtttattgagcatttttaacatgaagggatgttgaattttatcgaaggccttttctgaatccattgagataatcatgtgggttttgtctttagttctgcttatgtgatgaattacatttattgatttgcatatgttgaaccagtcttgcatcccagggatgaagcctacttgatcatggtgaataagctttttgatgtgctgctggatttggtttgccagtatcttattgaggatttttgcattgatgyttatcagggatatcagctggaagttttcctttttgttgcatctctgccaggttttggtatcaggatgatgctggccttaaaggagttagggaggagtacctccttttcyattgtttggaatagcttcagaagaattggtaccagctcctctttgtacctctgatagaattcagctgtaaatctgtctggtcctgggctttgtttgcttggtgggctatttattattgcttcaatttstaatttaatatttttaaatcttgggttaaatggttgaatgaatgtgtgaaaagttagatatcaatgaatgaatattcttaaatgtataaactttaatcttgctggatataggataaaatttacattaaaacactgtaatthgtcaatttaagtaaaataaattcaaggaagtggtctgaatttctcagtgagcatttagatatttatgggagtcatataaaataawttataaatgtgactgagggctttttattaaggaaaatgaaatattgctatggacatgattctgtgtgtttctttactacactatgaactaaaaattttggagacaaatctaagtatataaattggtttattgatgaccgattgggaatataaataggcacaaaaatttggcgaagcattttggcatgtctacctaaaatttaaatatgtaagcactagtccccccttacctgcagtttcactctgagcagtttcagaaaataggtgagcacagtacagtaagatattttgagagagagaccacattcataaaacttttattatagtgtattgttataattgtcctaatttattattattgttgttaatcttttactgtgcctaatttataaatcacactttatcataggtatgtatgtataggaaaaaacatagtatatgtagaattcagtattatccttggtttcagacattcagtggggatcttagaaagtattctctgtggaaaaggagggactactgtacttttaacaaagcacttcccagaataaacacacagacatatacatgcacacactttcagaaatgcacttaaatattcaatcatggagtaaaaattaattatgaaatatctagacaatgaayattatgtagtttttattaagaaagaagcagaattatatatactgacatgaaaggatgttcattatatatgttaagtaaaaactaagttcatcatatatgttaagtaaaaaaaagtcacaaattaagagaaagtgttaattgatttgagagtttgtgtatttttttttcctattttgtgctgaaaagctgaagttggcatcaaccaaggcatattgttatctatgtatcaagctaaataatttaaagatctttaagactattaattcagagatgctgtataaatagaatcagtgccagattttttgtttcaattctatcagccaagtatactatgctttctttgcttgtgatagaaaaaagagagaaaaaacacagaagcaaaaagtaaagttgtacaatagtgtgtagagtgtggttccattttgtaaaatgtatcagtgtgtatatttatatagcatagtcaaaagcctggagtgatataaattttctgttactggtctagtatacaagggaattagattttaaaggactttcattgtttttaacaattctgaacaaatttaatttggtacaagaagtatatattttaaatattattgaacttaattaaaataaattagagctcaaaaaataaataaatcacaggaagttcacagtctgactttatcaggaatgttgctattttcttaacaggtcatcaaacattatcactgatgcttggaaagaagcactttttataatttaaaaataccttttattcttcaacttctgctggcttaaagagcactaartccacatatcctaggaggcatggctgtccaatatatactatgtgtacattgatttatgaaccaataaatgtttcatacacagttgagattttaaatgagcttatgataattggatcaaaggaatactagtccagcttgagagtactgcagaaaaccaatcacagaaagctatgatgaaattttaattataaaggatattgaatatcctagagtgacaactctgttataataaatgtaacactgaatgggaaagagagaaaggagatttttacccatttctgtttgaaatcaactttctatttctagtaaattatcacaccattctgttttaatttttatatcttaaagttatcattccagtgtctttggtttactgggtttataaaagaattgaccagtagctatataatagatayagaaaagtctgcctgggtgtrgtggctcatacttgtaataatattatattataattgttctattttattattagttattgttgctaatcttttactgtacctaatttatacattaagctttatcatgggtatgtatgtataggaaaaaatgcagtatatatagaattcagtattatccttggtttcggacattcagcaggggtccgaaggtgggcgaggtgagcccactttgggaggccaaagtgggcagattgcttgaycccaggagttcaggaccagtctgggcaacatggtgaaatgctgtccttacaaaaaatacaaaaattatctgggcatgatagtgcatgactgtagtcccagctacccaggagcctgaggtgggagcatcactgagcccggtggttgaagctgcaataagttttgattatgctactgcactccagcgggacaactgagtgagaccctgtctcaaaaaaaaaagtcacaaattaagataaagtgttgattgatctgagaatttgtgtatttttttctattttgtgctgaaaagctgaagttggcatcaatcaaggcatattgttatatatggatcaaactaaaaaattttaagatctttaagaccattaattcagagatgctgtataaatagaatcagtactagattttttgtttcaattctatcagccaagtataacatgcttttcttgcttgtgatagaaaaaaagagagaaaaaacacagaagcaaaattgaagaatttgtaaatcatttctaaataatttcaataaaatgagctttgaaagggaaaawttttagataacattatctcatcaaaatgccttaaagtatattttaatattcagtaagaacagtgtatattaacatggctaatttagaggatttatattttacccacatgataatgtattatgcctgtaactgctaaaggaattatgtagcaaaatctgtcaaggaatacacgagtgggatttatatcagaaaaatcaaagccatttgtaaagccccattacttaggcagaatatcataggtaggaggtagatgttactgaaagaagaagttgggatatgaaatacaaatctattttgcatcatgattttgttaagtccggctgtttattattaaaaacatgtacagaagattcaattgaagtttctaaaagagaaagaaacttgtagttgtgggaacaatagtattccttatgaaatacttagatattaatagcttgagactgataatacaattcttaagttaggggttgcatgtgtagtggtcagatgttatttcaggatctcaagaaacagagccatggtaaaaagaagcttcctggagcttctgataaattccgtcacctttttgggacccagtttcttcatcmataccaacctcattagggtcctgtgagaagtacatgaggtgagatatgtactgaaataatatgccaactcttaagtgccaagacattaggatgcaagggggggtgcccaaaaagtcaacaattacttgatactctagatatatgtatggataattttgagaagtaatccttcttacacagaggtgtaggtttgtttgttccaagcagcaaacataatgggtataggaaagagaaactgtggccttcatatagactgagcttaggaaaacagttggaaaacagttcaaattcaaggtacttcaacaatatctagtgtgtttttgaaatatatttttaaaacccctatccaaatcaatgaatgctttggctaaaacctacttgggaatgagggtgttctttagtgccaaatactcatctkattttagtccatggctaaaatcccaagagttacagaggagaaatagggccaaacaaggtttctattaaaataagaggtcccaagtgatgaatggaaacttggaacaggtttaatggcaactataagccagaaattagctgaaatacacactaatgaatttggggcatatcttgagtttcagatagaaaattggtactaagtttagtgaattagaaacatagcttaacctaggcagttgcaattcttgttccaaaaatgctcaatttgctgctggactgcatggacacttgctacctccttgttttgagtcattaacaaaatgttgaatgggatatctggagtatcaagtaattgttgactttttggtcacccaacccccttgcatcttaatgtcttggcacttaagagttggcatattatttcagtacatatctaaccttatgtactcctcacaggaccctagtgaggttggtattgatgaagaaactgggtcccaaaaaggtgayggaatttatccgaagctccaggaagcttctttttaccatggctstgtttcttgaggttaaagaacatgatttaccaggctctgtttcttgagagaccaagagtggatccctgtagtccccattagaattctccttctagtttgaactattccattagtaaacactttttggcatgttatttaaacaattacaaaatcacctaactacactgtcttgcagctgcctttctttttttgtcttgtccacgtgagtatattgggagactytgtttaatgtctccacraattctagatagactgttcctgcagcatttctttttttaaattttgttttgataagcatttattttggcaatgattctagtaaatgaaactaaagtgcccatatgaaaaacaatcttaagtctatgtggttagtttgaagttaccagtttttaattaagccggagtagtccttagtatgaatgccttcatttctaagtgctcataaacaatcactttagtaatattacagttttgaaggaatttatatcaagcttaatggcactttttaaaagataggaaattgggttctctagtcacatctgtaagttatttcagtgccttggaagatcatttatctggccacagataattgacttacttacatcagttttttttttttttgagatggagtctygctctgttgcccaggctggagtgcagtggcatgatctcggctcactgcaacctccgcctcctgggttcacgccattgtcctgcctcagcttcccgagtagctgggactacaggcacccaccaccatgcctggctaatttttttgtattttttagtagagacggggtttcaccatgttagccaggatggtctcgatctcctaaccttggcctcggcctcccaaagtgctgggattacaggcgtgagccaccacacccggccacttatatcacttttatgcttcctatctccttattgatcttgaggttcaagtttcacttaaccattttcttcaatgaaaaataattttataatttaaaaaacctcaacctttaatattctatgattcttgttaggccatctcaattgagaatactgataaagaagtaaaactccccccaatactggctagtttgattttatctgttaatattacgcaatctgccccaaacctgtctctccctttttattgttacttatccaaagatggcttgaatctcttatggcttgaatctctttgtttattctaagcaattttcagacacctcagccaactatcaataatatattagttttttagaactaaaaatgtagaggatctccccctaaaagccaattgttaatgccaaatatttgactgatatatttcttctggaggaagggagatgtgaaaaaatttagccatcaagttatgtgaaaactttttcatcttcccatccactggatgttttatctgtaaataatgctataatcatattggaaagtattttccttctggggatgcatgaagatcaggaatcctattcgtttttaacaagatggaatttttaaaaactactttggacaactctaaacatcagagatgaccatttgtctcttttttattatataacttgtgctcggtttgtagagcaacataaatacatgaattaaaaaatgaaaactagctccttccctatttgacagatacttctcaacctcctctccataagatatgctctatccctatataggaaatttttctgtagcagcttgagtttactaaaaataagatctgaagaaaatgaagcaattaacatttattgagagtctataagggtttctacattgtgaaggagacagaaatataagacatggctcctgctttcaggttgcttataattaaagagataatattaaattatttggatgaatttaaaaatgacacatgccatcttacagatatgctgtagactgtgaaaatgaaaaaaaaaacctcgtgtttagagtagacactgtttsatggattaggtaggttttcatctggactttgaaatgtatgtaagattttataaggaggagagaaaataagaagctgtttgtattagaattacacagataaatttgtaaatttagttcttttcaaagaacattaattgagcacctctgtgccaagctccctactggatgctgtagattacagcatgtttaggaactaacttcatactctgttgctaaagtatttctgtgttttctaaaaaggtaaatctcttgtgaggaaacaaatctcttgaaggggttctcataacagaagtcccatttacttcatgatataaaaaggggctgttttctggttttgttctcaaaatgtaggatatagttctagacgtaattgggaaagcttaactttgttgcatacgcatcttccctatcatggttgatttcctatatggcatagttaaatgtgtttatccgtgtttgatatctaaagggccatgctacatatagactgccaactaaggttttatctgatgataataaattgttgtatttcatgacgacagcaacaacaacartaatgtacttaactagtcactgtgcaaattgctttacatacattttctcatgtaatcataataataaccgtatgagttttgcttactattgttttccttaattaaaatgagtaaagtgaagcttaggctaagtaacatgtccatagccaaacagttagtcactggcaggagtgtgactgactccaaagtctatattcctaattactgtgttctactttttaatagrgagctcttgaaggtccaaggaaaggaatgcrtaatggtgtggtcaaggcattagtgttaatatttgtagaaagggtaattaacaacagtctgagcaatcacattctaacaactagtaaggttggcaggagcctcagtataatggtgtgaggaacgaaatcattatagtgccaaatagagtataccatctctttagtacaatgtctttcaaaatgaggctgattgtgttggctttatatttgactccttaataattaaggcagtaaattctagctggagctaaatacctacaaggcctaaaacagcataatggacaacctggcaggtgtccttgctggaagatgacaagagtgctgaaaggagagtcctggtttttctcccaagacatgacatttgggggcttccattaaaaaattaccaagcctctgccactgtaatctcttccttaagtgcctatgattttttcacagtcacaggtctatgcctggtcaatacccagtggccaggtctctgagctgcgtgcagagatggcagcgacttggagggctgggaggagataaggggaggaaagatcacttttcatgacaacttacaacttgattccacttataagccatttattttcagaaacaagtaatgggtgargacacaggccaggtccacaatttgtgcacttgagagattaaggcctccgagatcaaattaccacagcaaactgagacagaattattgtagggatgtttggggaggatgcagagagaagaggaagaagccagagacccaagaaaggagacaggaatagattttgatgaaaattgcttcctactctgtacccttgaggaaacaaagaggacaaataagaagcagcagtgataggaggctgggcgcttctctggaataacactggctaggtagtggagcattgatagtgagtgtgcttggttggtggaacgaagggatgtgctagttcaggcctttgaattctgggtgtcaggatcacaaccttggctcctttaactgtccgctctaggagggaagcatgccaaatgtcaggtctcactctgactttgttccagtccatagctagaaaatgacccatagaggaagatctacagatgacagaatactgggagatgaagagaaaggacgttttagtgagtgctttttttgcacatgaggcaatagatttcaaattcctgtggaagaaatgtgagaacctgggaagastgaatattcagaactgagcagcagaggcaatgacacagcatggaaagatttcctctgatccttctaccttctcttttactgaagtgaatttgttgtctctgtgttgcctctatagcagtacaagaggaaacttggggacacagaagaacagaagtctaaggagtcttatatttaaggaagataagctgcagtcattgaaattgctggttattgtaagataaatcccagactcccacattttgcttaatgacagcagatttttttttttttttaactgcaaagcattaatggaatccaaattccagcctggcttaggagatcaacagtaacgctcttgatttaatggttttgcagactcttgaagacattgtcatccattaaagaaaaaattttaaattactcttgaaagaaaatgtcttgggtgataaatgtaaaagatttgaagcaagattagaaaaagcttgagagaagaatctctttaaaaattttaccagattttccccattgtcgccaaaatgggtcaaataatagatttgcctacagcttcatggagactatttttttaaacagagcattttaaacatttaaatattggttatttgccaaggcacacactgaaaataagggccacttggccgagagcagaattgagtcttggatcccaggatgctggttttaggcttgctcccggaaagagggcagcatttgccatccccctccttttgccctaggagttgagcactttctgcagtacttaagagtgtccagggaagatgtgggagtcaggtgaatagttcccatcgccagtaaccccagagcgcctccccctgcgttgtttccttttaatgttagatccgccgcctgggtgcccatacttagctaaggcccctcagtttattttcctgaattgcgcttggagatcttttcctggggagctgatagccagacttctaggggcttgactgcttttcccagactaatctccttaaagacccgttaagcaggggagagacggtggagactggatgaactggacagtgggggtagggagaaagggagtggccgtgttcctgcggtccgctgggatccggcaggtccagggtgaaggagatggggcwggagaggctgagcagtccgggttcgctgtccgccacttcggcgcggaatcagagcaggacttgctgagccctcctaccgctccctttccccctccccctctgtcttcccttctgtttccttttccctccccctggagctgtagcggcagcagcagcaggaagccgagccgggttgagcgactcggaggcgagcggaggagctggaatatggggagtcagcgaggacggtggggccaggagcccttgggagggcctacggagggagcggccccaggcgctttctagagcgtgagcggtgggggagcaggcgcagggtggcacgagcggaggcggggcccgggcgtggggcacggctggggaagctgccgcctccggccctgcccggctgcctccgccgcggccagtggctatggagcaggcgggcaccagacctgcggcgacagagcatccacgrctccggcggcccatgccctggctgctgctactgcctctcctgctgctgttgctgctgctgctacctggcccwgcggcctcccagctgcgatactctgtgccagaggagcaggcacccggcgcgctcgtgggcaacgtggctcgcgcgctggggcttgagctgcggcgcttggggccgggttgcttgcgcatcaaccatctgggtgcgcccagtccgcgctacctggagytggacctgacgagtggagcgctcttcgtcaacgagcgcattgatmgggaggcgctgtgtgagcagcggcctcgctgcctgctcagcytggaagtgctggcgcacaaccccgtggcggtgagcgccgttgaggtggaaatattggacatcaacgacaactcaccgcgtttcccgcggcccaactaccagcttcaggtaagcgaatcggtggcgcctggagcgcgctttcacatagagagtgcgcasgaccccgacgtgggcgccaactcagtacagacctacgagctcagccccagcgagcacttcgagctggaccttaagcccctgcaggagaacagtaaagtgcttgagstggtgctgcgtaagggcctwgaccgggagcaggcagccttgcaccacctggttctcacagccgtggatgggggcatyccagcccgctcgggtacggcacagatctctgtgcgtgtcctggacactaacgacaactctcctgcctttgaccagtccacttatcgcgtccagctacgggaggactcacccccaggcacattggtggtgaagctgaatgcctcagacccggatgagggctccaatggtgagctcaggtactccttgagcagctacacgtcggaccgggagaggcagctcttcagcatagatgccagtaccggggaagtgcgagtaattggggggctggattatgaggaagcctcctcctaccagatctatgtgcaggcgactgaccggggtccagtgcccatggcaggtcactgyaaggtgctggtggacatcgtggacgtgaatgacaatgccccagaggtggtgctcacggacctgtatagcccagtgcctgagaatgctacacccaacaccattgtggccgttctcagtgtcaatgaccaagactcaggccccaaccggaaagtgagcctgggtctggaggccacactgcctttccgactgaatggctttggaaactcctatacactggtggtgagcggcccactggaccgagagcgggtggctgtctacaacatcacggtgacagccacagatgggggaataccgcagctcacatccctgcgtacactgaaggttgagatctctgacatcaatgacaatccaccaagcttcctggaggactcctattccatctacatacaggagaacaatttgccaggtgtgttgctctgtactgtgcaagccacagacccagatgaaaaggagaatgcagaggtgacctactcycttctggagagggagattcaagggctgccagtcacctcctatgtctccattaacagtgccagtggcagcctttatgctgtcaactcctttgactatgagaagtttcgggagttctttgtgactgtggaggctcaggacaaggggagcccaccactgagcagcactgtgactgccaacgtatatgtggtggacatgaatgaccatgcccctcacattctgtaccctacctcaaccaactcgtcagcagccttcgagatggtgcctcgaactgcccctgctggctacctggtcaccaaagtcatagctatggactcagactctgggcaaaatgcttggcttttttaccatctagcccagacttctgacctggacctctttaaggtagagctgcacacaggagaaattaggactaccaggaagatgggagatgagagtggtagcactttcaacctgaccgtggtggtccgagataatggagagccatcactatcagcctctgtggccattacagtagctgtggtggatagggtttccaaaatcctccctgacactcagaggcatgttaagagccctcggacatactctgaaattaccctttatctaataatagcattaagcacagtgtcttttatatttcttttgacaatcatcattttgagcatcatcaagtgctaccgctacactgcrtatggcactgcatgctgtggaggcttctgtggagtaagggaaaggtcccctgcagaactgtacaaacaagccaacaacaatattgatgccaggataccgcatggcctcaaagtgcagcctcacttcattgaagttcgagggaatggctccctcaccaagacctactgctacaaggcctgtctgacagcaggctcagggagtgacactttcatgttttacaatacaggggcccagacaggaccagggccttcgggagcccaagcagcagtgactgacagcaggaatctcacaggccaaagtggtcagaatgctgggaacctgattattctcaaaaatgaggctgtttctcaaaatgaggtgagacagtggtcagggggtcttctacaaactcatgcatttgttacacatcccccaatatcctgtgatttggctttattgagtcattaacagtgacaagagttatctggtaaactgagtatatatagtatccacaatttgatcataatctgctatttcctctctagaaaaatagcactaaagaattgttttatttttcattttcagaggcatgaagccttgtccataaaattgtttgagaagtgaggattagtcttaatatttaatgctaaaacacagatttgtagagaaacaggacaggccttggaatagggattatgttttagggagtaatgttatgagactcaaggagaaatggcctctgctgtatcatctacagggaaatttttcttttgaaatcctatatgagtgatgtttcttaaaaagctctgaggcctctaggggctatcatagtcaccactatctgctgtctctgtttatactctggactgtctacagtggaaattatctagttaatatttctggtacttgcactgaacctatgtgataggatcctctggaaatgcatgtcacaagtgataaagctgtagtatttagacatcatactgaagctaaagtttgctttggctgtatgatgtggcarctcttctgtagagggctgtcagagggagtggatgatggtgaggcagagagattaagtaccaatttgtctggttggtccagggaggtattagaatgagtggattaggggtgtggggggatggtgaagaccaagagaagctgggattagaaggaagagaagggaaaaagaattctcccaatagtcacctttcttggcatactctgaattcattgtaagaggatttccctgaatttagcttaaatgcagcctgtaatcttctgattttctgttgacagtttctrtggttttgatgagatgtaaagtagccttttcaagtccttcatgtctttaagttaaatgacagtacttccaaagcatgcattcattttctggatctaaaatttgatttgctatagcttcaaaaggctggcttggaaagtggatggcttaccctacagtaaggtgtagaggcaggtgttagtatatgcactagttttgagatttaagtaggtataaggccagcttgttcattattatgaagaatgtacataaattattagaaagtagatgaatatgtgtgtgtgtttgtgttgtgtgttcgtctccatatgtatgcttgaaataacagagatatgctttgtgatacttaaaacttggatttcaaaagccaaaattttgtaccataaatagtgatgaattgttatctttccaaataactactttgtagaaagggcttttagagctactacacaatgtgtgaacaatatttgtctctcctctattttttgcaatatattttcattgacatattgctgtacatacatattgtatgtaatatccatattgttacatttcaagttcatggtaatcttgaggaatgtaatgcacaggcacaaaagttccattcctgattgagagtagatttttctcatggacatttcagatagatttattcatttatcagaagtgcctggtgttagtcaatgctgagaaaccatgggargcakattgtagattaagaaaaatgggggaataaatcaaagagtttccagaagtctttagatcgtagcatttgaaagcacgtaaaagggtttagctttaaataaggttgctgtagacatttgcttaacaaattcttgtgaagccctttgggattggggtgggctacaggtggtgaagaggcatgaacaagtcaggccaggctcagctttgccaccagctgtaagccggaagctcagaggaaagacactgttaccctccctctcctgactcaaagcttggggcaatttgatacataaactatttctgtcttacactgacctgtatattaatatgtacttyggtacacaaacatttaatctagggagaaaattatttcagaaagtgcttgcttttgggagattttgccaggagagtgcatgactttaataaaggcaaatttctgccaggcacttttggaaatccagtgaagaaccccaagatctacagctccagaaatttttgcagttatagggagagagtgtcacattgttacagtgtggcaagataggagcaaaagccactcagttctgaaagtcatcattgccagatcaacctgttaaattcccatgttgggctttctttttttcctacctagttactacagatggcaggagagtcctggggtacaattagtaccatgtgcctacattaaaagtagatgggaattagagaggaagagtaagggaatttgtactcactaaccaccctgctatatagatatatgtatatcatacatatacacatacatatatctcatattactgaatcttgaatattattcaagattattcaatatattgaatattataatattgaatacatatatgatttcattacctgcaagtcatgcgttaaatatttgttaacatctagcatatgaggaaataagctcagggaggttaggtaatctacacagccacactgctagtgttattttaagttgtatccatctgactccaaaaactttttttcaatactatgagtagacagaagttccaatgtttatattcccttttatatgggatattcaggcatttaagctatcactaattcacctagtcgtatatattaactgcttttggaaaaagagtaatttctggcatagaagcaggtaacaaatgggaatatcagtgagttactactatttttttatttttatttttttgagacagagtcttggcctgtcacccaggctggagtataggtgtgaatatggctcactgcagcctcgaccttctgggctcaagcaatcctcacacatcagcytcctgagtagcttggaccatagatgtgcgccaccgtgtctgactagtttttaggtgttttttttttttggaagagatgggggtctcactatgttgcacatgctgttagtatatttgtatttgtttatttgcttcactattggcaaaccctgttaagatcttttatttttattatttcactgatttttctcttgttgcttattaaacatcagcatttaaccccagactctaatctgttggtagattttacccccagtgagcttatttcataaatcacttgtgcagtgaggattytgaagtaactatttggcaatagggcagaatttctctttggaaatttctgaacttgatactgaatgttgttggcactcccttcagagtctccataaaaagaaaccaaattttttttttttttttttttttgagatggagtctcactctgttgccaggctggagtgcagtggcgtaatcccggctcactgcaacctccgcctcccaagttaaagtgattcttctgcctcagcctcctgagtagctgagattacaggcacgcgccaccacgcctggctaatttttgtatttttagtagagatggggtttcatcatgttgtccaggatggtctcgatctcttgaccttgtgatccacccgccttggcctcccaaagtgctgggattacagatgtgagccaccatgcccggcaaaggaaaccaaatcttaaggtagattctgtgcatttgtggtcgtggtgttgtgattgttaatgagtcactttgagtactctagtagatttgtccaacagtgtctcagtgggcccagctggcacaacatgtagaaattatgaaagagtagcagagatgaattaagtttgcattcactttcacttattttaaagcaatttgtagtcaccaaaccttcagttatttctgccactatgtgtgcatattcaccctaattccaggtatagtgacctgaaagagttaattcttctttcagtggcacctacttttatttcccccagcactgatttttctatctgatgactctatcctggaacagagtttacactcgttgtaaagtgacatagtagtgaatttataaaaattgcacaatggtcagaatagacaaagaaatcatatctatgagcttccactccagtttttcatcctctgatggtcactttataatgactggggctgttttagtttgcaaatttcatattggtcacaggactcttcttctgagaaaaagtttattttctttggtctgatgatacaataatttatttcaattacctctttcctcaatttttctacagactgctgagccagatggaattatggctgagctcttctctgtttctgtatcttgtacacattctgactgaagaagaaatctatttattgtagcttgaatgtcattggcctactgtttccttctgacccaggagtgagccatcacatgggcatctggtctaactcagaacactctgcagggacacagcctggcatattataggttgcctattggcatgctgtctacttgacagaatagcaaagtcagttctgggtacttgcttgttgcctaccaatttttgctctcaatgagaggtcagaataatgtcaatttgcaaatgtttgaggaaacattcctgtcaccaaacccagaggtttagctgaatatgatggcattttacaggtgtctttaaatgtggcttttacagaacttcacctggatcaatgttttgtgcatgtgataatacaactataaatttagcttattaatatgataatatttggagcagtataatctataaccatgacttcaaaaatcaaaggttaaaagtattcttttgcagtgttttaaatctgctaacctgaaaactatacaagggtttttctttcaagaattttaacttgacaaatgcaaaggaatatccaacattgcaaaggtaaagagaaatcttagttccttggcatataagcaccatcagttcctttctggccttccagggtcagaactctgggctccaaggaggtacaactgtgagtgagagagtagctrctgtgctagcaggctatgcatccagaactaaacagacctagcactttctgttgtactggaacccattaggtatgttctaaagttatgtttattttactttcctggtttgtaaattagcattttaaatgactacattcagaggaaagtattccacccagaattctcaaatgtattacctttgtgttttattttattttagtttttttgagacggagttttgctcttgttgcccaggctggagtgcaatggcatgatcttggctcactgcaacctctgcctccagggttcaagcgattctcctgcctcaacctcccgagtagctgagattacaggcatgcgccaccatgcctggctaattttgtatttttgggtttcaccatgttgttcaagctgctctcgaactcctgtctccaccttggcctcccaaagtgctgggattacaggtatgagccactgcgcccagccctcattttgatatactagaagaccaatatgcaacataatgattattttaaatgttatattcccttttgccttaatgcggaacagtctatgtatcccttttctgatgatttgtaacaaattaccacaagtaagttgtttaaaacaccacctatttgttatctcacagtcctgtaccatgtggctgagttgtccgctcaggtattctcaaggctgaaatgaacacagctgggctgtgttgtcctttgcaggctcttaggaagaatctactatcgagctcattcagattgttggcagaatccagttgtttggggactgagatctctgttttcctacttactattggcctggggtcactctcagttcctagagaactgaggactcaggactcttgtcccatggtctgctccatcttcatggctggcactggagaatcttccctcacatggaatccctcttatgcttcagatctctctgatttctgtctctgacctctagacccagatttaaagagctcatgtgattatgtcagtcccatccagatgatctccctttcttaaagccaactgtgctacatagcataatgtaatcatgggaataagatccatcacaatcacagtcttggagactattcagggtgtgcacaccaggatatagggatcttggggccatcttggaattctgcctatcagtttatatcaatgttcataaaatagcactatgcaaaatctgcagtggatatattcttaatacagtcctattaggaaggaaaaggagatattatatgcagtctcatgtcccagagggcaatttgttgatgtcttccacatggatttccatggtacgaagatagcatattatttcattgagtagttgtgtgagtttattaataaaatagggtattttaaacttattttactttaaatcttagaagaggtgattcatccttctgtagctcaaatattctatgtcataaatcacagataataccattacaagataaattaaatcttttttataattttaataggaactgaagtgtattcttattcttcagtaatactacatcacccatatggactacctaattgattttttccacatatggagttttgtgaccattattctaccaaaagactaacctttgaagcaataggacatattagagttcttcaccaatagaaagtaagcatagtcctgggaggtaccatctaagtattaaagaactaaataatcacagttatttcaactgtgattgaaattgtgatagtaatatatgtcttactgtgtcagatatatcagtagtcaacttttcaacttgaatttttccaagtttaatcaagttctggatgaaactcatgtacattttactacttttagttttgtattgttttaaatcaatatcctggaaactcagaagtaaaaaagagaaagaagaaaaatatatgtcatttcatgtaaatttatttaaaacacagacttttggcaaggcacagtggctcaagcctgtaatcccagcactttgggaggccgaggagggtggattgcctgaggtcaggtgttcaagaccagcctggccaacatggtgaaaccccatctctactaaaaattcaaaaattagccaggtacggtggcagatgcctgtaatcccagctactagggaggctggggaagaagaattgcttgaatccgggaggcagaggttgcagggagccaagatcgcgccactgcacaccagcctaaatgacagagtaagaccctatctcataaataaataaataaatataaataaaacacagacttttgtgttaaggggacctaaacatgactgtcagctgaactcagcaatcagacaagtaatttaatctctccaaagttcagatgtctcatttttgcaatttaagtacaataatgttgactttgcattatagttcatttatttaaacacattttaaaaacctcccagatgccagaagcctgctagactctgactatatagctacgcttttatgaatatctgaagatatgcatgtgtctaatgagcaaarcagatataatccctttcatagagtttactgtctgacaaagaaagaattaggatacatgcaacagtatgtaataaagtgcaaaatctagtactgtgtagctacttaaaacatattatatgytttcttcctttccttttccctgcctgatcttactgccataagaaatcttgtaactgtgattctgtcaaatgaatctaagaaggatgttgttgctgatggactagtatagaaaatagcagcatgacaaattaaatgtgtcattggggaagtgagattgtataatgaactgagtttcctggtcagtcctgctggaactgtgcctttcrgcaaaatgagtttgatgatttcattccaaagatcaagttgcagcaattttcatcatgaatgttacccaatcatagaaaaattggcaacatttctcagcagatgttacagtctttctcaaaggaaggttctctcagctgacaagctaacgatagtgctcctgatggcgaggggagagacggtgatgatgactgattgataaaaagtattttagtcatatttccaggtttataaaatgatttgcaaacattttcttttgttccctctaacaccgctagtagataatggaaactcctttgatttggtctgtagataattttatgctktgttatatggaatatccacagcattttgtgaacttgaaaacaaaggaggaagcagcttgcatatgcatatcttgctagcagattggtagaatagagagagcagttagcatgtgaggaccattgaggtaaagtatcccagagttgtaactttttctgggccttgactttggctaattctctgcatgccaaatatcatgtagccatccagaaatctgtctgaatattgagatggtgatcatttctctcctgggtgttatgaagaaatgtgtttattaaatactttgcatcccttaaaggaactatatgaatgataggaataagaattattgacagttttgaatggtctattgatattactatggctttgtttctaccaaatatggtaagtataatgtagaggaaaatacaaaatacaacttttatcccccatttttttcattcaactatacctcaatattcagtgacagggccacctyaatctccgcccatgaaaacgcatctagaggagtgtcacaagtttttcacagtgacatttttgcttactgatacaagacagtgatggtgactgatgatgtcccagtgatttctgagtagcttctaaccagcacataactcccccaacagtctttaagtctttaggtgcccatattttcctctttgttctcccccttcagactgagagtttgtagagagagggcaacagatcttttcaatacacaactaatgcaaaatgtatcaggtttttcttggatttcagctactccctgttaaacaatcagagcttagtgaacagtgattcagtgaggagggaaagcactcaggaaggagcaggaacaagtacaagtttatgaaaaggattagctagcaaaacaaggtcaaactctgcaatagtttgttttcctctccctagtatccctcttcaatcagaaaagagactgttatcagttgctggtgttatgactgggcacatccgccctgggtcaaatatgctgcagtctgcaaagccagcagcagattgcagtcctctgcagtccagccaggccagcagaacttgtgtagccatgtgccctgttatagctgtaatactgaattgggaatgttcccttaatggggcacttgagggcaaaagcagtgaaagcttttcctttctcaaagcagactgttcttcccgtagtgttttaagaacacagacatgtattgggcaaggcaaagccaaaggtggcctttacaagattattaaatctggtcttccagggtatctaatctgtgtgaggaccctgatgaactaattttcttctmaagtgctatatatgtagatatcatcatagagttacacatgaaatggctcattcaatacttttttagatgcctggaaatatttaagggagtaactaatcaattagcagcattcctgggagaacattgtcttgtcattttaacagaaaactctctttgtgattttgcagccacgacagcccaaccctgactggcgttactctgcctccctgagagcaggcatgcacaggtatgtatttccctcctcattcactcagaagtaaccttaacttggtatggctcagataaactgcatctccmtaggccagaagcagctgtcaaaactaaaaagctttaggtactttgccaggaaaatgcaattattttgtccccatgtttattccttgaaagatcgcaaatggtcagtgccagatgcttatcaagtgctggcatataagagtcctctgtaaaatcacagaaacaggctgctatgtattttctcccatcaaaatttctacagggaagtaatttcaacctccttcatccctctctacctatgctttcttttcctcctttaaaaactgtaattaatactcatgctttgagacttgggtacattgtgcaatgtatacatacatgttgtctaccttgttttttttttaatctcacattggctattacatcctattaccctcaataattgattgctattgttgtttgtgttcacacctattagagcctcctcatctttcccatctgttgctatcttattgtcatcaatgacatggttcttcagaagatgagccatgtaaagggctccaaatctagcttactttaaattaacctagagtaacggtattagtctaagactcagattaaatataattttgctttctctactttgtctctctgacagtaattgattaactaccattatttctggaggtgatccagtatccatgccatggggccaaataaaagattcattatttgcgaatgtctttggaaaccaaatgggaaggaccaagaaacaaatgatcacaactatcaaaaggatttaattttaaagaagaaataatcttcaaacttaagcccctcaaaatatctgggcaactatcaagtgaatattcaccaaacttagatcagttcgtaaagagaaagcctacaaagtatgtgtagagttaatgtgaaattagttttagcccattaaaatgcattagattgaaataaattaacatactctcaagcattacaaatgagcagaaatcattacattgggtgctatttctgattcagaagcaatcagtgaagggctgaagattagtagttggcttggtaagatgtcacattggaacctgggtcataattttaggccagaaacattcatgcatataccagaatattaggtatcagaagaaattctttatatttattagagaccaacttgtgcttttgcctgcatctgagctgttggtggagacatgcaatgggtaaaagcatggtttacagtaccaactcttgaaaagtaccaaagctatgagttgtgccttaaaaactacatttgaaataaaacattaaaacataacttcctggactgggcgcggtggctcacacctgtaatcccagcactttgggaggccgaggtgggcagatcatgaggtcaagagatcgagaccatcctggacaacacggtgaaaccctgtctctactaaaaatacaaaaattagctgggcgtgatggcatgtgcctgtagttccagctactagggaggctgaggcaggagaatcgcttgaacccgggaggcggaagttgcagtgagccaagatcgagccactgcactccagcctggcgacagtgcgagactctgtctcagaagaataaataaatgaataaaataacataacttccttatcccattttcaaattgaaaaaaaaaagccaaatgtgctcctatkcgggtttcaattaagatattatgagatttgagtagggtaagaaataaaataaaaattgaaattaaaatgccatttcttttttgcattgtaatacattgaacatattaaatgagttgtgaacctaaataatactaatctttttcgtatgtgtgcttgggtgttctcggtctttccagtcttggacatcatgtaactattctttaaaaaattctgctttgagctgagctggctccaggatagttacaccttcatgaatctgactgagcccacacaatttgctagtaggatccaggaacacttgaaggctgttaatatttggggaaaaaaaacagataattctagagtgtagacaaggggaagaatagtaaaaggtcagagtttaatgagtgaatttctactggatatgttgtttgaagtcaaagagtgagaaaacattgaacttatatgttgccttccctctaatagttcaagtttgcctgctctgttgcctcatataacccctttagtcagtagtctaaattttattttagaaatttaactttcaagataagcaaatgtctagtttaaaagggtcctctagtctaggtgtagtggctcatgcctgtaatcccagcactttgggagggtgaggcaggtggatcacttgaggtcaggagttcaagaccagcctggtcaatatggtgaaaacctgtctctactaaaaatacaaaaatgagccaggcatggtggcgggtgcctgtagtcccagctacttgggaggctgaggcaggagaattgcttgaacctgggaggcagaggttgcagtgagctgagatcgtgccactgtactccagcctgagtgacagagtgaggctttgtctcaaaaataaataaaataaaacaaaatgttcctctaattttgatgagggttttcttggacattttctcttaggatcccacttatttcttccttcctttcttccttcctcccttccatcattcattcattcattcattcattcatccaacaaatatttgagagattaatatgagttagtattagacatacataaatgaatactgcaccatgttctcttttcccttgaacagtttatgttctatctctgcttgcctctaaaggtctcccagtttgtatctcactcccagcaatgttttatgctgaattaatctcttctgagcggggatctgtgagtggtggtgatcaagtttctctagtctcaggaaatatagggtgggtcatctatgcataaaagatatagaaagagtaaaatagaaaataaggttaagaattaattagatagccaaattggaacaatactccaattatcagaaaatattttagtgtgttttcttctttagagtagagaacctaggaacaagagaacctgcaagagaggcttggaacttttgagaacaagccctcctcatctgcttcagtatcgagatgttaaaatggcttagtcctctgatgggcttcctgttagatttagtgagcgccacatggcgttaataaaaaacagaattgccataaagatagaacatgtgtgttcctggaatagtatagcaggcaataagtaagtcagcaatgcttctgcagtttatgcagggtgactgctcagcagtaattgcttcagttcaagcatgagcagaatgtgttagctgcagccctggcttcatagttgtaagcaatttctgagggtggaagaagagatgggaaagaatttatgatctaaccrttatctgggtctgtgtgtttattcagctctgtgcacctagaggaggctggcattctacgggctggtccaggagggcctgatcagcagtggccaacagtatccagtgcaacaccaggtaaagagctggggtctctccattctttcttggtttctggaaagtgatcagatgacctacttttgtaagatcaggaatgttgatggctctttttcttttatatttttgttattcccttttttccatacatacatgatttccttacatatatgattattttgattttatacctaatgctcttcaggagttgaaaaaggataacaaggaaagtgtgtgtgcacgcatgtgtgcatgtgtgtgtgtgtgtatgaagtttttggggtttgtttgtttgtttaaatcaggtacctttcaaatgcttaggtcatccaagccatgcagagaagatctggtggccttatgcacagagatgacactgttaacaaagatcttttggttgaagactatggaaacccacccaaagtagtaaggaaagaaagagaaaaagaaggaaagaaagaaaaaggaaggaaggaaggaagatggtttctcatggaagtggaaaattatcggaaccaaggcattgttttgagttcaagtcaaagtcaatctgcttctctctgcacatcaacaacattctgcagactgacttttagtgccttggcatgcatgttgccaaacatgaccgcctcacaatttcttagtttagagggataatagggactatttcctaatccaaactttcaggaaagagaacctgctaagttgtgtaaaaaacctaatggctgggtgagtataggaaaattgcttaaactcacatttgcttggtatccttattcttgccctatcactaaagcagggtcatgtaatagaaatatggctttggaggcccatcgctgtggcagttttcagaaagggaagattaagtgttggtagagaccacaaattgtgtctactctaatcctctattaatagaacatcatgatgataatagtagttactaattattaagccataatatgcctagacactgtgccaagtacattgtatgtgtggtctcatttattccttaagtcaagcttgcaagggatttattacatctattctacatatgagaaactggagaggcagagagattaagaaatgtacccaagttcacgtagcttgtaagtggcagagggtaggattcaaacccagatgtgtttagtttcaaatccaagtatatctagcacttatattcataacatggctggcttgcaataatccattcaaattcaaatacatatctacatacataacagatgacagaatgtgtgtgtaaaaggttttttcccaaaaataatcagatgcctttcaaattattaagtaacatgcagctaagggcccatttttactggcaactttaagggcattcrttgattctaatcagccaggatttgctatttatggatgttgcacaattcaactaaaagtcacatttgtccaaaaaatatacgagttgaagcaattcattagagagctaatattgccagattgcaaggggaaaaacataaaatagttcattgacaaatctgtaccctcagtgccaacgatggagtgaagaaatgatggaggaggaagtggttttagactgccaagtgttgcaggatgtggaggcatctgggaaggtgagaacttcccaaagaagccacgtgaaatcatgactttctaccttgcctttatttcagagtttttcttgctcttatggaggcattgtaggtcgacctggtaagccacaaactaactttgaatacattctccctcccattggtgatgctggttggtgtgtattcctaggcaaatgtggaataggaaccatgtattgatatttcatacatctggccaagtccctctttcagattcaaaaaatgttgagaacctatcttttttacagagatagagaaggggatctcccttgttccctttcttactgtcccagcccctcttgtataacccattttatccagaactgtgcctggctgctgatgcatgagtcacagtcttcatggactgtgctggatagagcttacatcttccaactactccatggcaacctaatcatacttttcaatacatacctctgcatcagtggtgtaaagttaaagggattctctgccttctccctgtccttctggtacttttaggtttttaggactcaatatatgttctgcactgcttggagggaatatggcataaagattaagattatgatttagagtcagatttgagttgaattctaatcccaagcttacttgctgggtgagcatagacaaactgcctgaattcatattttcttaattaccctttctgtaaattgggtgtagtaataataataacacctattttattgagttmccatgagaactaaaggagaaaaaaagaactgagcatagtgcttgacatatagttaataaatgtctaatcttttttttttgagacagagtctcgctctgtcccccaggctggagtccagtggcacgatatcggctcacagcaacctctgcctcctgggttcaagtgattctcctgcctcagcctcctgagtagctgagactacaggcgtgtgccaccaagcctggctaattttttgtgtttttagtaaagacggggtttcaccgtgttagccaggattgtctcaatctcctgacctcgtaatccgcctgcctcggtctcccaaagtgttgggattacaggcgtgagccaccgcgcctggcctaatcttcttactcttttttctttctggactacttttctgcaatctatgatatagtgttggctgatagcctggtggccagaattcagtagttctcatttgcaggcccagatatagaccctctgaggttatctgggtctatataatccagtcaccccaactgttcccctggaaatggagtgaggaggatttattagttgctgcctgaagaaaagggaaatgctccaaaaaatttggttgtttccagactcaaatagagcctgcctttcattgaytctgttgcccttaaagcttcacggtgaagatgcagttgcttccaaaaggcttctttctggtgcctaagcctccttatacttgcttcagagccctttccgtgaaccagctgtgtattgctcttctcatcccaacacttgcaatggctgaataaaggaagtggggcctgccttacgctaatcctcgttcatatgtgtttcttaaagttatttttccttcactgatgaattccttttttttttttttttttttgagacagtctcgctctgtcgcccaggctggagtgcagtggcacgatctcagctcacaacaagctctgcctcccgggttcatgccactctcctgcctcagcctcctgagtagctgggactacaggcgcccgccaccactcccgtctaattttttgtatttttagtagagccggggtttcactgtgttagccaggatggtctcaatctcctgacctcgtgatccgcccacctcagcctcccaaagtgctgggattacaggcgtgagccactgcgcctggcctcactgatgaattcttttgctttttaaagaaactgttcatttattttcacagtctgcaaaagcctaagataaagatgccacactctgaaaggatcaacaagggcatcaccaagtaatgttttctgcaggataaacaagtcaggcattaaattggttaatcctgattactggcccctttctctagcctcccctctgtgtgagcagacccggaccacaggctttcttatttcctttcagcttcccttgagactgagcagagagagaaaattagctaaatcaggaatgcagggaatacagttgcagcctcttcttcagatggaggaatgcgttttggggggagggacattaaagggccagtcgctcatgttacagctctttttaacttcatgagtactaatgccctgaagaggttttaatgaatgccctcttgtgatcagttcctagggcaatcccaggttataaaaggactgcccctgcctgtgagggaactggcctggcttcagtgggccaggctgctttgttatctgttattggtttttccagctcctctttctacatttcaagggatctcaggccttacctaaggcaacagtacattagttttagagtgggagatgctcacagttttcagaagagttcagaaagtttcaaaacacacagcactgcagaagataacattatagcttctcaagaccccaggggatctgggactaaacagtgaaagattaattaggtagcggaagccactaaggcagtgagtcttagttagagaactttggtttagacaatggttctcaaaggggcagcaacaccaacaatacccggaaacttgttagaaatgcaaattcttaggccctatcctagactaatgaatcagaaattctcaggatggaggctgggtgtggtcgctcatgcctgtaattccagcactttgggaggccaaggcaggcagatcacttgaggtcatgagttcgagaccagcctggtcaacatggcgaaaccccatctctactaaagttacaaaaatgagctgggcgtggtggcaggtgcctgtaatcccagctactcgggaggctgaggcaggagaattgcttgaactcgggaggtggaggttgcagtgagctgagattgcaccactgcactccagcctgggtgacagagtgagactccatctcaaaaaaaaaaaaaataataaataaagaaagaaagacattctcaggaatgggacccggcagtctatgttttaacaagccttctatgtgataccaatgtactgtraagttttaagaactggtctaaggtaaatattcctgaggttgtcttatatcattacagggtcagaatgcatgcaaggaagccatctgtttatggttcttgtgagaagcagggggcctttccccatgcccgagagataattgttaagagctcaagcttgggagtcagtgaccctttctgaattctacctctgccactcagtaattgtatgttcctgggaccattacttaactttcctgattctcagtttctttctctataaaatggggagaatagtggtgtctaccttatagggttcttggaagaattagatgagataatgcacacatattgcagaatctgaagaacaatcagggtttagtaaatagtagctatttttaaatgatttttccaggtatgagtctatcctacagcttcaaaatttagacccaggttgttctgagtattctctgtgggaagaatctgctatagagaagatttttttaaagtgcctgtctctttgtttccttaggggattgcttttgccctgatttgccacatctctttactctgtggaaaatggacagtttatgtgccctagttttatatggggatttatattcttaattgtctcaaggattcttacctgtctgacaaaaccaactccccatggaaagactccatggagactccatctctgatccttccccagaaagaaagcatgattcttaagttttttagaatctgtttaggagcactgtcaacatgaatttttctatttcatgagtgagtgcagcctcgggccttgttggagaatttagaaagcatgctgttccactaacctgttcaacctcaacttctgccgttgtcatagcaatgacagtcctgggaggtgtgtgcatatccttattaggaaaaaaaaatgagatcagggatctatgtgagtggggcagctcccgcctgtgagtatccttcgctgtcacctgccatctgacagcccaggagtgccagcttggcttggctttctctacccgaggaaagtaagtccttttaagatgcacttttactttctggggttgtgaaactcattgtgtttgccagagttctcttcgcagcttatgtaaagaatttgtttgttttggattgacctgaagggaggaagcaagggtgtgggaaggggaattagcatcccctacctaggagaagccatgaagcttacttaagtctctgctggctccatccattcatgactttcttcatcttcttcttgggaaaacactctgtaccttccacttttaatggtcatgtaaataaaagactagaatggagatgtcctggttttctgaaattaaacatttttgtttatgaatagactctaagataattctttccctagacgctctgtattttcttggacctctcatttgccccatagtaattattctaggattggtggcctgggcagaatacagtcatggttaagaccatgatacataatagaagaatttcttccgtaacagtagccccaaacagagatcacgtgtctcctgaaacctatccagtctcatgtgcactcagatgtacgatcctggatataacattttagagggtgtagtgaggagaatagaacaacactgttctcttaggctgcagtttccttcaagccccacgatggagagaagcaggctaatgcagggtaaggaaatagagacttattatagtttcttcagttatcattgattcctttaatatgccagctacattgaggcaatacagtctggcctctgaaaaccttgtcaggagaaacaacttttgaatatatcttagaaaaataagacactttatcccttcttttgtttaagagtgttgcataaaacaggagagtttctgaattaccctcccttctagctttctttatacaccattctttgtagctgaagttttaagccccttgtcaaaagggagattcaagtttctgctgrggacatctcagtgtcacaaagggccaaggaagtagggtctcaccaactttgccacctgactcagctcaaaggtgataggtcacctgtgtgactgagagctttgtgggaaagatgatatggagggtggagagtctgcacttcactctgtgggaaaaattgctgaggttgtttagaattgttaggcttggaactcctcctgggaggtgcttgaacaagaaagacctgcttataacctgagttgagggcagaggaggaagatagtttgtaattcctttacgttttgtggctccggcaagccctgtcctcagcctcactgacacaagtaaactaaaaatgaaagtctgtcctagtgacagcaagggtctttcatggcaatattttaaaagaaactctgcccagatttcaaaggaacgtgaaaattttatcttcagaggcagtcagctttgcagttgaaaaggycattgcctaatctggagaaacatattcagttcaagcactggctagagactagaggcccccaggaaagggccrtaagattggtcactgccaggaagcctgtcaatgagtgtgtggactggagaggaatctttctctgcctcagcacttggagtctccgttattcacaatcagaaaaagagggagagcagagatagatgacattccacgtttttctcggtgagaccaagagcttcctcagcaacagccctgcctgaaattgtctatctccaagggcgtgggctaggcaaaggatgggagaagtcagtcctgaagatggtaatacttaaaggaaataagggggacaaaggatgyttgtgctactattgaaacaggaaattgagagctctgtagaagtcagactcaagaggcataataatagaaagttagggtatgaaaaggtgacttttaagaaccaaatgtggacccgaaagagaacaaagagaagtttattgtaactagcgttgtattccttgtctgctggataccaaacaatgtaccccgggtcttgagattatcgatgccattgtctgtaaaaaaccaaccaaacaaactttaaaaataagtaaagcctgccctgtacagaaaatctaataaagcaaatttgttggtgatgttccaagaaggttcaccagcttgggctttcaaccagcattracccaatcttgtgtccagagctgttgctgtaggtggtatcatgtatcaagctgaatagtgaggtgacattccccaagtcttctctcttgtcttttttgactgtgcatcatagatactgtattacccaagaacacacacctgttcgatctcttttcctataatcacctggagtcagatgaataccgtaaaggtctgtggtaagactagaagcctcagccagtatgaatgatttacattagatgcacaccaagctgctttcggagagtccagatttatggggataagagcatcactaggtatatcaacagccctagggtggatacctttragcctgtaaatttggctctgtgttggacgatgaaccatggaatacagaagaagctcccttctctcagctaaagcctattagcaaaaatagagccctgaggacattgtattttaagtgtatgttccagtgagtgggtcgttgctgggtcaagttttataagtctttaaatcccatactgttgcctcctggactgtagaaatagtctcttagaacaagagaaaggaagacratagctaccatttattgagaactgtgataagcactttacatatgttgcatacttaactttgagagaagtacattattattcccatgtttcagataaaaaaattaaagctcataagaattaagtggctttcttacattcacacagctagtaaaaatgttttttgctcaccattgtattcccattgtcaagcaggatgcctrgcacacaatgatgctcaataaattttgttaaattcattaataaatgcagtggtaaaggcagtatttgaactcatgtctgcttgctgctgaactctatacacttaacacattactattatcttgtcccgcatgatacatgaagggaatagcttggtaacttggaaaagactatttactgtctgagttctaggccaactgtagggtgtctgtatttatttcccattatgctataacaaattaaccataaacttcatggcttaaaacaacacaatgtattatcttacagttctggaagtcagaagtccacagtgagtttcactggctaaaatcaaggtgtgttcttgccactatataacaaggatccactttcctttagtttccaataacaggctccttatttctacctgagccctcactggcagcacctttaatgccatatttgtaataacaatctgttcatgacaatttaggtttgctcctcacttttttctgagtcctctctagtagagccattaatatgcatattgctactagcagcctgttcaaggtaatgtaggctctttctatcatgctcttcaaaattcttctagactctgcccatttcccaatctcaaggccacttccgcatttttaggcatttataacggcagaaccgcacttccagataccaaaatctgtattagtttcctagggctgccataacaaattaacacaaaatcccttttgccatgtaacataacatattcacaagttctaaaattagaatgcagtcattttggtggggccattattctgcctaccacccggtctttcatgttcaggcagaggtggctctgtgtgtgtgtgtgtgtgtgtgtgtgtgtgtgtgtgtaagttaatttcagtagagaatgagctagagtagagaaagagaattaaggtgagatgtgtcatggaagaacagtgactgatgatgctaactttgctcaatcaagaagtgtgatccatttaaatcatgctttcagtgatctatccaatcagataaactactctcccttcctgggaagagtaaggaaggaagtagagctaaagatgaaagttcttttcgtagcacatccctgcaaaggatgggagtattgttttggtgggcattcccttttctaagagcaaagatggaaatgtggagagaggagaaaaatggttcccattacattattgtgttctggacttagagatattgttctgccccaggtytaagaatattgttccaagagttgggagcaggcagcagaggacagtactctttagatcacccagaggccaatctgtaaggattcaatcctggggcatggtagctaatggaaaagtcactgtcacaagtgatgccaggagatggggcaacacatattgcctgccttgtatgcatctagcgtctgtgtctaagtgaaagcagattatatccagaacttccctgraaaatagaagaaagagcctgattggtgtgtatgtgtgtgttaggggttgaggggtgggtaatgttcctgccagtattcgtaaatcccacctgcttttcctgtgatgcttcctgtgttggggataggagggtgggatggttcagggtcaattttatggatccatatgtatctaaggatgtgtttgttttttgggaacattttgtataacaaccagtttcactctagctccctccttgatattctaaacaagctggatatctccaaagcttaggccctctccatacttacagcagctctgactggagattaaatcaccccttatactgctgacaatgattaggccatgggacccatgaaagagcctccccagagtccagcatcccctgtgggctccgtgtgtcatcaagatgtcaatccaactgctgttcctgcagtctgcaatcagcagggctatgtttattcagcggtcagtgtcacatcaatttccttctgttgcaacaagtataaatggattctaaatatttgcctttgggaaatttctttagagggaaactcactaaagctaatttttttagctttttggtatgttctctctgaatctggggatttagatatataaattagcttctttggtcttttcttgcccagggtcacaaccttgcctccaggataataccttctaagtgtttgtgatttgaagggcactacgaagatcctcacaaaaactacctcccagccgggtccctgaaactccatcattaaccaccttcatcagcatttctcttttaaaatccttattcattcctgttctccttctttctttctcacacacacacacacacacacacacacacacacacacacacacacacggggagagagagacagagagagagagagatagagaagtgaagtatatagtatcctttctagggatgcttttcttggcttggctccaatagagaattttgttgggaccctctatatatagtcgtgtaccaaataatgacactttggttaacaatggaccacatatgtgacagctgtcccataagattgtaataccatatttttactgtaccttttctatgtttagatacacaaatacttgccattatattacaattgcgcagtattttgtacagtaacatgctgtgcaggtttgtagcctaggagcaataggctataccatatagcctaggtatgtagtaggctatgccatctaggtttgtgtaagtacgctctatgatgtccatacaacaaaaatgcctagtgatgcatttctcagaacatatccccattgttaagtgatacatgactgtagtcatcatcaaacatttattaagcacttaggtcaggccaggctctgttctaggtgatgcagatataatattaaatataacacagtcctgcccttataaatctaatggtgaagggagaaatgtaaagaaatatgatggaaatattacattgtcatgtgataagggcgacaataatgccctacgtaggtagggtcaacgaaggggaaggaagctgggacaaaccaccagggcctgttggtccagaatgggacccagggtctgtctatgttataatcaattcaaaccctaggtaaataaggtaagctaggctgcctttcttgagacagtccccagattgttttcayagggcccaaacactctcagcaaccatgaacagtggatgttgtgggacctcagaagatggaattggaaattcaggggactaagtcagagattatttgacatttaatactggatattgaggccgggcgcagtggctcacacctgtgatcccagcactttgggaggctgaggcgggtggattgcctgaacccaggagtttgagaacagcctgggcaacatggcaaaaccccatctctacaaaaaaaatataaaaattagccgggtgtggtggcatgcacttgtagtctcagctacttgggaggctgaggcacgagagtcacttgaacctggaaggtggaggttgcagtgagctgagatcacactactgcactccagcctgggtgacagaatgagaccctgtctcaaaaaaaaatttaaaatactgggtattgcaggatggcaagtaggatgtggagaggaagagaattccaggcaaaggaaacaatgcgtgcatgcaaaaacaaaatacaaaaaactgaattgtgtagtctgggttaataagatgagtgcatttgatggatgtggtagaataaagagatgttaggaaatgagatcagaaatgtagactggaatcagattttgtaggaccttaaacatcctgctaaataatttgtagtttcatttgttggccatggagacccactagaaggttagttggtttgtttatatttaggaaagaagattcttttaagtttccttaactctactgaattttcaaaaatcaacctacagcaatccaaacttatctgtggagatacattccaagaccctcagtggatgcctgaaacctcatttagtactgacctttatatacattatgttctttcataggtgcacctatgataaagtttaatttataaattaggcacaatactcttgtgctttggggccagtattaagtaaaataagggtacttgaatacaagccctttgataccaaaacagccagtcggataccaagacactttctaagtgaactaacaggtgagtagtgtagacggcatggataggtcggacagagggatgattcacgtactgggcaggataaagcgggatggctcgagatttcatcacattactcagaacagcttgcaatttaaaacttatgaattgtttatttttgaaatttttcatttaatattttcagactaaggttgactgtgggtaactgaagcctcagaaatcaaacctcaaataaggggcgatcactgtactgaataatatgtcaagatgagctatgagcttttaacttagtgtttttcttctcccaaaccaaatattggaaactttggagtgtttagaaaaggagaatcgaaaagggaagtaaatgcagcattttttttaattgttaaataaagggctgggcttggaaatgttcttaggtaatcctggtggatttggtatatcatgtytgagaaaatgtggagagtgaagggcaggtttaaaatttgtctcatgttagtttctgaagggagatagcctggcattgcacagtgcctcacatttctatcgtatcacttaataattgtgcaacctgtgcttcagatttatcaatgtataaaagaggagagaccataggctgttgtaagtattaaatgacataatgcacgcaaaatgcttagaaccatgcttagttcatggtagccactcaaaaatgtcgtcagaactattactactcagtttaatgctcctagcacttaacacagtgcttggcacacagtaaagaggattcaagatgtttttgctagattacatggaatggtatggaagtgtgcagggtggtgtagagggttctcccattatcttgccttccttatactgcaatgtgctgacagcacctccattttataccctcaatgcaaggatatcactacttgtctagaaatggttgctcaaggctgagaagtgacagcaacacagagcctgggattgctgccaaatttcaagaagcacagattgtaacaaagtaaggggggagggtagagaagaaaagtttgaaaacccaaccaaagtcagaagccattttgttgtcggctgaaataatgcctcatagagtttcaggtggggcaggcagtgtgaaaactttgggaatagtcagtgtcaagttgtggtgctaagggaggaacccagtagtgctcaggcctgggcaagtctggcttcttggggcccagcatttagaaaggccctgtgtgttttgatattatgctgtcactatcttgaagttcttgataatttgttaacaagggccgcctccccccattttcatttggcaaatttcactggttcctgcaaattatgtagttaatcctgggtgcaggctagtttttgaaccatgttgggctagtattcttctgaacctctatctctttgatttaattacagaagaaacaaaagtcataacaaattatatctgtgcaggactaaaataaaatgagtagtgcctcactccctacatccaatcatgctttccaaaagtaaccactaccaataatttagcgtgcatcttcagaattctttatatgcctacattttaatgtatttttaaataaaatagaattacattgttgaagtaaatattaaaaaatatagcatttttgcatagaaatatttatttccctcaatcccactcccctttggtgaagcaaccactgttaacaattttgtgtgtatcctccaatatttttttgaaattaatgaactttactttttagagcagttttaggttcacaggaaagttgagtagaaagtgcagagttctcatgcactcctgctctcccacatacacaatgcccccacacccccgccacagtgacatcctgcccagagtggtacattcatgacaattgatgaaactatattgacatcattattgaaactatcattaccacccaacttccatgtttactttagggttcactcttccaaatatttcttgcatcacttaacaatggggatacactgagaaatgtgtctttaggcagttttttcgttgtacaaatatcatagaatgtacttacataaacctagatgatatagcatactacacacttaggctctatcgtatggcctatttctcctaggctacaaacctgtatatcatgttactatactgaatactgtaggcaatttttacacaatgataagtatttgtgtatctcaacatacctaaacgcagaaaaagtacaataaaaatacattattataatcttacaggacaactgtcatatgtgtggtccgttgttgactgaaacatgattatggggcgcatgactatatagagattttcaaaaagcaaaatgggataatgcaatatgtattattatacagcttgtgtgtgtgtgtgtgtgtgtgtgtgtatgttaacaaacacctttctacgtcagtacatatagatttgccacaatcttcttgagtaaggatatagcactatgttgtatacctatattataatttatccaatttgctgttggtatctatgttttctaaacaatacaatatacattcttatacatatttcttatgcatgcttgctagtatttatacaggataaatttcmagaagtagaattacagaatcataggatataaaaatatcaaattggcaaattggcattcacgtacctgtggttggactgcacttgttacatacttccctctgagccttccatccccacctcgagctagtgctatatgtcacttaactcagtgacatcatcatcaacagacttagcctctgcagttgaaaatgctagagcaaacagaggagaaaatttacttgtgaatcataatagctaacctgtactgaacagttaagccatgtgccaagtattattctaagcactttacaagtattaactcctttaatctgtataaccacacccagaaatttgtgcattattatactcattttactgctaagaaaactgacacccataggattaaatcagatcacacatttagtaagggcaccaggatctgaagcaggattgtttgacttctgagtctgtgctcttaaccactgcacacaccgtctctagaaagtttaatgccatctttatgccaaagtttatctacctggtttatcctttaacactattattgtatttattcatttacttgtcttttcctcccactgtgctgtaactctttgagaacagggtacttgtcctaatattattcatatttatatccctaattcctaatttaatgtctaatttattgtaaataagttttttttttttgagacagagttttgctcttgttgcccaggctggagtgcaatggcacaatctcagctcactgcaacctctgcctcctgggttcaagtgattctcctgcctcagcctcccaagtagctgggattacaagcttgcaccaccacgctaggctaattttgtatttttagaagagacacagtttcactatgttggtcaggctggtctggaacccctgacctcaggtgatctgcctgccttggcctcccaaagtgctggattactggtgtgagccacatgcctggccttgtaaataataagtttagttgaataaataacaatgcctccgggaggtagctattatatccattttacagatgaagaaactgtaagtcaatgttaatcaaatagtatcctagaaaatagtagaaagcagaatgctggagctgagatttgaacccaagacttttgatacttcgtccagtgtgctttccaccatgcctaagtagtctccttcacttcctccttcagagggctatggagagtaacctagcaaccatttctaagctggaaaatgtcacagccggaagtcttcagtcccctagaaggaaaagagcctgatggggagagggtccttggaaaagagaatttctggaagtactacatttgagaataggtggttaaagtgggagttggattagtaaaggaatactgcatagtagtaatacccattctttatttcagaatttcttcatgacagacattgatctgtgtgatttataagccttgtctctttttaatgttcacaatcccattagatggttattgttatctttgttttgcatatgaaagaatgggagctaagaggccaagtaccttgcctcttattcgttcaacgaataagtggtgaagcagattccaactcaagtctatgttacccaagaacctacattttaagcattttgttaccccctggatatgacagccaatgaagagggggtattttgagaagagactataaagggaaattgccttccctacatcctgggggaccttatcaaccaggaaacaaggtagagaaaactgtgcagcctgagccctgctgggttgcggggggctcacagaaagaagaaatgtgatttttttttagctaactacggagaccagccattccaatgtttgaatctgggttcgcagcacatgatgtctttatactcttaacctagaaatggcagagttattttgggcacaaagcaagagctgtggctttaaaaatatgccaagtgtatttatctcttccgctccaagattactgaaaattagcccagctgtagcttgggacaccaaacagccaaaaaatcttcttccagctcaactcattccacccaaagagggtgaaatacccaggagtagcagctctagcggcctctgggtagtggtattagattggcctccccattgctaagcctgacatccaatcacacacacaccactctcccagctgctctgtagatcacaatgctaggcctgtgaatggagctcaactccgtctcttccctcatccccaaggcttcacaagaagtaaacaaaacaaacaaaaactatttgattattgagccaaggagtcaatgtgagaatagtttttcaccttcattatcaaawgcctgtgtggagctgaatgtggtggctgacacctgtgatcctagcactttggggaggcagaggtgggaatattgcttgaggccaggagttcaagaccagcttgggcaacacagcaaggccctatctctctctctgtctctctctgtctctctctctctctctctctctctctctctctatatatatatatatatatatatattttttttttttttttttttttttgagacagagttttgctcttgttgcccaagctggagtgcaatggtaagatctcggctcactgcaacctccttctccagggttcaagtgattctcmtgcctcaaactcccgagtagctgggattacaggtgcctgccaccatgcccagctaatttttgtatttttagtagagacagggtttcaccatgttgggcaggctggtctcgaactcctgacctcaggtgatccacctgcctctgcctcccaaagtgctgggattacaggcatgagccactgtgcctggcccctatctctgtatattaaaaaaaaaaaatcttagccaggcatagtggcgcacacctgtattcctagctactcagaaggctgaggtgggaggatcacttgagtccaggagatccagtctggcagtcagccatgacctcaccattgtactccaacctgggcaacagatatagacgctgtctctaaaaaaaaaaatcctgtgtgatttaggacaaattatcttgctgtaatttaagccttcatattccttttttataaaataaatatgctttaaatatgtatttagatatacacttataataatagctttaattaattgtaattaaatcatttaaaattaaatacatgcaaaataccccataaactgtctaatccataataagcaatcaatagtccttaaacaaatgaatcttctgttgctctgatcttaataagtaaaatttaacgagtttttactttgcaccatgcacttatgctatgtgctgtataaggatagttacatttaatctataaatcaaccctatggggcgggcactcttakgaactttttttacggatgaaaactgaggcccagagatatgaaataattwgccaaacatcaccataatttacatgatgtagccaggtttaagcctactattctgattacagagcctaagatcctacagagaacagggagtatatttttacattcccttgtttccatggaaaagtctttccactgtcaattgaaggactaagcagcagcggggaagtgctggaaatgctagcccaggtgggcttagctttctccctctctctctgatcctggacaggatttgggtttcagaccacgattctcctgtgttttgtgggctgtgattactcagattaggtttgcccaattcataaaggactggcgggggttgggggtgaaggtgtgggagaaggcggagcttgtccagtcggtccaacaaaccccacagatggcgaaatagggggcggggaaggagcttgagatattttacaacctgggctgtttcagtggttgatggcggatggtttttgccttttggtcagcctgagtatatactatcattctacaatcggccaaattctgacagagagggagacagagagagaggttgattaaattgatgcccaaaaccaagaaggagcaaagaaatcggggctgtttgaaaaagactgcagtggctgacttgggtggtgagcggaaataaggaggagggagaggcggggtgtctctgcgcggaaagcctggaagttcacttgcaaacacagaatctgcacagccttcggtgccctgactctttcctgggcatccagaggcagcagcagccgccagcgccaaagaacgagcagtccaggggctgggccggaaacggctataatcatttaatagcctttgccggctgcactgacttagcagagtgggcggtaggcaggctccagagtgctgtctggcaagatagtccccggctttaatcaaaatgatgggttttctggaagctctttattaacctcagcactgaaatcccagagctggtaacaaagggatgaatggggagcaaaggggcggggccgaaacctggaggccgggctgcatccgcaccccttcccccacctccactcctttcaactcattctggcttagggctcctgctggcatctctgtgcctcccaaatagtagtaacaaaacaggcaataaccataataattggcacatttgtataacgctttagcattttcaaaggatgaccttgttatacagctcaggatctgagtctcctagctggagtcagactccctagatttgagtcccaggatccaccagttagtgaccatgtgaccattagtccttagtcccctcatctataaaacagacacataacacagacagagatactagaaatgtctacttcatagggctcttgtcaggaccaaaacctatacgacgtgcagatttgtttaactctgttgcacacacataggaagggcacagtaaatgttaactacatcgacaaccctgtgatgtagacaggaaggggatcatctccattttatggatgaggaaactgaggctcagagatatttatgtaaatggcccaggactatgcactagtgagagaaccagggcaagtcctcaagaacagaaagagaacaaagcaagatgaagagaagatcagaaaagtgaacaccctccaacaccctccagcacatgcccctctgagagctttcctgaaaatagtatccttggtcaaaatgagtttatgttctattagggaaagtcagtgtaaatcagaaaagccctcctggccttaacagaacagttccaaatgcagatgagggtgagtttaacaggcctggcatttgcttcacaatcttctggccctttcctggcatttgccttggcaaagactctgacctgatcaatcctagtccctgaggctcaactccatcaactcaggcagccagggttagtttagcatgaaagaggaaagctggaaattttgccaaaaagattcctgggcagtgcctaagggaagtgcccaaattggattataggattacatgaagtggccagctacttccagagggcagggttttttgtttgtttgctctgtcacccaggctggagtgcagtggtgcaatctcagctcactgaaacctccgcctcccgggttcgagtgattcttatgcctcagcctcccaagtagatgaaattacaggcgtgcaccaccacagtctcgctaatttttatagttttagtagagatggggtttcaccatgttccctaggctggtcttgaactcctggcttcaagtgatccacctgcctcagactcccaaagtgctgggattttagatgtgagccaccattcccggccccagagggcagtttttaaagtagaagtgaagatctgtatgcatttattaaaatatatgttgttctgattttaaaatatatccctaccaattgtgaagatatcggctaatccaataaaaaagcaaaaccatattttgtakaattatggtcgtattctgttaaataaacttttaaatcctattgggttgtaatctgtagtctgggaagggctctgcctaacgattcagacccctaccagatttatatgtgtctgaaatcctccttctagcctcttaacaggcccattcatttgggtcttgactgcatcctcagtcttgtctttgcctgagggtgagctaggaccctgggagcataagggaggggacttgccggagatcctagaagggaaaggaggcagcactgaaagaagaaacatttccttgattgatcatttgctgatactggcccctggttggggttaggggtagaaatgtgcttcttccgttttcatcttcttcaaaagggagtatctccatgattctgccccaaaggcatgacattttataggcaaagccagccaagtgtcttgagtgctcttaaccaaaaggaattcagattaggaggtcagtcagtgtttgtcagatccttaagcttttgttttactggaatgagtcacagtctacatgctgctgagctctcagagatgtttgttttatacaacaaccagaacaggtgaggcacagtggtctgtgagggactggagagaccacaccttgttctgctctgcggaagctggacatgtggaggaggcacctgactagatctctgcctcctggagtttaggctgagtcatatagaaccaggaagctcagtgacatgttaaagtggattaactcttggcagtcctgctgtgaggggctccctctgccaatacacacagccattaatgtcctttaactgtgcaagatgaacatatctctgtgttctgcatctccagatgacagtgcttaggcctcatgcagagtcctggttatggttgaagaaaaatttccattttgggctctgagggcaactaaaggactgtggagtggtgctgaaacccagttttaggtgccgaatcagaggtttttaaatacatttctctcttttgtctcagtctcttagagacaggacctgtattttaaaggtaaacaggcagattctggctgagctcaattgcagatttgattaacttagatagatcaaagtcattagtctcagagaaaaaatttgtttctcatccctaaagtgctattgtgtcagctctgccagggtgtaaggaaaagggtttggaagagagaagaaaatttcttaccctctctcgtcactgcctgctgtaaatttgcagtatcattatcttggtctcctaagccctgagagctgcattatatataattgcccatatgtgataccatttactgaattcttgcattgtgctaaggatcaagcttagtactttacatgcattacatcattgtctttagggaccccaaaagtgcctcattggagagttgtttggtctgctaaagagtgggtaccactttcacttctcacatcagtcctttcattcattcatccagcaagtatttactaaacacctgttatgggccaggaattgtgctaggcactggtgatacattggtgaataaacagatacattttttgcctttgtgaatcttacagtggtagagaataataggccaagggggtgctgcttggctaggaatgtcatagaatgcctktccaaggaggttacatttaatacagacttgaagagtgaggagtcatgctaagaatggatgagaggctcacgcctgtaatcccagcactttgggaggccgagacgggcggatcatgaggtcaggagatcgagaccatcctggctaacacggtgaaaccccgtctctactaaaaatacaaaaattagccgggcatggtggcgcgtgcctgtagtcccagctacacaggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaaaaaaaaagaatggatgagaaatcattcaagacaaaagcaaaccagatgtgtaaagatcctgaggcaaaaacaactccaaggagccaggtatggtggcctgtagtcccagccacttgggaggctgagacaggagggtcgattgagtccaggagtttgaggttacatcaagcaatgattgcaccactgcacttcagcctggttgacagagtgagaacctatctctaacaaacaacaataaaaaaacaattccaaagagtgtttgaggatctgaaagaaggcctgtatggttggagtataatagtaagagggagatttgtagatgagagtggagaagaaataaaaatcagattattgaagggacttatgtatcatggtaaggagttttttttttttttctcaaggcagtagaaagcttaagcagaggagtgatataatctgatttatatttttaaaagagtttgctatatgtatgttatgcctcatttttttttaaattttttatttttagatggagtcttgctctgttgcccaggctggactgcagtggcacgatctcagctcactgcaagctccacttcccgggttcatgccattctcctgcctcagcctcctgagtagctgggactataggcgcccaccaccacgcccggctaagttttttctattttttagtagagacgcggtttcactgtgttagccaggatggtctcaatctcctgacctcgagatctgcctgtctcggcctcccaaagtgctgggattacatgtgtgagccaccgcgcctggctgttatacatcagtttttaaagagagacattaagaaataaagatgactctggctactgtgtggagggttggagagaagcaaaagtggaagcagactgaataaggagactattgctgcaattcatataagagatgatggtgtcctgaaagagtggtggcagtgaaaattgggagaagaggacagagtcaagatatatttaggaggcagaaatgacaggtcttgatgatgtattataaatggagaatgaagaatagaatagagaaaaatgaataattagctttgaactttctggcttgagaaatggggtaaatggggtgtaatttactgaaactggaaagatttagaaaggaatagattcgaggaatcaagagtttgatttcagatttcttcagtttgggatgcccatgagatttccaactggggataccagataggcagttatacatgagattggagcacagagagatgtgggcttaaaatataagtctgcatctcatcagcttattcatatggtatttatatctatggatatggctgagatcccaaaaggagagagtgaagagaaaatagagaagagagtctagggccaaacccaaggaagcttcaacacacagatgaggagactgacaaaggaaactgtcaaagaacagtcagagagaaaggtcaggagaatgttttgatggtgggggccagaatatgctgtcccaaaataagaaggattgttgagctgaaggcaagttaaaagaagcagatacaggctgggtgcagtgggctcatgcctgtaatcttagcattttgggaggctaaagtggrcagattgcctgagctcaggagttcgagaccagcctgggcaacatgatggaacmccatctctactaaaatacaaaaaaaaaaaaaaaaaaaaaaattagccaggcatggtggcatgtgcctgtagtcccagctactcaggaggctgaggcacgagaattacttggacctaggaggcagagactgcagtgagctgatatctcgccactgcactccagcttgggcaacagagcaaggctctatctcaaatttaaaaaataataatcatgataataataaaagaagcagatataggagaggtcttctgccctccctgtatttgcctaaaaaaccataaatttacaaagacaaaagttatcctacttccacctccctcctctgcctcccaccaccagggagaacaaaggttaaccactgaagataactttggactcttattggcctggaaatggtactgctttacaaattagcctttatctgccattcatttgccttcccccaagtagctacccattagagactcaaagtccttaaaggtcttttcctttgtcttacacttctttaaaaatttattgttctttgttgaagatgctatataagctggaattctaagccacctttttgagaactgctcattctctgggtgtctgtcatgtatatatgaaatgtacatgttaataaacttctgtttccttttttttcttgttaatctgccttttgtaacaggggtccagtccatctaagaacttattggggttattctacatgacaaagaactcatgagaataagtgtttcaagaaggggatgacaaatgctgctgagaggtttgataagatgaggactaaaatgtgaccattgattgtggaagtaatataatgaacttgacatgagttatgttagaaaattactgctcagggacaccaaattagaggagactgagaagtaataggaaattgaaatagcagttgtacccaaccctaaactgtaattgaacataaacagtttatttgatggagcttttcacgtgtcaaccaaaggagcagtgttagatacataaacattgctatgatgtcagagttccaatgtcatggccactgggatcactttgcccagacagaccattacccttcctctccagctctgacttctactcttctagaagtcactggtatactttatggtgtgtcttccaatcagactcttgggaatgtcttttattgaaaactcctgtggatgcataatcattttcccaagactcagggcagatttcacctcctctggaaccccattaactttctcaagtataattaacaatttcttcttctggagtcccacaatactttacatatactttagttattgcatgtattaagttrgtttctagttgcttgagtgtatgtccaactagactgtgagcacactgagggaaggaatttggcttggaaagtaaaattggctcccagtgttttatctaaacaaataggctcaatttacaacaggattccatcctcttacgctgtgtattcccatctcttccatgctgcatcccaccacccttcaatgttattacaataaaattaagatcaaataatttattcarctaatttttcttgttttggacaaaatagacatcctaatacatttatagccaaagtttaatctagacactaaaaggagcatattttgcctttaggctctgtatttcccatcccgttcccagtcaagataatcacaactgtattctttaggaaattcttcacaaagaaccaaacatatgttactatgaaactagattcttggtatcctggtgaaaaaacctgccctcttgcttgtctgtaaatactggccttggctgggtgtggtagctcatgtctatgattccaacactttgggaggccaaggtgggaggatctcttgagcttcagtgtttgagaccagcctgggcaacatagtgagatcccatttctataaaattttttttaaaaagctagcctggcatgggagcttgtgcctgtagttccagctacttgggaggctaagatgggaggattgattgagcacaggaggtcgaggctgcagtgactgcatttcagcctgggtgacagagggaaatcctgtctcaaaaaaattaaacaaataaataaataagtaaacacttgccttgccctcagacttgaacaaacaactcgtgatttttctggggaggttcagcctgcctatgcagtactcctgtactctaccagcagtgtggcatcaagagcatgtgttgaccctgttaatgatttgtaatgttttgtctttcagaaccagaggcaggagaagtgtcccctccagtcggtgcgggtgtcaacagcaacagctggacctttaaatacggaccaggcaaccccaaacaatccggtcccggtgagttgcccgmcaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggraacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctkaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattrtattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatkttagttactagttattacagctgtaaggataaaacacgtcatgtggattcattttgaattggtgctattggtatttcctctgttattgctaataaatgaaaatggtggtatgaaagaaatggtggtcatttctaagaataggaggaaatagaacactgataagcaattaatactgaagaagattgctgcagtatgaaactcactgtaacactctcttatcacgttagcttttatgtccattactaaggcaaaagccccagtggaatcaagattcaaacttcatatcattagaatgggcagccaggaggttgctgcgtcactttgtagttacactatttcagttttctctaataagaattgcaacaaacccatttttatcacaagagcccttctaggcatctttttcattacttgtttagcccttgcacctctctacaattggaaagccaagtgacaccccaaagaaatgaacttttaggtcagggatagtggctcttgcctgtaatctcagaactttggaaggccaaggccagaggatggcttgaggccaggagttcaagatcagcctgggcagcatagcgagatcccatctgtacaaaaagaaataacttttattgagtacagggtgtatgccagccacactactgcataggttcagctgtgacaaatagattgttttgtccttttgtagttaaatttgtataaatataagctttagatgctgtaggttctcagttaggagcaattttgccctcctggggacatttggcaacgtctgaagtcattgttgcttttcattacttgaagtggagggtgctattggcatctactgggtagggggcaacgatgctgtgaaacacctggcaatgcacaggacagccccctataacaaaggatcttacagcccaacatgtcaatgtctcaaatcaagattgagaaaccttgagatagagtgaccatataatttgtgtagtccacttttgaaatggaacaggagacaccattcgttattacttcaggattcaagatgtaaactgggactgtcccaggctaactgggatttatagggactctataaataaactggtatagctgtgccactaactagatggggaatttgaggcaaaccactacttctctcagtttttcagtcatctctaaactggtcataattataatacagaccttatagatttgtgaggtaatcttaaaaggttttagcaggtctggcacaccatagtactcaataaatattattatttattaatccttttcttccatttccttacccccttttcagagatttagctattagacccagggaacttttcctactgactaaaatgtgaatgagggatggccaaaaaaatcaacatagtcttggcaataaaaatattttatttactcctccgctcttttgctcaccccaggaggaaaagaaataaagtcagtttcataactccttacctatttctatcataataataatcaaatccctaagtagtcaagtggccagtctgtttgcagctatttcacctcaattattggtgatctgaaagccagaaaccaaagggtttgaagtacaacagcttgagagagaaagagaagagtcacctccaacaacttctttcggcagatgagcaaaacagaaatgccaaattacccacagacttgcctgggatttcacaggcaataaaggacaagacaggtgcatctctctcaagggtcaggctacttgatataagtctcacatatacagagtgcaggattcattctttagaaatattgcaattgatctaattttaaaggatgagattctccaatgagtgtctagagccttggctttgaattttaggctcctaggtaagattgtaagtgccaggatctcatgttaatgtattttacgtttaaattataaacattatgtttgttataaaccccaatctaaagtacaaatgtaactgaccaaacactaatgcaattttactgttaaatctagatttaaaaaccatgcaaacattaagagatacaataaaacaagtaaacaaacaaaactacagatacagttcctcaagactttcagtccctggagcttttccaggaaatggaaatggaaataagttggccactctttgacctatttcatcatattttcatgtgcttcctttccttgtagaaaaagctgattatgttatttccctcaaaattaccttgactgttggctggcaggacacaacttgcaacctgagaaatttcttctggctttatgcacacacacacacacacgcgcacacacacacgcgtgcgcacagtcatacgtgcacacacgcgtgcacacacatgcacacgcacacatgctgacacacatgcacatgcacagaggttcttactgtaactaggagggggctttagcaaatgagcatggtgctgtcctccttttgaaactgtgcctaagagtggtacatagcaacctttttgttataatcagtcaggtaaaatgtttgctgggtcccattttctcttggggttgatccattgggaaatgcctgctgacgtatgaaatcttaaaagttttttgcctaataaagtctatcaccttgtctttgaacttaagctcctctgagctggacactagtaaatttactttcataatatgagtctagtttgcataaagaaataagaaagagtaggtagtgaaaaacataaagtccagcattttgttaggttacacaattgtcgggtgacttggggatcatcaatccacaaagaacatgagcaagtcagacaaccactcagccagtagctggtcttagagcagagctaaaacaattggcacccgaagcataaatatatgggagactgacacaacagttctcgttttagagtttgctttcactagacttactttatttagttttatgtgaaattgaatttttattataaaaggtaatacgtgttctttaaaataaatcaaataaaccagagatatataaagaaaaattattaatctcaccatcttctttcaattctctcttacatgggtatccaattttaacaatttcaaatgtgtttctctgcatttttctctatacacacacatttatatcacatacacatagttttaaaaataattgttttccttttttttctttgagacaggatctcactctgttgcctaggctagagtgcagtggtgcgatctcagctcactgcaacctctgcctcccgggttcaagcaattctcctgcctcagcctcccaagtagctgggactacaggcgtgtgccaccaggcccagataatttcttttgtatttttagtagagacagggtttcaccatgttggccaggctggtctcgaactcctgacctcaggtgatctgcccgcctcggcctcccaaagtgctaggattacaggcatgagccaccgcgcccagcctgttttcttttttatataaaaacaaaatgatgccatgcttgttgccctgtagatttttcttttaatttacaataacatgaagatttttttcagttcaactctacatcactctttttaatgcctgtataaattccacataatggccagatcataatgtcataaggcatttaatttttctagatttttgctactcaaaaccaaaaatagcacttgttcacaattataaatttagcacctgagctttataaaacctggtctaggtgtattacaaaaaggacgtttggaagactattatgaactttatgtgactccctccacaataatcacattcctttactggaactcactcagttctagtattcaacgttgaattgtggctctatttgtagatgaatggtgaaaaacagacattcacaagaaaaacagaaaaatgttagaaagatatgtcttcatttacttatccagaataatttcatgggagcttcatttcatccaaagacttctccattcaatcacagattgaaatgtatgtatgaaagaagaagtctcaaagacaattcaaatacttgcttagacctgtgatattttaatataatctggttgaacattgggtagaaagcagtctaacttttttctaggttgttacatgttacctgagggtagacatattaactttgtaccagtggagcttatttcattttaagaaaaacaaattgcttatcaagtaatgaatccaagacagccaaaaatcaaggcagccattcatgtatttaaaaaatctcagttacaaaaccatctggctataaacttcaggaaaccttccttatgaaattattgatactattttatcccttaaatcagcctttcaagacgtaattccagtctgggttcagtggctaatgcctgtaatcccaacacttttggaggctgaggcaggaggattgcttgagcccaggagtttgagattacagtgagctataatcagtcacatcactgtactccagcctgggttacagagcaatacactgtctcaaagaaaaaaaagaaagaactgcattcctaaatcaggtttattccattctctatggctaatagaattcatcagccagacacagcacacatttcttcccaactgctgtagctttccagatcaccttcctcttggtcctcctcaagcctatgatcaatttttcagaaatcttggagtctggaagtcctagccttcctttcacacttttcacagtagtatgctagcttagagcccaaccagatatctggtaagtcggttctaggacataggtgggtggtccatatacttgggatcagtagctgggataggcagtgctagatttttcctggggatgcttataggatggggaggaagccttgtacaggttaaacaaataaaattaggatcattcaggtactttctttgcatagatttggaatgatagggccaaggggctatggaatgagaccatttttgctgacagagatgtgcattttaaaatagattcttgggttgtgagttaaagaaaccaacaccatctagtttaagctaaaaaggatgatttattataaggacacaaatttgtttcattgaaactaagaatgggagtaagtttaggcctctggaaccagtaacttggaagccagaaaaattcctttttaaatttatcttctctaattatctctcttaatctgtttcattcttcctgtctctacagatcagctccctctccttctctttgccacagcttctaaatttatacacactaggttctagtggcccataaaaacctacgttctgtttcttttttctcttctttttttttttttttttttttttttgagacggagtctcgctctcacccaggctggagtgcaatggcgcaatctcagctcactgcaaactcctcctctcggattcaagtgattctcctgcctcagcctcccgagtagctgggactacaggcgctcaccaccacacctggctaatttttgtatttttagtagagacggagtttcaccatattggccaggctggtctcaaacacctgaccttgtgatccgcccaccttggcctcccaaagtgctgggattacaggcgtgagccgccgcacccggccacatactttctgtttctaattcctagttctaacttcttcctggaaagaaaaactaattggatcaccttgagtcaggtagcccatcagccatgggccagaggactgtgggtaggaaggagaattctcagaaaaaaggagatcggatacttagagacaactttaatagcttgctgatagctgatattccccagatactgttagtatattaaacatcagtgtatagaatcttagaaacttagggccccaaggaaacttatttaacaaatgagaaaattgaggctcacagaaaggggaatgactcattcaatgttacacagctagtcaatgacaaggcagctattctcctgttaccactctactgcacagctagaggccaccaggagtgaatgacaatactcatttcattatatgtttgagagccaaaagtagtacaatttagggaggtcatgttaattttatatagagagtagtatttcattgttatatatgttttattaatctttttattcaagatgaaatatcaatattgatttccctttattgat

SEQ ID NO: 12251 - DNA, 47196 bp, Homo sapiens
  misc_feature (1)...(47196): n = A,T,C or G, or insertion/deletion polymorphism (see Tables 1-2)
ccttggattgggtccatggttaagtgagtgagtgaggctcaagggcttctttttttttttttagagatagggtctcactctgttgcccaggctggagtgcagtggcatgatcacagttcactgcagctgcgacctcgtgggctcaagccatcctcctgcctcatctcccttagtagctgggactacaggcatgtgccaccatgcctggcaatttttttttgtatttttggtagagacggggtcttgccatgttacccaggctggtcttgaactcctggactcaagtgatctacctgcctcagcctcccaaatggctgtgattacaggtaggagccaccgcgcccagccttcaagtgcttttttttgttagtgagactggtacaaccaatgccaaggctggtgagcaaagttgcacccagttggggaggggcgaaaccaagggcagaagggcccagggcatggcctctcatggctgaaggaagaggggacacgtggccagtcacagtgacctctgcagacctcaagaaggaggccagctaggagccatagctgtcactaagacagtcaaaatctaatcagcaccctggcgccaagaggccattgtccgctgctcaggacagtgagtgatagtcgataaccagctctctggaggtcagggccccgaggtggctgagatctgtgcctgcattaggacatttaaggggactccaagccaggatttgctagtgtttgcccagcagggagaggtggaaaattggggatgaccaaccaggcctccctgctcacagccaggggaattcatcctgtcgttcttccattcagcaaatattcatggagcacctgctgtgtgccaggcaccgtgctaggctctggggagatggctgtgagcgggatcgacactggccttgtgtgagctggccttgcagtaggggatatgagcaccaaacacataaggcccgagtgtgcaatatgccacaaagattgcagagaaataaagcaagataacaggttgcagaaagatggaggccaggctggctgctgttcctgggtaggtggcttctggacacagtttcctcaggctctgtttcctcctttgggcctctggaatcttctgaagacaggcctggcttccaggatcccggatggagttgcctgttgactgtgtggactcaaagtgtccacagtgcgccggagcgcgtggtcttccccagcaaatctgcttctcttctcggctctccatcgtgggaagggtccctgggatcctccccaccaccccagcctgaggccactttccctctgtccccgctctccccagcctgctttccccaccaagcgccaccaagtccctgctgcctcctcctcccaaacaggctcaaacctgccccctcttcgccagctctcagctcagcccgctcctctcctgcttaagagccttcactggctccccactgccctagagacagagtttgagtctactgccatggcttggcagacggtgttgtccctggcctgccaaccttccagctgccatcccagccagtccttctcccccttgctccagccaagggccccgcttgtagggtgggaagtgggccgtgccctccctcctgcctgcctattcgctgggtcttccctcattccctccctcaccccgccctctcataagaaccttcagaatctgccagacgcagtggctcacgcctgtaatcccagcactttgggaggctgaggtgggtggatcacctgaggtcaggagtttgagaccagcttggccaacatggcaaaaccctgtgtctgctaaaaatacaaaaaaattagctgggcgttgttgtgggcacctgtagtcccagctactcgggagactgaggcaggagaactacttgaacctgggagacagaggttgcagtgaactgagatcccaccattgcactccagcctggactacacagtgagactctgtctcaaaaaaaaaaaaagaaccttcagaatcataaaatgggtttaataattatacttatctcatagggagggcttaaagcacctaggccagtgtctggcaccaaggaaacactgtatacctgttaaaataagaataaaataaaatacacatgctcacttattgagtgcctgctgtatgtcgggcccctccccgagagaactctggtgcatccccgataaagaaacctgaccctctaggatgagggagggtcttccctgagcgcctgctaacagcctcctctgctaatctgaagtcctgcagcttgcccagcaggctggcttgtcacacgggctacccccacaggccgccatcttggaaaaggccaatggctgtggaatcattcttgactcctattagccttcctgttctctctcccgccccacagcatccatcctgtcagcaaatcctgtgggctctgtcttcaacacagatctagaattcagccccttctcaacctccccatctccgcagcctggtgtgagccctggcacctctctctggggccagtgtggtagcctcctcactgctacccacttctacccgtgcccccaccacccaagcaagagaggtcttttttaaagtctcatcatgtcacttctttgctcaaaacgctctggcaacttcttccttgctcaaatatttgttaaaagaagaaaggaatgaatgaatgaatggcctgtttgcatctgtaatagccagcacataggcagtacttggaaaacacccacagcaagaataaatgaggagatggctggacacggcagctcatgcctgtagcatgttggaaggccgaggcaggaggtttgcttgaggccaggagtttgaggttgcagtgagctatgattgtgccatagcactccagcttgggccacagagagagatccccatctctacaaaaatttaaaaattattcgagcatggtggtgtgtgcctgtagtcacaactacttgggaggctaaggcaggaggatcacttgagcccaggagttcaaggctgcactgagccrtgacggtgcgactgcattctagccacagaatgagaccctgtctctaaagcaaaaaagagaaggagaataagtgaggtacttgagcaagtgggtgaggatggttgagccacagcaggcccacagggaggctggtgggtgctgttggtggagggggccgatttgtgttcctggtggctgcagagccagtctgttgcctcccctccctcccactggctgggctggggacggagccaaccaggcagatcccgggccattctggggccctggcctggcctgccttactatcccagtggggccaccgacgtggctgccatttctggaaaccccagttctaggtaggttactgtcccaggaagaagtgcatgcctagcttcctgccagcccagcccagctgtcccagaagccagaggaagctctgggctggtttcttataagtagcatgactaactgattgcgccacaggagctgaggtttcaggccagtttctgtcgtggagtttcaggggtcagcggctccaaagccccagcccccacccgaggcccctgctgtccctggattcctctccacatgccacctgtcacagaggtgcttgcatcctgtctgcagaaccagcccctcctccaagccaggtttcctgcccagagggaagaagagcagaaggcctgtaccgccccctgtgcgcccccagtcctccgccccctgcccccctgccacccgctgtgggttcgggaagagtcctgctgggtcgcttccaggctgctgctggcttctgacatttcaaggcttaatcacttaatctcccccgagttttttaaaaaaagtgagtcaagtgtgttctcctggtggcgggcgtgttttcccaggcccatgcttctgctcatttcctggctgcggccttcactgactttgctgcttcctaactctgtgaccttggccttgtcacttgctgtctctgggtctcaggccaatgggtctcaggccagtggggctccccggacaaagttccagggttttggggactgcatttcaagggtcagcaaccacagtccttaaacacgtggattttggagtgacaatgcctaggttatggttctgtgaccaccagcaagtgctctagcctttttgtgcctcagtcttctcatcagtaaaatgggaatgttaatggcacctacctcatagggtcgttgggagaaccaaattgattaatatattgtaagtacttagaacagggccaggcacaaaataagtactgcatatacagttaactatggacaaaagcttgggacctggttcatgtttaaaaatgattattgaggccaggtgcggtagctcatgcctgtaatcccagcactatgggaggctgaggcaggcggatcaggaggtcaagagatcgagaccatcctggccaacatggtgaaatcccgtttctactaaaaatacaaaaattagccaggtgtgatggcgtgctcctgtagtcccagctactcaggaggctgaggcaggagaatcacttgaacccacgcggaggttgcagtgagctgatatcgtgccactgcactccagactggtgacaaagctaggctccatctcaaaaaaaaaaaaaaaaaagattgttgaatttattattgctgaatttttttttttttgagacagaactttgctctattgcccgggctggagtgcaatggtgtgatctcaactcattgcagcctctgcctcttgggttcaagcgattctcctgcctcagcctctcagcctcccgagtagctgggaatacaggcacccaccatcatgcccggctaatttttgtatttttgtagagatggggtttcaccatgttggtgaactcctgacctcaggtgatccacctgcctcggcctcccaaagtgctgggattacaggcgtgagccactgtgcccagcctattattgctgacttttaaaccattcattcatttaatatatgtttattgtacacatgctatgcctgtgtcaggcactgtttcaggcactggggataaagcagtgagcacagcagacataaagctctgccctcatggggcttgtggtctctcagagggaggcaaacaatgcatttatagacaaatacataatttaaatttgaggttacctattatactcccaacttgaaaaactagcagtatattgaggtggctatttcacatctgatggaggaatatgtcttttgtgaaccatttatgttctttgcctatttttcttaaagggatgtttgtcttattgatttgtaagaactcttcatatattaaggccattaaccgttcataatgtagattgctacctttttctagtcttttgcttgctgatatagttgggatgtcatcctctctaaatctcttgttgaaatgtgatccccagtgttggaggtgggtcctggtgggagatgttgggtcatggggacgggtccctcatggtttggttctgtccttgccatagtgagtgagttctcacaagatctggttgtttagaagtgtgcggcacctccctcctctctcttgccctggctgtcaccatgtacgcctgctcccctcttgccttccccgtgaataaaagctccctgaggcctccccagaagccaagtagatacgggtgctatgcttcctgtacagcctgcagagccataagccaattaaacctcttttctttgtaaattactcagtctcagatatttctttatagcaatgcaaaaatggactaacacacttgagttctgtctttttcttatggcatattttaatctaggccagacacagtggctcatgcctgtaatcccagcactttggaggccaaggcgggtggatcacttgaggtcaggagtttaagaccagcctggccaacatggggaaaccctgtctctactaaaaacacaaaaaattagttgggtgtggtggcacacacctgtaattccagctactcgagaggctgagacacaagaatcgcttgaacccgggaggtggaggttgcagtgagccgacatcacgccactgctctccagcttggggaacagagcaaacctccgtctcaaaaaaaaaaaaaaaaatctagggaagttgaaaacattttgcagtcaaagctatctttgctrtctgcatcttgaaataaaataaacattcatacatgtaacctcattaatctgattagagatagtgataagtactgggacagacataaacagggtgctgtgataagaagtcacagggagggcccgcattagttgaggggggtcagagaaggcttctgaagtgtttctggtgcaaatgcttggaaaagggagagctgggagtgtatcccagggctgaggccaatggaggattgcagaagagggagaggggataggaggggaatgttagagggataagcaggggaattggctcttttcttcattttcttaaattaaactttttattttcagataattaaagatttacacacagctggaagaaatcatagagaagccgggcgtggtggctcatgcctataatcccagcacttttggaggctgaggcgggcagatcacttgagatcaggagttcgagaccagcctggtcagtatgatgaaaccccatctctactaaaaayacaaaaattagttgggcatggtggcttgcctgtagtcccagctactggggaggctgaggcaggagaatcacttgagcctaggaggtagaggttgcagtgagccgagatcacaccactgcactccagcctgggcaacagagtgagactccatctcaaaaaaaaaaaaaagaaaagaaaaagaaaaagaaatcacagagagacccctgcttctatgctgttccccccgagggcaagattgtagaaatctgtaatacagtatcacagctgggatactgacactgatataagctactgaccttattgggatttcccgatttacttgtactcatttttgtgtttgcgtacgcatgtgtggtttagtgctatgcaattttatcacggcataggtttgtgtatgcagccaggatccagcacagttctatcatcacaaggatggctcaaattctccttttatagccacatccaactcccttcctgacccaccccctcagcccctggcacccactgatgtgttttccatttccatggttatgtgatttcaagtatgttacataaatggagtcacggggtgtgtactctgggaactggcttttttcactctagggcttggattttattctaagtcagagatgcttctctaatgagctgtgaaccccctggggatctgtggcccctgtgaagaagccctttaggagccagggggcattggatgtgtgagctggccctggtctcatttctgattttaaaatggctctggctgtgatgtggagaagaggcagggtgagcctcatctgcagcaactgctaactgcccacatccccccrgmcttctcaaaaatttgccactcccctgctcaaagaccctcaaaagctgcccactgcttagaggacaggcctttgacctgaggtcctcacttgggcttcagggattctgtgaacccctaaaatggaatgcagaattaagtgtatgcaccttgccagaaacagggtttggggtttacattagatgctcagataggtcattgatccccaaaacactaaggwctctgacttctagacagatagtagttaagaaccaaagctttggagcttgagtgctggatttaagacccatgactgtcacagctgtgcaacctcagacaaatcactcagcctttctgtgccttggtttcctcatctgaaaatggagaaaataatattacctatttcatagattattaaatgcattcttgtatgtaaaagatgtaaaagaaaacttggcatgtggtaaactctgtgtgtttaagtgaatggtgaggctgcccagtataggagggcagagctttccaggtaaagactttctaggcctcctgggattatcaggccctctctgtgttggttgttgtcatacatgacagcagtattccttccaaagggatgccaagttgtggttgcacactgcacttagatccagttgattgacagcactgttcaagtcaactgtgtccttactgatttctgcctgctggatctgtcgattaccaaaagagttgaagtaatagtaataatactattattatccaataatagtattattcagaataatcacacagatttctctatttctccttgctgctctcagtttttgccttacatattttgaccctttgttgttagttgcctacacattaaggattgttatttacatcttcttggagaattaactcccgaatcattatatagtgccacttttttttaatttaaaaattttattttttattttttgagacaggatctttctctgttgcccaggctggagttcagtggcatgaacacagcccactgcagccttaacctcctgggctcaagtgatcctcctgcctcagccttcccagtagctggggctacaggcatgtgccacctctaataacttttctttaatttacartagtattagtttgttctcatgctgctctaaggacaygcccaagactgggtaatttataaaggaaagaggtttgactcacagttctgcagggctggggaggcttcaggaaacatattatcatggcggaaagggaagcaaagacatcctttttcacatgacgtcaggaaggagacacgccaaggaaagggggggaaagccctttataaaaccatcagatctcaggagaactcactcactgtcacgaaaacagcatgggggaactgctcccgtaatctaatcacctcccatgaggtccttcccccaacacgtggggattacaattcatattacaattcaaggtgagatttgggtggggacacagagccaggccatatcacattattattaattagtgccttctctctcatttttttgattcgcctaggtagagatttatcaatttcattgatcttttcgaagaaccaatttttgatttcattgattytcctcgattaattttctatttttaatttcattgatgtatgctccaattttgtatttttttcttctgcttgttttagacatatattgcttttctgtttctagtactctagatggaaacagattattgattttagaactttctttctaagatatacattcaataatataaatttccctctaagcactgcttttgctacgtctcaccgattttgataggctatattttcatttttattkagttaaaaatatttttagtttctcttgtgatttcttctttgatccatatgttattcggaagtgtgtttttaaatctccaaatacttggaaattttctggctttcttcctgctagtgacttctaatttgaatccattgtggcctaagagcatatgttgtgtgatttctaatgttttcaatctcttaaggttgttttatgtcccagaatgtggtctgtcttggtgattattccacatgaacctgaggagaatgtatattctgctgttgtgagatgtaacagtctataaatggatacctctgttaatatgacctcgggtgactctttttttttttttaagttgctgcttcaccattggcttttggagattttgcagatgataaaatcctcaggacttttctgctgctcagtcagattttcttatcctacacttgcggaactgttgtttgaaattgacaagcaggatggccaactctgcccggctcattttatttcatcttattgggttcagcctgcagttttaggagatgagattgaaggaactggtatactggaatccacggtgggctcggaagcaaacaaacgtgggttctgattctagctctgaccttttaccagctgtgggacctggtggatgggttatttggcctctctggcctcagtttccttagctagacagttgggataacagcctacctttcaggattcttgtgtggattcggtgaggtaatacttctaaagcacctagcaaagtgtcaagtacaaggtaagtgctgggcaagcagggattttgttcacacaaagccttgactcaacataaggaggctgtttccaatggctctgcttaactgagacctgagagtgattgctccatctgtggtggcatatgggctgaaactgcctagcagcatgtcagargtggggygttcgcaggacatccttgtccaggttggcagttgagcttggcaggtgaccgctgagaccccttccaactccaccacttcaggaatctcttttttttttttctgagacagtcttgctctgtcacccaggctggagtgcagtggctcaatcttggctcactgcaagctccgcctcccgggttcaagccattctcctgcctcagcctcctgagtagctgggactacaggcaccygccaccacgcccagctaattttttgtatttttagtagagactgagtttcaccatgttagccaggatggtctcgatctcctgacctcatgatctgcctgcctcagcctcccgaagtgctgggattacaggcgtgagccaccgcgcccagccaggagtctcttgatttagaatgggaacttgaaatcatctcctcttgccgtgtacttgaacgcgataacctggcacttatctttttaattcttttactcacctgcatctttgttctttttgcctctgatgttcagggaagcctcttctcccactgcatctgtgatctctcctgaaatgtagcacccacacatccctgagaagctagctgcggcacgtgtgtgtgcacatgggcatgcrtaagtctgggcgtgccttccacaacagattaaggatatcaatcctgacgccatgctgggatgttttagtgaatcttgacagggttgttgactcccctgtttccctggaggactttaccatgaaagtcttctgctgtgtgactttggacaggcgtcttggcctctctgtttctctttattcataattgaggctaaagtgacacctttgccatctctgccacaggatactgtgggcatctgtgtagttgtgagagtaaaagttactaggacttgccaaggaaatcagtgtcaggaacccaccaccccattcccgcccctcctttacttgagactttacttttgtaactctcagcaaggaagacgagttcaacctttgagccgatacagagccttcccctagagagagctttgcagcctcatgctgagccagttaggggccccacatcatgtccaaaatgaatttaatcaacaaacagttactgaacacgtcctatgtgccaggcaccgttgtagatactggggactcggcagtgaatgggacagaccctggctgtcaggatgacagacaatttaaaaagggacagatgtcccacgctggcttgtcctttgcaccccyggcacttcgtgaggagcagcggccagttcttgtatatagactggcccttggtgtacatttgtctgacgtttccaaatgatgtatgcatccttggcaggaacccaggaaaagacatgctgtgctcttctcaggaattgtttcagggaggtgatgttggggatttgtcccattcttgttggtgagtttagatcacttggtgaaggtggtgtctgccaggtttctgtattgtaacgttcattgatatgtattttcactcattagttaatatacaatacaagttttgcagggagttactttgaggctgtcatagtaaaatagagctttcccttcttccctgtttatttatttattagagatgaagtctgactctgttgcccaggctggagtgcggtggtgcgatcatagctcactgcagcctccaactcccaggctcaagccatcctcctgcctcagcctcccaagaagttgggattacaggcacacaccacactgcacccggcctcctccatttattgatctatgtcaatacagactcctggactttaactccaagggttacaagtggataccataatattcattttgatgctcaaaatgtgcctgttttgtccaggtcaggctagctgctgagtacttccttattgtctggcacaagaattccaagcctatctggtacttttccttctcctggaatcagctatttctctaaggcgctctggttcctttcagtacagaatagtatttagaagccaagacctggtcactaggaaggcatgataatcaaatgtgatgaatgatcttggattgcatcctggacgtataaagggcattattgaggcaattagcaaaacataaataggggccgtggatgagatagtggtgatgcatcactgttaatttcctgatttcgatggttgtattgtgattatgcagagaatgtccttgtttttctgacatgcacactgaggtattggggtaatttattcattatggagatatgtgagtgtgtttatgtgtctcatacacagatgtttcttaatgatggggttttgtccccataaactcatcataagttgaaaatattattaagtcagaaatgtacttcatactcctaacctactgaacgttatagcttaacttagctcggaacacttgcattagcctacagttgggcaaagtcatctaacacaaagcctgttttgttataaagtgttgaatagcttgtgtagtttatggaatactgagagtgaaaaacagaatggtcgtatgggtgctccaagtactgcttctactgaacacccattgattttgcaccatcataaattaggggaagagaggaaaagcacgcgtaagggaggaagggccgggtacagtggctcacgcctgtaatcccagcactttgggagaccaaggtgggcagatcgcttgaactcaggagttcgagaccagcctgggcaacataatgagaccccatctctatcaaaaatacaaacacttagccaggcctcatggtgcacatctgtggtcccagctactcaggaggctgaggtgggaagattgcttgagcccgggaggtggaggttgcagggagtcgaggttgtgccactacactctagcttgggtaacagagtaaactctgtctcaaaaaaaaaaaaaaaaaaaaggaaagggaggaagggaaggtccctccaggtggaggggacagagagagaaaaggcatggaggtgggactgagtttggtgtgtttaagaagtgcaggtggcagccgggctcagtggctcacgcctgtaatcccagcactttgggaggcygaggcaggcggatcacctggggtcgggagttcaagaccagcctgaccagcatggagaaaccctgtctctactaaaaatacaaaattagttgggtgtgtggcccatgcctgtaatcccagctactcagaaggctgaggcaggagaatcgcttgaaccygggaggcggaggttgcagtgagccgagatcgcgccattgcactccagcctgggcaacaagagtgaaactctgtctcaaaaaaataaaatgaaataaaataaaataaaatgttaaaaaacaaaaaagaagaagaagtgtaggtggcaggcgtaggatgcatgggtgctgggcccaggtggagagggaggtggagccctgctggggggagggccttcaagtgtgcccaagtcactcggagagcatccagcaggggcctagagctcctgaggtggccttaagttcttatgatgccccagacactgcacacagtrcttcagaggcaacacctccgttcctgtttgctgcaagcctgtgaggttagccttggaaccattcctgtgccacagaaacacagccagagcaccaaaagagaaatgctgttaatggcaaagaactactcactagcagaacaaagcctgggagctgcttttttgaataagatcccaggagagagacccaagcgggaagtgaaggatgggcacttgaaatgttgcagggaatataacccagcgcgtgctgttttctttttttctttttcttttttttttttttctctttttgcaacagggtctcactgtgtcgcccagcctagagtgcagtggtgccatctcggctcaccacaacctccacctcctaggctcaagcgattttcctgcctcagcctcctgagtagctgggactacaggcacgcgccactaccgcccggctaatttttttttgtatttttggtagagacaggtttcaccatgttggccaggctggttgtgaactcctaaagtgctgggattacagatgtgagccaccacgccyggccccagtacacactttttggagggtatttgacgttatgtaccaggagtgctggggaaaagtacacacttgactccgtgagattctgcttcttagcatttttttcttttcctttttttttttttttgagacagagtctcactctgtcacccaggctggagtgcaatggcatggtctcggctcgctgcaacctccgcctcctgggttcaagcaattctcccacctcggcctcccgtgtagctgggactacaggtgtgcgccaccacactcggctaatttttgtatttttagtagagacagggtttcactatgttggccaggctggtctcaaactcctgacctcgtgatccgcccacctcagcctcccaaactttctgttttcttttcttttcttttttttttatgacagggtcttgctggagtgcagtggtacggtcttggcttactgcagccttgacatcccaggctcaaacgatcttcccacctcaacctcccaagtagctaggattacaggcatgcaccaccgtgcctggctgattttgtttaatttttgtagagataaggtctcactctgttgcccaggctggtcttgaactcctgggctcaagccatcctccctccttagcctcccaaagtgctgggattacaggtgtgagccaccacacctggcttctgaacattttttcttaatgataatagctggtgctatgggctgaatgtgttcccccaaattcatatgttgaaacttcatcccattgtagtcatattaagagatggggcctttggagaagtgattaagtcatgagggctctgtggttggtcatgaatggggttagtgccctyatgaacgggctgaaggaagtgtgtttgccccttctgtcatatgaagacacagcagcatggcatcgtccgtgaggaatgggctctcaccagatctggatctcctagtgtcgtgatcttggacttcccagtctccagaactatgcattagaaaatttatttatttattatttatttattttgagatggagtcttgctcttgtcgcccaggctggagtacaatgacgcgatctcgactcactgcaacctctgcctaccccagttcaagcgattctcctgcctcagcctccagagtagctggaattacaggtgcccgccaccacactcggctagtttttgtatttttagtacagacggggtttctccatgttggccaggctgatctcgaactcctgacctcaggtgatccacccaccttggctccccaaagtgctggaaatacaggtgtgagctactgtgtctggcctgaataataaaatttaaaacaatttttcaaaaattcaccatgaggtctcactatattccctaggctggtctcaaacccctggactccaagtgatccaccccaccttcccgagtagctgggactagagatgcacaccattgcacccaatagagcaatacgtttctgttctttgtaaattacctgctctaaggtatttttgttatagcagcctrtatggactaagctgacttgtaacgttacttgagactttaaagtgttccggtcactgttggagggctctgtctgtgttagctcatttaatccccacaacacctcaatcagatggggctattcttagtcccactttatagataaggaaactgaggcatggaagcacagcttgctcaaggttcacatctagtcagtgacagagcaggtatttaaacctcaggaaataatcagagaaacatgtgtagagggttgtccaaggaaggccacatccagaagcatctcccaggacagttgttgtgtagctcaccctctggactttgtgggtctgggtgttgtttcatgwttatagagagagctctgtgaacgtggaggacctgttgtcggcagagacacaaatggccagggcatggctgggcagccgcagtggctcaggcctgtaatcccagcacttcgagaagaccagaggggcagatcatgaggtcagaagttcaagaccagcctggccaacatggtgaaaccccgtctctactaaaaatacaaaaattagccaggtgtggtggtgggcacctgtaatcccagctactcgggaggctgaggcagaagaatcrcttgaacccgggaggtggaggttgcagtgagctgagattgcaccrctgcactccagccttggagacagagcgagactctgtctcggaaaaacaaacaaacaagcaaacaaacaaacaaataaatggccagggcaggggagggttgcatattgaataagatgagctctgctggaagcacaggtcagcactaacctgcttcctctctctctgcaggtgccttggcatctcccaatggggtggctttgctctgggctcctgttccctgtgagctgcctggtcctgctgcaggtggcaagctctggtaagtcaccacttctcaatcattcatttgttggctattaatggcgtgccagggtcctgcagtatgtcacctggccttatggagattacactgcagtgggaggggacagccaatgacaagtggccctgattatcagtaaattctaaagattgttagaaagtgatgggagccgggtgcagtggctcacacctgtaatcccagcacttcaggaggccgaggcaggaggatcgcttgagcccaggagttcgaggtcagcttgggcaacatagggagaccttgtctctacaaataataaaatattagccagrtgtggcagtgcacgcctgtagccccagctactcaggaggccgaggtgggaggatcccttgaactcaggaggtcaaggctgcagtgaactgtgatcgcgccactccactccagcctgcgtgagaaagtgagaccctgtcaaamaaaaagagaaggtgatggggaaagaacacagaacagcataagagggggttggggaagctgggtggagtgggggggaytgcagttgaaagtagggaagtcagggaaggcctcattgagctgacttggaggaagcgggamccgtgcagatgtctggggaaggctcattcttggcagagaggccctgcactgagcctggcgggagggttgagcacaggagggaatgtggtggaggagagtgagcagcaggagggagcagtgaaggtcagcaaggtgacagagtggctgaatcaaaaaagaccttgcagtgtttgagcagaggatccatatcatccattatgttccaaaggactcttcaggatgccgtgtggagaaaggaagagggtggaagccaggaggtctggagggaggtctggagtggaggagatgagaggctccggatccctctgggaggtagatttgaggacagattggaattgaggtgaaagacagagaaagagaagtggccaggatgactccaagatttctgacctaaactactgggaaggacgcggttgtcatttctgaaatgcagaaggatgccagaagagaaggtactttggggaggggcgggaatcaggagttagttttggacatgagataagcttggaatatttatttgctatctaagayagctccttaacatggtaagcccttatgcaagttgttgtcagctgagatgggcgtggcactgagcatgggagcatggaggcgcctgagtggtctcatgctcaggtgrtttagcaaactcagtgtacatcctgccaattccagtcctgccatggccactgacaagctaggagggygctgaaaggagaaggaccccgatgtctcctccagcccatccatctcctstcwcccattggccaaacccaaccggaaacyaaaggccaagggtacccggtgatgaagactgtggtatcagcctcctgagcacagagagggcagaaaggggtggagacaaagaggggcgcagatagtgggcaaatggggaagtggcacttcccctagctcgagggcagaggcttggtgtgatggaatggcactccttaaactgctacatattttccctttaatttggccaagaacaagttgtcaagtttgtgtragataaaggtgcacttggttcgttcttgtctaatggcccccrcacccatgggtatttcttcagcttccacagtcatcccracactagctgggaagctccagcagccctggtcctggccccagctctgtgggcgctggccctcaactttgcctgcactgtgcttttgtgytattccccttggtcctgtttgggtgcaagtccccctcacgcattgagttcctgggccgctcaggctgctcctgtgtctccccagggaacatgaaggtcttgcaggagcccacctgcgtctccgactacatgagcatctctacttgcgagtggaagatgaatggtcccaccaattgcagcaccgagctccgcctgttgtaccagctggtttttctgctctccgagtaagcctgcgctggagctggaggtttggggaggttgtgcccaaagggtttgccccaagagtgagctgggtccaggtggtgcgctggagtgcaggatgctgagtatggtttgctgctgtttatatggtgttagaggggaggtcccatctccagggacatgttatgtaagatacagtggagcgcatggtgggagtgttggtccacrtggcacatggatacggctggaatactggactagaccagcagttctcacactttttggtctcaggaccctttttcacacttaaaaatgagtgaggacccaaagggctttggtgtaggtaacacatcattctatgtttacctaattagaacttgcaatgaagaaatggtgtaatttttaaaaaattaaaacaattaaaaattttttttcttactgaaatggaggtctcactgtgttgcccaggctgctctcaaactcctgggctccagtgatcctcctgcctcmgcctcccaaagtgctgggattacaagcgtgagccgctgtatccggcccaaaatggagaaattttaagtcccaacaacatgcaagcccgcattcaacaaatcttcagatcaattacatgatcacaggtcatgtagcctctagaaaattccactgtacgccagtgagagagagtgaaaaggcaaataacgtccctgtattatgatgaaaagagttttacctggtgggcccagaccacactttgagaaccactggactagacccttgattgaggagtacggtgttgagagtggagtyctctgtgatggtggatggaccaggacacatggcataggagtcaggtggttccctgggctactccatggtgcacaggatgcttcgttacactggtgcccaggacataatcacgtacacaagacacacagttacggggcagactggggatatacggcacaccagcatgcagsgttcaccagtaaaggtggtattccatgattattctaaggtagatgggctgtgctttgtttccattggcttagtccagggattggcaaactatggcccgtgagccaaatccggcccactgcttgtttttgtaaataaagttttattggaacacactggctgctgtagttgtaacagaaactgcatggccctcctttatgtttttttttgtttgtttgtttgtttgtttgttttctttgagacagagtttcgctcttgttgcccaggctggagtgcagtggcacaatctcggctcactgcaacctctgcctcscgggttcaagcgattctcctgtctcagcctcccgagtagttgggattaatggtgcctgccaccacacccggctaatttttcgtatttttagtagagaccggttttcaycatgttggccaagctggtctcgaactcctgaactcaggtgatccacccgcctcrgcstcccaaagtgctgggattacaggcatgagccactgagcccggcctyctcctttatcttaattgaaataattcagaaatggaaagtcaaatactgcatgttctcacttataagtaagagttaaataatgtgtacacatgggcattattccatgtaccatggaataacagacattgaagacttgggagggtgggagaggggtgaaggaagagaagttacttaatgggcatagtgtacaccatttgggtgacggacccaccagaaccccagacttcaccactakgcagcatatccagtgagaacagatctgaggcttgccatcaaaattgcacttgtaaggccgggcrctgtggtggctcrcggctgtaatcccagccctttgggaggccgaggtgggcagatcacttgaggtcaggagttcgagaccrgcctggccaacatggtgaagctccatctctactaaaaatacaacaattaactgggtgtagtggcgcacacctgtaatcccagctactagggaggctgaggcgggagaattgcttgagcccaggaggtggaggttgcagtgagccgagatcacatcactgtactctagcctgggtgacagtgagactttgtctcaggaaaaaaaaacaaaaacaaaaaacaaaaaactcgtaccccctaaatttatacaaataaccaaaaaaaaaaaaaaaaaaggaaattgtgtggcctttgaagtccaaaatattaactatctggcctgttacagaaaaagtttgcagacccctggcctagcccgtgagatgtgggttggctgttaaggtggaacattggaattatcttacgatggccaaactgtgcgatgcagagcttatgttgttctaaattaattagtgccaccggttcttccctttcatgggctttcaggaacaagctaagtcccaggaccagggccggcagctaggcaggtgtgaggagcatccttggtgcatgtggtaagaggctgtggccagcaagagaggcaaccctagtcggctgccccagcacaccctggccgctcccaagcccccagatctgtcctcacatccgtgatcgggaagctggaagagtctgatgcggttcctggaggcatgtcccggacacagctgtggggcccagccagcctacaggtgaccagcctaacccagcccctgtgtctgcagagcccacacgtgtntccctgagaacaacggaggcgcggggtgcgtgtgccacctgctcatggatgacgtggtcagtgcggataactatacactggacctgtgggctgggcagcagctgctgtggaagggctccttcaagcccagcgagcatggtgagcagggcggagtgyggcaggggtggctgggtgtgttcccacagctgcctgggytgagggtggggtgrgcaggggaggaggtggggtcatagcaacagcaggaggaagccgcctgtattttcccaaatctgatgggattcctgcccctgcctgggcctcagtcctcccacctttgaaacggagctggtcgcagtagaccaccaagcccccttcagcccagctgtttccacccctgaacttaagtgcccaggaaggcgtattgrgatgaggtgtgcttgctggaaggcatgcctgctgctgattgaaaaccgaactgggaacaktccttccattctdtgtccactsgtcagctgctgcggctttggatggtcttgaccgtggaaggctgaccttcttytggtacccggagtccctgcaggaatcccccttgagcttgctgggctgtggtgacaggagtttaaaacatgcgttgtattccagtgatgcatgatatgacatgcatcacaggaataaaaacctgaggtctcatggatatgattgcttcaaargagaccaagttttaaaacagatgaatcaaaataaagaaaaatactcagtaaatcatcataaagtacagagatgtggccaaaggtgtgaaggatgcagctgtaaaagctgaagtttgaggcygggtgtggtggttcatgcctataatcccagcactttgggaggccgagcccrgcggatcaccggaggtcaggagttcgagaccagcctggacaacrtggtaaaaccccgtctctactaaaaatacaaaaaattagtctggcatggtggcaggcgcctgtaatcccagctacttgggaggctgaggtaggagaatggcttgaacccaggagaaggaggttgcagtgagcttagatcatgctactgccctccagcctgggcgacagagygagattacgtctcaaaaaaataaaaataaataaaaataaaaagattttttaaaaggctgaagtttgggttactttggctcatacactttgccttcactgtagaaaggtggttagtaaagaccaggcgcggtggctcatgcctggaatcccagcactttgggagcccagcgcaggcagatcacttgagccctgggctattgaggctgcagtgagctgggattgtgccactgcactccagcctgggcaacagartgggaccctgtctcaaaaaagaagaaaaaaagggtaattaataaacactaaagttctatgtagaattttagcaacattattgttattataatcttctttgctatggctctgaatctgtgtggtgctccagaagtatgctatggaggttttgtcgaccaaaaatctgggtggtggctgtggtttgtaggccggggctgggctgggtgatgggggagtcactgcatagatcctcacatagaggccgcttctcccrcagtgaaacccagggccccaggaaacctgacagktcacaccaatgtctccgacactctgctgctgacctggagcaacccgtatccccctgacaattacctgtataatcatctcacctatgcagtcaacatttggagtgaaaaygacccggcagatgtgagtgggcatgctttgacgtttttctgtgacctctggggaacagggtgggtgaccagcagaggcccagtccctggagccaggagcctgggaggcaagcyctggggctggatagcaawtcccaggagctagagacctggcttctcacctggctctgcmctaggcaagtccctttgcttcctggccccccrcycctcacatcagagaaggggagttatctctgcatgccgctcctcctctgtaaaggtagrgctgtgggccacrtctgtgtttcccagtttgggggacacaagtgatcgtaggtggcacattgacagctcacttgaataaccctattattgaagagaataatactgactcaagagacagtgacccgtgtcagttcccttttgaggccaacgggttaaggagraagtccccatacagctgactcgtttactaattcctcttaatgaagagagcagaggccacaccccaggcttagactttcccaagaaaacaagatcagtttgttggttgttccccatggaagctggtcctgacattcccttcacagtagtgttggtggagtttttgttgttgtttgttttgagacagagtctcactctgtcacccagggtggaacacagtggcgtgatcttggctcactgcaacctccgcctcctgggttctagcgattctcctgcctcagcctcctgagcagcygggactacaggcacctgccaccgtgcccagctaatttttgtatatttagtagagatggggtttcactgcgttggccaggctggtctcaaactcytgacctcagatgatccactcgcctyggcctcccaaagtgctgggattacaggtgtgagccaccgcacctggccagtggagttccttcttaagtacatgtattgacatctttaaaaagggcragaggatttacaggaaactatcaggtcartaatggcaggggccgtccacagtgggtggctgagtccccctatttttctgctggtgtgcrgggaggtcatttcctgccacccatgtttccccaccctgaatccaccttcctcacattcccattggagggacamtctctggacatatgggacctggggtcccacagggctgcawtccaatgcctgctgtgccactcgccagctgtgtgatgttgggcatatcccataacctctttgtgcctcagtttcctcatctgtaacacaggagtgacaagagcacccgcccacagggctatgacagtacaagktgtgtgatacagatgagctcccctgtttggcccacatgtgtcctaaaagccatgtgccctttctcttgagtgccccaggccacagagatccccatctgcccrctgtcccacacactggtctgtcatttgttccttgaggtttgtgagggccggctctgtgcatcccaggggcccaggctgggcctggttggctctcagggagcaggcacccgccaccttaagctcccatgctggtgtctgtcactgcttcctctcaatctggccaagccaggggtgtcgatttatatctctcaggtctggtttcccctttggcactgggccaggtatggggaaagagcaggaatggggcagttggctcacacagcagaggctcagaaagcrgggggcatggggggaaggagtgcacagatgctagagagtggggcaagttttgtttggtcaataaatctccttctcatgccccaggcctgtgcaagacctacagagagtcccaaggatgggctggggggaagagaaaggtaccaccttcagagtccaaagatatgttatttaatattttcatatttctagatctgccttcaggcatggctggatccagcttctaggaacctgtccagctctgcgccctgctttattctgtactggcttcrtttttaggcaggctcttccctcatgtagtggcagatatgcctactagttgctccaggcctacatcccaaagccacagtgggaaaagggttttttttcttgacggttctaataagagtcctaaggctgctgctcagtggcctggcttcgatgctgtgccagcctctgaaccaatcactggctgtgggtggagagaggrtgctggtggagggccctgcttgtccagggaggagtcacataccygcctctagggctgcaggtgggctcagctccatccaaaccagatgaactgaaaataaggcaggagtggcttccccaggggaaactggggaagaggaagcaggactgtgctggctaaaatgccagccaggtttaagacgtggcaccagatgccagtcatgggattggattggtcagcatgcctgggctatggcttaggggtatgttggtgctcagggatgccacaggcctccagataccaggtctgaggcagaagaatgaagtccagcttctcttgtgggtggaacagtggcaactgagataccccatctctcccttcccaagaacagagctgaacataaagaatttagtgattggccagagcttggccacatgctcccctctgatgaatgataggccaggtgatgggattggcacaattggcttagactaatgagggttggccctggagttgcaggcagtggagttctgtcctaagcagtgggcacctaaacccgatggcataaaagctgggcgggtgtccacctgcatctgccacagcactryaggcaccaactgtggctcatactgagtgggataaattccagaaagaaacattaggaacttactatagaattttggggctagagctactcattcattcccctagataatttctaggcaaggttccatagtggagggggagttttggcttgggcattgaaggatgcataggagttttctagatggggaaagaagggaacggtagaccaggcagagggaactgcatgatawaaggtttatgggtgtgaaaattcatggaatgtttgaggattatggggttgggggatgtgggaatatgtgtagcgawaaagcaccaaacaaagccaaaagtttagttagagccctgaatgcctgcctcataatggtttccatattttatatgcctactatgtgccaggcacattgctcagggtcacacagctggaartggcagggctgagtttttgttgttgttgttgttgttgagacagagtctcactctatcacccaggctggaatgcaggggcgtgatcatggctcactgcatccttgacttcctgggmtcaggtgattctcccacctctgcctcccaggtagctgggactacaggcacaggccaccacgccaggctaattttttgtatttttagtagcgacagggtctcgccatgttgtccgggctggtctggatctcctggcttcaagtgatmcccctggctcagcctcccaaggtrctgggattacaggcttgagccaccrcatccagcccagatctgagatttgcacccagtatttgaactcccaagcctgtgctctttttcctcccatggacatttctctcagagatggtctcccaaacacctgtccttcttgttaaaaaacagacaaaccgcaagtagttctttggaagctcagatttctcttttgtttcttagtaaaacatttcccagttcccagctcccttccagggtgtragatttcttcggtaacttacatctagctgttgcttcttgtttgctcatgtttagaaagaaagacaaaagagagtgagaattttctctcccttccccagtctccccacaactcacaccccaccctcagctccctctgtaataggaaaatctctgaactctctgtagttgctccagcaatcttttggaactttgcttctttcttgtgaaaaaacctcyccttggctcactttgcaccaggtttccccaaatgtgcttccaaccacaagcagaaatggagctgccagtaaccaggaagaaactgccgggggctgaggaagaggagagggaggtgcatagccctggatctcgcagggagaggggtgacaggatgagaactcaggttgctcacttgccatcagggtcagtcatgaatatagcgttcatgtatcactttttaaagcttttttggagggtaaaagtaatagttacacaaaataaaaatacaaatggtacaaaaggacttagaatggaaacatgtttctctcccgactccagcctcctgtttttcttcccagagactgaccactgctgtctgtctcttgccagaagggaaagggaggcaaggttagggcaggcagagggcatgtgcatcctttagagagagcttatgtctatacaagcaaatgtgtgtgttcagtcatcgctgtcttagttttctattgctgcataataatggtactaccagcttcacagctttaaacaacacccatttattatctcatagtttctgtggttgggagtctggacatagcttagccaggttctctgctttagagtctcgtgaggctataatcaaggtgtgggatggggctgcagtttcatctgaggctcarttggggaagggtcacttctaagctcatacaatattggtgacattcagtccctggcaggctgttgaactgagagcctcagtttcstgctggctgttggttgtagttaaccctgaattccttcccatgtgccctttgcaaagccatcaaggcagagagacttgcctagcaagtaggatattacagtcttctgtaatataatcacatccatgaaatcctctatatatcccatcacctttaccatattctgtgggttagaaacaagtagcaggtcctgcccacactcgagaagaccagatgacacaaagatgtgattcaaagtggggatcatcggggccatcttaggtttgtctgcagtgatcactgtgccatctctctctctctcttttttttttttttttttygagacgaagtcgtcactctgtcacccaggctggagtgcagtggcatgatctcagcttaccacaatctctgcctcccaggttcaaatgattcttctgcctcagcctcctgagtagctgggattacaggtgcccgccaccacacccagctaatttttgtatttttagtagagacagagtttcaccatgttrgccagrctggtcttgaactcctcacctcaagtgatccacccacttcggcctcccaaagtgctgggattacaggcatgagccaccatgcccagccccatctctctttaaaaaacaaacaaacaaacaaaaaacataaaaagaagcagagaacacatacacatctgcatcttcccttgtttacttaacaayagatcttggaagtcacttctcagtagaggctaggytgggcagagcattggattctaggccagtgagtttggacttgaccatggagacactaggaagcccatgaaggacagagagagatgcctcgaccctgccagtcctttagaaagatcacccagtgctttttrtataccaaaccctatttgaaatacttacgtatattaacccatttccttatcaccacaaccctgcgggaagggagataggcacttttattatcttcattttgcagatgasgacattgaggtccagagaggttatgtcacttacttaaggtcacacagccaggaagtggtagtagggactcttacccttgttttacagatgagattgaattatctcacraaaactcagaaaggttaaacaacttgcctaagtaacatacagctaattagtcgaggagcctgacgcatgttgctstagcctggtcacagttacagaggtggcaagcaatggcctgaacaggaygaacaaccaaatacccaggctggtggctcttaaacatggtggggtcagctaacgacagcaaccagggtgggcactggtgcccctcgcccccggctggtgccctaacatctcccttttctctaccagttcagaatctataacgtgacctacctagaaccctccctccgcatcgcagccagcaccctgaagtctgggatttcctacagggcacgggtgagggcctgggctcagtgctataacaccacctggagtgagtggagccccagcaccaagtggcacaactgtgagtatcaagaggcctaagcaatggtaatctccactctccattcttcccctgtggccagacacttcccctggctgagtctctgggcttttatatcataggatgcctctaatggcaatcctgccattagatacacctgcygtggtgtatctgccaggtaggcaggctaggctgcagtaacamacaagcccacaatttccatggcttaacactatrggaatatatttcttgctcaygtaacaagctaacgtgaatgttgctggtttgtaggtggtttccctccctgtagaaatctggggagtgaggttctttccatcttgtggtgccrtcattctccmggacaaagattcttacctacttttgtgtcctggtttcctttggcagcctggtgaagcctatggacctcatttcagaatatttwtaaatacataaaatcccagcctgggcaatatagwgaaacccccatctgtacaaaaattagccaggcatggtggcatgcacctgtagtcccaggtactgggaaggctgaggtgggaggatcacttgagcccaggrgtttgaggctgcagtgagccgtgatcgtaccactttactcccacctgggtgacagagcaagagcccatctctaaaaataaataaatacaatgaaataaaataaaataaatagaactacagaggaaactaattgtattgaaatgcagttataaaacatttaaacacatttttaatctagagatatatgtgcttctttattaagatctataaataataagttctaggggtagctcrcataaatactgtaatttcaaagtagataagcataaataatactttatgatactgaaattgtgatgtgatatgagaatagctgtgagttttgttttgctggggacaggatcastgatgctgtcattactggggtctcttccctccattctttttttaaaattgtattttattttatttttaaaattttaaaataaatagagacagggtatcactatgttgcccaggctgcttttgacctcctgggctccagtgatcttcccatcttggcttyccaaagtgctgggattacaagtgggagccagtgttcctggycccttcctccattcttaatggaaggagatgctaggtgtgagaggttagggaaagtaaagatgtaatttctttcccatccaagttctcagacccctgaattctacctgcagccatgttggtccatcaaccccaagtgaagaatccctgctctagggccccaccattgtctgtatccagccagcagaagaggcgtgattatggagatcacatctgcttcttgaaagcagacagcccggaagtgggccgcatcacttcctctcaaattctattggtgaaaatggtcacatgactacacatagccacaaaggaggctgggaactttctcacttggaacstacatcccagaaacractcttttcagtgaggtatcccacaggtctttcgcagtagaaatattgattatctcacataaaatgaagtcttacaaatggacctactgggttttgtacagcagccaagtgatatctcttcccttctgctgtcttcccttctgccrtccttcacatggtggcattgtatccttagacttgccacccatgccctcaggttggccrttgcacaytrtcttacataaagcaggaaggaaaggaaaggctgctacgagagagtgtaccttgtgcatctcttttttaatcaggaagcaaacatctttctagaagcttccctagcaaaattccccttacatctcattggccaagactgttacatrttacatggttactgttattacttgctcattgcaaggaagactgggaactcaaatgcctggaaaaaggaacaggataatcgtgattggctcaagccttagggtgggcatggctccctgacaagggagagaggaaaaagctgttgagtgaagaagactgcttcagtttccccatctgtataatgggaggagtaagggctgtcgtraaaactcaatgaaagaagattcttcaacgtggtaggtgcagtggcagctggcagtaccctgaccctgccaccgcacagccctctcagcattgctcrtcctgcactgtggatatcarttgagccacgtgtctcctgccctgggctgtgagctccataggcagggtctccatggctgtatctccagaacccagcacagaaccaggtgcttgggaaagttttgaattgattctcatctgccattggcatggggaagggaactagcttgyatgaaacagataacaatgtatgggaccctcattcattatttcagcaaatatttgctgagttcctcctacatggctagccctgtgctagacactggggaatcrgcgatgaacaaagcagatagaaatccccactcttgtggagctgacattctggagggagagacaaaaagcaaacatataaagaaagaaagaaatcacatggrtctggatgacagtgagtgctgggaagaaaataaaagcagaggaaggggatggagcgatgggcrgggggcaacggtagggagggtgtcggggaaaactttttggagaatgtgacgatgaaagtgaacaaggagaagtcaaccgtgttgagatgatggcagctaatgatgtggacaggccactctgttctgagtgcattatctattgattcatcatgtcatcctcgcaacagccctgcacgatcaattctgtcattaaccccatagtacagatgaggatgcggaggcacagagaagataagggacttgtcctgtgtcacacagcaaggagccatccggctcctaagttggtgcatttgacttctgtgcttcyggaaagaaagagcagcaagtttaagatctggaggtggcactgagctttggaggagcagggggcaatgaggtggccggtgtgacgaggactcaatgtgcaagagggagagtggyggggagatgaggtggaggggtggtcggcggtcagatcgtggagggtctcggacgagggtcctgaccctgggtctccagtcctgggaagtggagcccaggctgtaccatggckgacctcagctcatggcttcccctcccacttccagcctacagggagcccttcgagcagcacctcctgctgggcgtcagcgtttcctgcattgtcatcctggccgtctgcctgttgtgctatgtcagcatcacsaagtgagtcctgggcccagtgctgccgagcagtccctctggagtgcagggtggcagggacttgcccctctagtctgcccctttgcagtcctctcagtcaataatacgyatttactgagcagctactacacaccttgagagtagagctgagaacatatcgacaaggaccccacttttttctttttttyttttttttttttttttgagacggagtctcactctgtcacccaggctggagtatagtggcacaatcttgcctaacagtaacctccgcctcccgggttcaagcaattcttctgcytcagcctccagagtagctgggattacaggcgcatgccactatgccyrgctaattttttgtatttttggtagagatggggtttcaccatgttggtcaggctggtctcgaactcctgacctcatgatctgcctgcctcagcctcccaaagtgctgggattacaggtgtgagccactgcacccaaccaggactccacatttctaaaaccgscatcctactggggagactgaaaatacatatcaatcacaaacaggtggttttccatagtgacccactctctgaatgcactagaccagggtgsaggccagagatsttctggggtgctttttgcaaggggsaccaggataaggctctccaaggagggaaaatttgaggggggccytgactggggagaatgagctggccagggataagcaagatggagtcatcccacatccccttacaacrctgggtgcctgggcaactgggggcatytgggggcatgtggtaggagccagaggaatttgcgacgattgccctgatggagtcaggagacctgggtttgaatcctggccttggagcttggtagctggyggccgacaagttgctgaaacccctgagcctggggttcctgctttgcagagtgacagtgatggtgagaacatatttcatcagccagaagaggccaaatcacagtaaaggctgagggaggagatgagtggcgagtggctgggaggtggtggaaggagcctcgtttccagagagctcttgccagcccttggaatcatggtgtctcagagcctcagtcctcccatctctgaaatgggactagcaagctcaacctcactaagtcaggattagaggtggctaaggattattaacatgattgatgaaagtgcccactcttggcccagcacacactaggtaggcagggaatgcaaattcccctccatatcttgtcactgatgcctccgagcaaccttggactgatcgccttgctctgagcctcagtttccccatcacctgtacctcttcccactccccatcactatatcccagcatgccagcctctttgctgttctttgtctttggtttcttgttttgttctgttttttagacagggtctcactctgttagccaggctgaagtgcagtggcgcggttacggctcactgcagcctccaattcctgggctaaagagatcctcccatttcaacttccagagcagctgggacaacaggygcttgccaccacacctggctaattttcttattttaatttaatttwattttattttttgggacagagtggagtctcaaaaaccaagctrgagtgcagtggtgcgatctcgactcactgcaatctctgcctcccgggttcaagcgattctcctgccttagcctcccgactagctgggattacaggcgtgtgccacgacacccagctaatttttgtatttttagtagagatggggtttcaccatgttggccaggatggtcttgaactcctgacctcaagtgatccacccacctcgttctcccaaggtgctgggtacaggcatgagccactgtgcctggccaattttcttacattttgtagagactggctgtcacttatgtagcccaggctgatcttgaacttctacccctttatctttattcatggcacttattaccatgaatgaatgacctcatataagcatttctttcgtttttttttttttttctttgagatggagtctcatgttgtcccccaggctggagtgcagtggcgcgatctcagctcactgcaacctccgccttccgggttcaagcgattctcctgcctcagcctcctgagtagctgggattgcaggcgcctgccaccatgcctggctaagttttgcatttttagtagagacggtgtttcaccatattggccaggctggtctcgaacttctgacctcaggtgatacacctgccttggcctcccaaagtgctgggattacargcrtgagccrccatgcctggcctcatataagcatttctgtctccatttatcatccatctttccctcttgaaggtcagtttcaccaaggcaggcatctttgtctcgttcactgttgtrgcctcagggccaggcacagtgagtcaaacatagaaggtgctcaataaatatgtgtttatttattgaaaccatgggcagaggctaattcagaagcggtctgaggaccttacctcccagtgatgatgcaccrtggccccaggcaggccaggaagagagaagggttgtgtttctccgtaggtcccccagcttcccaggccatcccaggccattccctggtcatttgccctcagctgctctgaaaaagggattgttgaggggaacctagaatcctctctctgcagtttgagtctttcctaatcccctggggtctcattcccactgaggacataggtggcctcctcaggaactctgtgctgggtaacagaatgcgggagtgtgaacctggctctgccacctaccagctgtcactccacctccttgggcctcactctcctcatctgtagaatagggttagcaatagaatccatgtcaccaggttagaatgatgagtcagtggtttgacctccagaaactaatcagcctgatctctgatgccaaataagtattggtgataacgaccacttttatgggaggagcgttcacctgtcaataattcagagatcaacaccttttccttttgtttttcaggattaagaaagaatggtgggatcagattcccaacccagcccgcagccgcctsgtggctataataatccaggatgctcaggtaggagtaggcgtggatgaggacatgtgggactgtgtacatgaagaagtgtggttcagaacacctgggctgttaaggaccttcactggcttctggaatggcaaatagacagtcaggagggttgcaggggagacagagrcagaagccgaatgaggtcattagcagaccagaggctttcccgcccttccccttggcaatcccagcctggggtgggcttctctggggttggtttcctgtttttttccctccccttgggagaatgacccttgggtcatcatcactgtgtcattccctggggaggtgccagtaccagggctagaggccagaaggagtggaggaaggagagggtgacaggctttctgtgtcttcttcttaagcataggaaactgcccccgaagcactagcaaatcccttccgggttctcattggcctgaaatgtatcccacccctaagccaggggtggagtcagcttccccaaggcgatggtcctgtgggtgagtgggtggggtttgcctgagcaagatgagagttctctaggtaggagaaagggggattataggtcctgtctagaagagaaggtctgagggtccttgcttttccagggactctggaatctagtggtgttggctttgaatcctgactctgccactcactggcagtgtggacttgagcaagttgcttaattctctgagcctcagtttcctcttgtgggttataacagtgtttacctggtaggacagatattggaatttattgagacaatacatataaagtgcatattccagcctcttgcaaataccaagtgccatttatgtatcagttagtgtttgctgtgtaacaaaygaccccgaaatgtagagggttacaacaactttatttagcttatgcttctgcaggctggcatttggggctgggctcagcagtgagggtggygggggaggctgggctgggctgggctgggcagatctgaattgagctgacccgtccccgtagcctccctccgtgtctgacagttggctttttttttttttttctttttctgagacggagttttgctcttattgcccaggagtgcaatggcrtgatcttggctcactgcaacctstgcytcctgggttcaagcaattttcttgcctcagcctcccaagtagctgggattacaggcatgtgccaccacgccaggctaattttgtatttttaatagagatggggtttcttcatgtyggtcaggctggtctggaactcctaatatcagrtgatccacccayytcagcctcccaaagtgctgggattacaggcgtgagccactgcacccagcctagttggctgacttttacctgggacagtgcaggtgcctgagccatgtgcctctcactctccagcaggccggcccaggcttgtttacagagtggctcagttttcaagggtgggaagtcccaaggcttcttgaggcctaggcgcagcactggcatgatatcacttccatcacattctatgggcccaagcaagtcccagggccagtgtagattcaagggatgggaggagattcagagcactcctctgtggccacttttgccatcgaccacagtccctgtaaatattaggacaatgtaattaattcccaggaatctgargctcagaaagcgtaagtgacctgttggacttctgatctgtgtgatgtcgaggcttgtaccccttcctgagcattgccgtactccaggccgggctgcaaggccactctgctctttcattggctgtctctgtattttaggggtcacagtgggagaagcggtcccgaggccaggaaccagccaagtgcccgtatgtatctgaacttaggtcacagcctgcatgcattgggaaggtgatagaattggagaggcaagcccctagctccatgtctgccttctcttccctgcattcggtaattgccctgtgacattagccttcaagggacggcaggaggaggggtgttctggaaacgtggactgctggccaagmcccctgagtttcactggtgtgtcaggtacatggtgataccccttgggagtgctgttatagttaacaaccagagcagccktgcctgttgttaaaatcttgacctaattgtatacttgtcggcaaatagccactatcctgaacactcccctccttttttttaatatacaggatctcactctgtggcccaggctggtgtgcagtggtgcratcatagctcactgcaccttcaaactcctgagctcaagtgatcctcccatcttagcctcccgagtagctgatactacagatgtgcattaccacgcctggctattttaaaaggtttttgcctgtaatdccagctactcaggaggctgaggcatgagaatcacttgaacccgggaggcagaggttgcagtgagcgcagattgtgccactgcactccagcctgggcgacagagtgagactcttgtctcaaaaaaaataataccaaaaaaagtttttgtaaagacaagctctcgctgtgttgccccgccactgtggcctccttagcttcttccctggggcctgctggacctttccatactccagaaactaaagggggtccaggaccctgcttcaaccctaggatcccgcatcttttttttttttttttttttttggacgcagggtcttgctgtgtccctcaggctggagtgcagtgattcactgcagcctcaaactcgtgggctcaagtgattctctagcctcagccttctaagtagctgggactacagtcatacaccaacatgcccagctaattttccttttttttaattcttgtagagatgtttgagacrgcttgggctctgttgcccaggctgttctcaaactcctgagctcaagcratcctccctcctcagcctcctaaagtgctgggattacaggcgtgagccaccgcacccggcttccatatcctttctaattggtcatgrcttgggataatggtgttgcttttaattatcatcatccataaagactttttcttactcaacagayctgagcttgtatttggtgcccaggacatgtgctgggttcccgaaatcccaaagacacagaccctaccctcagggatttctcattctagcaacatagactgatcaattactgattataacgttagaaggcatgtctgmagtagacagccatcaggacatggtgatttcaggctgggctttgaagaatgaataggagtttttcaagtgtcgaaactgaaccctgaccaamctttgcttttgcagacactggaagaattgtcttaccaagctcttgccctgtttyctggagcacaacatgaaaagggatgaagatcctcacaaggctgccaaagagatgcctttccagggctctggaaaatcagcatggtgcccagtggagatcagcaagacagtcctctggccagagagcatcagcgtggtgcgatgtgtggagttgtttgaggccccggtggagtgtgaggaggaggaggaggtagaggaagaaaaagggagcttctgtgcatcgcctgagagcagcagggatgacttccaggagggaagggmgggcattgtggcccggctaacagagagcctgttcctggacctkctyggagaggagaatgggggcttttgccagcaggacatgggggagtcaygyctyctyccaccttygggaagtacgagtgctcacatgccctgggatgagttcccaagtgcagggcccaaggaggcacctccctggggcaaggagcagcctctccacctggagccaagtcctcctgccagcccgacccagagtccagacaacctgacttgcacagagacgcccctcgtcatcgcaggcaaccctgcttaccgcagcttcagcaacyccctgagccagtcaccgtgtcccagagagctgggtccagacccactgctggccagacacctggaggaagtagaacccgagatgccctgtgtcccccagctctctgagccaaccactgtgccccaacctgagccagaaacctgggagcagatcctccgccgaaatgtcctccagcatggggcagctgcagcccccgtctcggcccccaccagtggctatcrggagtttrtacatgcggtggagcagggtggcacccaggccagtgcggtggtgggcttgggtcccccaggagaggctggttacaaggccttctcaagcctgcttgccagcagtgctgtgtccccagagaaatgtgggtttggggctagcagtggggaagaggggtataagcctttccaagacctcattcctggctgccctggggaccctgccccagtccctgtccccttgttcacctttggactggacagggagccacctcgcagtccgcagagctcacatctcccaagcagctccycagagcacctgggtctggagccgggggaaaaggtagaggacatgccaaagcccccacttccccaggagcaggccacagacccccttgtggacagcctgggcagtggcattgtctactcagcccttacctgccacctgtgcggccacctgaaacagtgtcatggccaggaggatggtggccagacccctgtcatggccagtccttgctgtggctgctgctgtggagacaggkcctcgccccctacaacccccctgagggccccagacccctctccaggtggggttccactggaggccagtctgtgtccggcctccctggcaccctcgggcatcycagagaagagtaaatcctcatcatccttccatcctgccccyggcaatgctcagagctcaagccagacccccaaaatcgtgaactttgtctccgtgggacccacatacatgagggtctcttaggtgcaygycctcttgttgctgagtctgcagatgaggactagggcttatycatgcctgggaaatgccacctcctggaaggcagccaggstggcagatttccaaaagacttgaagaaccatggtatgaaggtgattggccccactgacgttggcctaacactgggctgcagagactggaccccgcccagcattgggctgggctcgccacatcccatgagagtagagggcactgggtcgccgtgccccacggcaggcccctgcaggaaaactgargcccttgggmacctcgacttgtgaacgagttgttggctgctccctccacagcttctgcagcagactgtccctgttgtaactgcccaaggcatgttttgcccaccagatcatggcccacrtggaggcccacctgcctctgtctcactgaactagaagccgagcctagaaactaacacagccatcaagggaatgacttgggcggccttgggaaatcgatgagaaattgaacttcagggagggtggtcattgcctagaggtgctcattcatttaacagagcttccttaggttgatgctggaggcagaatcccggctgtcaaggggtgttcagttaaggggagcaacagaggacatgaaaaattgctrtgactaaagcagggacaatttgctgccaaacacccatgcccagctgtatggctgggggctcctcgtatgcatgsaacccccagaataaatatgctcagccaycctgtgggccgggcaatccagacagcaggcataaggcaccagttaccctgcatgttggcccagacctcaggtgctagggaaggcgggaaccttgggttgagtaatgctcgtctgtgtgttttagtttcatcacctgttatctgtgtttgctgaggagagtggaacagaaggggtggagttttgtataaataaagtttctttgtctctttattttttatgtattaaccaaacatacctccagacactgctgtgagtgctgtgtctctgttaactcctggaattcacccatccagaggaaccaggatgcaagaggttaagaaacttgccgtctgggtttgggttccccatacaaggattcaaatagttgatttaggaagtaatcccgggaaaccctgctaaggtagtggggaactgaggcagggaaggacacaaaccaagaaagtgttacctgaaaggggtccagatgcagaccccaaaagagggttcttgaatctcatgcaagaaagaattcagagcgagtccatagagtcagtgaaagcaagttaatgaggaaagtaaaggaataaaagaatggctactccgtagacagagcagccctgagggttgctggctgcctatttttatggttattgattaattatattccaaacaaggggtggattattatgcctcccttttagaccatatagggtaacttcctgatgttgccatggcatttgtaaactgtcatggcgctgttgggagtgtagcagtgaggacaaccagaggtcactcttgttgccatcttggttttggtgggttagagccatcttctttactgcaacctgttttatcagcaaggtctttatgacttgtatcggtgacgacctcctgtctcattctatgactaagaatgccctaacctcccaggaatgcagcccagtaagtctcagcctcattttacccagcccctcttcaaagctccagtttaaataaacctctgacaaaagggtgagttattcaacagattaccagcatgagtaactgatgcttacctgccggggatctctggaagaccatgcatggcacatgcccagttatgcctgcaaaggagagggagctggggtatttgtccaccagctcccatctgtcattggctgagagctgcttccaggagcattaattctccagcacttccagctactccaggaaaaaaaaaattcttcaactgagagttggaggtgttgagagactctggcacaccaagaagacaggaacaggacaccaacagtggctgatgatacactgccaaggtcacacagctagttagcaacagatctatagtggaatccagacagtgtctccatcacccaggctctctgtagtgatctgcgcttcacatccgaggcaggcagagggatggtgtgggccttagatgggaaggctgggaacctgaagctcctatgtctgtatcacttttgcttctctgagtagctgccctgatttcacacttgaggggcttggccattttagattccttcctgctctaggagcctacatactacactggaaatgatggggagctctctacctcacatgcagcctgatgtttgttagaaacacctccttgcgccaggcatgatggctcatggctgtaatcccagcaatttgggaggctgaggcgggtgtatcacttgaggtgaggagttcaagaccagcctggccaatatggtgaaaccctatctctaccaaaaaataaaaaattagccgggtgtggtggtgggtgcctgtaatctcagctacttgggaggctgagttggtagaattgcttcaacctgggacgcggaggttgcagtgagctgagattgtgccattgcactccagcttggatgacagagtgagaccctgtctcaggaaaaaaaaaaaaaaacaaaaaaaaccttgttctaagccaaaatcaatccctttagctgcccaaatcacacagtttacagatggagaaacagttttagagaggaaaagggacttgcccaaagtcacccagagaatggcagagcctgaactagccttctggacttcttgcctccaaaagctctttataataaaatataattttaaataaaaatagttatctgtttagggccaagcaatatgctaagtgccgtccagccactgtgtcatttacgtctccaaacagctctagttgggaggctcaatgattatcccaattttacagataaggaaacaggtccagagaggttgaggattagcctagaaccacacagctaggaaatcctggagycaggatttgaacccgggtctgacctaagagctcccagccgccgtgatatatcagcttatgtcatcctgacacctacgcrgatgtcggctcgaatccactttgcctgagcattgtctcagagaaatctaatttaaaaattaggcagcaaatagaaaatatatttgactgctagagatgcaatgggactgggagcccaacaaaggatcttaggcaaaagaaatccaagttgttggcctcagcaactattactgaactggctgggctttgggaagctacagagggatgagaagacctggtggatcaggtgggcccaactcaggctggcccccaccctgcaggaagtaggaaaagtccagggtcataggcccagtgagatgccggctgcgggagtttcagcctccggggctggaccagagggcaggaggggacgcccctgggtagcagcgccagagtgggctgagtggcctgggcccctgcgggggagctttcagagatgttgatttgggggtactccctcagccctgcctttacacagaatttgtgggggatgaggggagggggaaaggggggaggaaggcagtgagtgcatctgaattttttttttttttttacaaaaagtggcttattgcatttttctgattactctatcagcacgtgcagaccttttcctattcagagaaagcctgaagatataaagaggaaagtgaagaaaaaccaccggaaatcccatccccgccccagcatctggcactgtgtgggcgatcacgaaatgagcgcttgtttttgaaggcgtagtatctccgtgaacatccggttgaacaacctttctgactttatttttcccacgaaagttattaattaaaaaacaaaaagcaaaacaccgaaaaaacaaaaaacccagcaagtgtttgagctcccaccacgagggaggcctgacgtcactggatcctcccggcagccgatgaggctgcatgggacttgcccacgatgtgctgttaccgagtggcatagccaggcttcaaaccagagtcctagctaaccgccctgtatataccatgggctcatcatcttccctggttccagctcagaacagagactcagaggaacaagggctctgcgctcaccctgcctggttaggtccagcctttccaattccaagctgtgtgaccatgggaaaagtgtttgcccactctgggcctaaatttcctccttggtaaaaggcacacaagagcagtactctgcacgccacagtggtggggtgagcagcagatgacgtggtgggtggaggccaggtgacaccaggctgctctcaagcttaacttgcctgtgatggtggcgggaccgtgtcagttcttccaccaaatcccacctgtttccacgacgtttattgacaagtcaggggcaccgccccgggtggagggggtgtgaagaggaagtcagctccctggtccctgctgccctctggtgaccacatcagcatcagcacctgctccatcccagcagctccaggtccaggccgtgcccagaaaacttggcctgggagattccccacccgccctgccccgatcccacctctcttccatctctgcattttccagaaattcccccagcaccagacaaaagagcctaatgtccattagatatgctgtgtggcgccaggccagcgtgtaacctctctgtgcttgattcgttatctgtaaaatgggaatcattataatatctgcctcatgtagctattgtgagaattaaatatgttagtacctgtgaggtccttagaactatgcctgcggctgggcacagtggctcacgcctgtaatcccagcactatgggaggccaaggtgggcagattgcctgaggtaggcgtttgagaccagcctggccaacatggtgaaaccctgtctctattaaaaatacaaaaatcagccagacatggtggcgggtgcctgtaatcccagctactcgggaggatgaggcaggagaattgcctgaacccaggaggcagaggttgcagcaagcggagattgtgccactgcactccagcctgggcaacaagtgggactctgtctcaaaaaaaaagaactatgcctgcaaatagttaatgccttaaaagtatttgctaacattcttcttcttcttcttttttttttttttttgagacagggtctttctctgtcacccaggctggagcgcagtggcccaatcccggctcactgcagccttgaacacctgggctcatgtgattctcccacttcagcctctcaagtagctgtgaccacaggtgcacacaccactaagcctggctaatttgttttttaattttttgtagagacagggaatcactatgttgcctaggctagtcccagactcctagggttcaagcaatccatccacctcggcctcccaaagtgctaggattacagatgtgagccaccatgcctagtctgctaacattatccttaatattacactgaatatgtctgtggattttgtgggaggtgagggtataaaacataattagaggaaataatgacattctaaatttaatttgactttattacaaaaagggcagaatggagcaacagtaatccaggacaaaaaattgtcccaatcccatcattcaacccacttgtgtttgtatctgtttgtgccacttctgtgtgttgtttacatgcagagtcagtgtttgcgtatttgcggttttatatcattcatttctcatcatacatacatatatttatattcctgacatttttctagggaatatctttatattcctgacatttttctctttttcccttatgttcttccataccgggacttataggaccttgcccagactcaacttccctcttccccatggacccaagttgctgagcttccaacaggtgtttacagcaaaggagaatgagacagagagaagcagagatgcagagagaaagacagacagagaagactaaactgattgatcccaactccattatgatatctgactccaaccacagaatgaccctgatccagccacagactgacttctgatcctggccacagtccacctcctgtcctcagccacagaacagctctgactcaagccaggaactgagtcccgacccatgttactgacttactcatgatcctggttgcaggctggccccagccacatgctgacccctgaccctcaccacagatggatctttgatcccagctataggctgatctctgattctggctgccctgaaccaccactcctatatactgatgacccaccttagcgtgatcccacccaggaactggcatttcctgggacaggctcttggccacctgctgctctgccctgggcacaccaggccctacgcatcctcccccttccaccaccatccatgatttcctgatttctagcagcaaatttagcttgagttggtcaacatagctgggctgcctgaccttcctctctgccatggaaccacagagcaagtcagcagttctccttcctaatcaaaaagcagcatggaggagaaggctcctttgccaccttcctttctgctttggatggtgcttttgcaatcatgaggagacaagcctggagatgaaaggaggcattctgaatatggtggagtggaagaagaagaaggcctgcctggggctttgattacatcaccaagtgatcaaaccaaccttaaattcttaaataaactgtaagtgtgcttttctttaaaccactgtgagttttcttttgcagtcataaagcaaccttaaaaattgtagtaggtacaataatgaaccccccaagatgtccatgtcccaatccctggaacctgtgaacatgttacattacatggcaagggggggattaaggttacagatggaagcagggttgctaatcaactgaacctgagatgtagagggagattatccttaattatccagacaggcccaatataatcccaaggatcttca

SEQ ID NO: 12252 - DNA, 56510 bp, Homo sapiens
ggtggctcgtgcctgtactcccagcattttgggagggtgaggtgggtggattgcttgaggtcaggagtttgagactagcctggccaacacagtgaaaccctgtctactaaaaatacaaaaaatagcctggtgtcatggcacaaacctgtaatcacagctactcaggaggctgaggcaagagaatcaattgaactcgggaggcagaggttgcagtgagcagagatggcaccattgcactccagcctgcgcaacacagcaagactctgtctcaaaaaattaaaaaaaaaaaaagaaaaagaacatgcagattttccttcagtgtcgggcatggcggtgggactggagactgcatttcttttcttttttttgagacagagtctcactctgtcacccaggctggaatgcagtggcacaatcttggctcactgcaacctctgccttccaggttcaagtgagtctcctacctcagcctctggagtagctgggactacaggtgcccgccaccacacctggctaattttttgtatttttagtagagatggggtttcaccgtgttagccaggatggtctcgatctcctgacctcgtgatccacctgcttcggcttcccaaagtgctgagattacaggcgtgagtcactgcgccgagcctggagactgcatttcttaccagctctgaggtgatggatgatacttgcttctgctgctgatgtccctgttccagagaccacacctttaatggcaagggtgaggggattctggaatccgaatacctgagtctaaatcctagctctaccccataacaactgcatgaccctgggcaaaatacttaacctctgagagcctcagtttctgaatctgagaaagggggaaataataggacttagcgaattgtgagaatcacataagataaggtatagaaagcacttagcacgatgcctggcacatagtaggaactgtacactaagattaataagcagattgggcctcgtgcggtggctcatggctgtaatcccagcactatgggaggccaaggtgggtggatcacctgaggtcaggagtttgagaccagcctggccaacatggtgaaaccccatctctactaaaagtacaaaaatttgccaggtgtggtagtggttgcctgtaatcacagctactctggaggctgaggcaagataatcgcttgagcttgggaggtggaggttgcagtgagccaagattgtgccactgcactccagcctgggagacagagtgagactccatctcaaaaaaaaaaaaaaaaaaagagcagattgggcctggtgaagtggctcacacctgtaatctcagcactttgggaagccaaggaggcaggatcactcgaggccaagaattcaagtccagcctgggtaatataggaacaccccatctcttaaaaaaaaacaaatttagccaggtgtgatggtgcatacctgtagtcccagccactccagaggttgagatgggaggattggcatgagcccaggagtttaaggttgcagtgagctatggctgtgccattatactccagcctgggtgacacagtgagacattctctctaaaataaaaaataaagcagattgaagaaagcgggcttctagtagaaacagagacaggaaaaaaggcagaaagtaacttccagatcaagaactgagctggcctctgggcatggctgtctcttctactgcttttttgttcaaccacctcatgtgttagcccacatggaaaatgcttctgctttgtaatctgcactttttatggggcttgttcagatggtgctggtataaaggctgaaacccacattgctggtgggaactacctatggggtttccttgaatttggtgccaccgcacctgctcagcgaccgtgccttgatgtgctttagatcagccatccctaaattgctatcctgtcgcttcagtccaagcagaaagaagcgagtaatgagtccatcctgatgaacaattcagggaggaacattcttttcttcccctggtgagacttcattgactacccaggcaagaagcagcaggagctctgaattaccgtgatcttgttagcagctatggcttgccattggtggagcaggtacatcttgtgctgaaggatgctggtagggcagaacactcatgaaaggctactggcctgattttttttttttttttttttttttttttttgccaattcaagagaattgtctgtacaactcttagtcttagtcttatttctcctggacattcaagactctaatagtaggctaactcattttttatttgtaactaactatcaaagcctggtataactcagtgagaaaaaaaaaatcctggttagaaatgttgcaaacaaacaaaaaaaatcttctctaatatgtgaccaatcccacagtagccacaatggcttagaaggcatttgaagtctcttctacagcagtctcatggggccttttttattgtatcagaaggatgaaagatgggtcagctcctccaggattcttatcttttatttcaggagtcttcagttaaacctgagcttcagaccttttccatgtaattggatccaagtcaggacctcagtctctgtttcccacctttgagtttaggagagcaagctctagggctgcatgaaacaagaggtccttttaccaataaaaaagagaggccaggtgcagtggctcatgcctgtaatcccagcactttgggaagctgaggagggcagaccacctgaggtcaggagttcgagaccagcccggccagcatggcaaaaatcccatctctactaaaaatacaaaaagtggctaggtgtggtggcacacgcctgtagatctagctactcaggaggctgaggcaggagaatctcttgaacctgggaggtggaggttgcagtgagccgagatcactgccactgcactccagcctgggcgacacagcaaaactccatcacaaaacaaaacaaaaaacacacacacacaataaagatgggacaaaaagaagtgtcttggtctgttcctgctgctataacacaaataccttgaataggttcatttataaacagcaggaattcatttttcacagttctggaggctgggaagttcaagatcaaggcacctgcagattcagtgtctggtgacggctggtctctgattccaacatggagtcttgtcactgaatcctcacgtggcagaaggcatgaattcttactacatcctttcatggcagaaaggctaatactggctgaactttcttcctcaaacccttttataagggcattcatcacttcataaaggtcctgcctcttaatactgttgaattggggattaagttttgacatgccttttttttttttttttttgagacagatcctcactctgtcacccaggcttgagtgcagaggcgcgatctctgctctctgcaacttctacctcccaggttcaagtgattctcctgcttcagccacccgagtagctgggattacaggcaactgccagctaatttttttgtatttttagtagagatggggtttcaccatgttggccaggctggtctagaactcctgacctcaggtgatccacctgcctcagcctcctaaagtgctgggattacaggcgtgaacaactgcgcctgacctatgcctttttttttttttttttgagacagagccttggtctgtcacccaggctggaacgcagtggcgcagtcttggctcactgcaacctccacctccggggttcaagtacttctcctgcctcagcctcctgagcagctgggattattggtacccgccaccatgaccgactaatttttgtatttttagtagagacggggtttcaccatgttggccagtctggtctcagacacctgacctcaggtgatccgcccgcctcagcctcccaaagtgctgggattacaagcatgagccacctcaccgggccttgacatgcattttggaggcacacaaacattcagccatatcaggaaggttcagcagtccgagtccaaattggtttcaggcaatagcagccctgatgaatgtaatattccagatggatcagttgcacaggtaacctatagcttgtgtcttgagtcaacacatttctcattttaaccatttctcatgcagatctttttgaaatgcacttcacacactttaatatggaaaattcaatctattttccatggattttgtaatcatcattacgatattctttattctagttacaagctcaggaattgttgaagtgtagacccatacacaaaacagcctcagaccctcaacttttataactaatctttattgcttttttaattacaaagtgatacggtcttaagttttttttaagttatgcatttttttgtgtagtttttactatctccttctagactattcgcctggcatgttgtcacttttgtctctctttaatgtatttctagcagcatccctctcatttataatcattcatctagattttggctggaaaactgcacaatcaggctaattacaattgtgtgtgaagaatacccttaagacaaacgcttagccaaccaatatgactgttaggatagaaggatagaacttaccagtggatttggcatgaagtttacactgtggaatcagataggcccaagtgtaaagtgcctcttattggtattgggagcttcaacaaatgaccttatcatcctcagtttcctcggtgtaccttcagtttccttaatgtaaaatttaaaaaacaaggctgggcacagtaggtcatgcctataatcctagcatcttttggccgaggcaggtggatcacctgaggccaggagttcgagaccagcctggccaactaggcgaaacccccatctctactaaaaatacaaacatgacagacgtggtggtgcacatctgtaatcccagctactggggaggctgagacacaacaatcgcttaaacccgggaggcagaagttgtggtgagccaagatcacaccactatactccagcctgggtgacagagtgagactctgtctctagataaataaataaataaataataaacaaaacaaaacagaacacctaacttgcatggctattgtgaggattaaagggaataggatgtaaaacactcatgacagtgtttggctcgtgatggtgactcgaggaacactagtttcctctctcatgcatccctcccatgtatcaggatattgtggcagaatgtgtctaggacaatagttctcaaacttgaacttgcatcagaatctcctagaggacttgttaaaatatagattgctgagctgggtgtggtggctcatgcctgtaatcccagcactttgggaggccgaggctggcggatcacgaggtcaagagatcgagaccatcctggccaacatggtgaaaccccgtcgctactaaaaatacaaaaattagctgggcatggtggcgcatgcctgtagtcccagctacttgggaggctgaggcaggagaatctcttgaacccagcaggcagaggttgcagtgagccgagatcgagtcactgcactccagcctggtgacagagcaagactccatctcaaaaaatatatctatatctatatctatatatagatatagatagatagatagatagatagatagatagatagatagatatagattgctgggccacaaccccagaatgtctactttaggaggagcaggttgggtcctgaaaaatgtttcataaaaaatttccaggttatactagtgatggtgatgctgctggtctgggggccatacatcgagaaccatcagtctaggaggtagatatacttgcatccaaattcctgcttggccccttggcagttgtgttaatttgggcaagttatttaacttttctgagccacagtttcctaatctgaaacaggggcacgataacttttgcctgataaaatgttgtaacgtgatatggcagttgggaaagatctagtacttaataaatcttttttttttctttttctttttttttttagatggagtctcgctttgtcactcaggctggagtgaagtggcatgatcttggttcactgcaaccactgcctcccaggttcaagcaatcctcctgcctcagcctccggagtagctgggattacaggtgcctgccaccatgcccggctaattttgtgtgtgtttttagtagagacgggattaagtcacgttggccaggctggtctcaaactcctggtctcaagtgatccacacaccttggcctccaaaaatgctgggattacaggcgtgagccaccgcgcctagccaataaatcttcattaatctcaatgttgccttctttgtggcagagtctcttcctgtttagcttaaggacttgtagtgttccaaggaactacagcgactagatgatactgcccctaaaattatgtacatcttatcttagaacctttaaaataagacatctgtcatttctcaagaaggacaataataagatctgtagtaggtagcaaattttgatcctgagcaggtagcttaggacgccaatttcattaacttcccaccggtttatcttctggggcaatgaaggattaatttaaaaagtactacatcctgaagactgaaaagagttttacggaagagcatatacaagttcatgagtaccttctctattgggtatatgtgggctgtgggctgtgggttgagagcagctacccagaggcataaaagcattctcataagttgcaaagcaggtacaacgctaattgaatttgttctgctcagatgacatactctccaggaaagaaaaaaaaaatgttttcctgctgtgaaattggtttgctggtgttctgacaaatgaaagccttatagtaaaggcatcaactttaattattcatttctatttgcttaaagacatattcttatgtgacatacatatgctcatacatttccttgttgtaacaacatgaactaaataagtcactttcacacataaatgaaactccatgaattattattgctaacgcacgttctctatattattcagctggagaaaaagtaatgtttgtgtaatggggaagaattacagagcgaaagatgaggatctttttagtgtttttttcaggtagacaggaaaaaaggcaaaggctaccatctgctattactgatgatattactgaggaattgatacatttctatctatagagatttattaatgtacaactggttctacaactttatttgttcagtctacataaccaaaatgaggcttcaagtccggaagttccctgttacccaaggcaaacgtattagggtctgttctgccatctggtgttctttgaaggaaacatccacagaggcattatgagataaatagccagtgttgcctatgttggtggtgggtgttacaacctcgatgaaaagcaattccagaatctctgccaaattccaataggagataatttgagaatatatattaagaagaaaaatatacatacccttggagtaccaatttcacttttatgaattcatcttttggatatatttatacatgtgcacaaagaaatgtatataaaaatattcctagcagtactgttggtaatagcagaagattggaaacaagctaaacatccatgagtagggtaccagttaaataaattgtgacatattcctacaatggatatagtatagcatgttgttgtttgaaaaaaaagtcaaatctatatttacagatatgaaatgatcaccaagacacacacacacacacacacacacacacacacacacacacacatatatatatgtgtatatatatatattttgttttgttttgttttgttttgttttagatagagtctcactctgtcacccaggctggagtgcactggtgtgatcttggctcactgcatcctccgccaccctggttcaagtgattctcctggctcagcctcccaagtagctgggactacagatgcatgccaccacacccgggtaatttttgtatttttggtagagacagagtttcgccatgttggctaggctggtctcgaactccygacttcaggtgatctgcccgcctcagcctcccaaagtgctgggattacaggcatgagccaccacacctggcaccaaaacattgttaagtgaaataaacatgatcaagaacaatgtgtatcggtagggtgtggtggctcacacctgtagttccagcactttgggaggccaaggggggcgaataatctgaggtcaggagttcgagaccggcttggcaccaacatggcaaaaccccgtctccaccagaaatacaaaaattagccagtcatggtgcatgcgcctgtagtctcaactaccctggaggttgatgcaggagaatcacttgaacccaggaggcagaggtttcagtgagtcaagatcatgccactgcactccagcctcggcaacagagcaagactatctcaaagagagagagagaaaaaaagtaacaacatgtgtaatatgctgaaatttgtataaaaatgttcataatgcataggatatttctagaaggtttaatcaaaaataaaattttgaaggcctccccacaaccataggaatggacttcctccttggccaggacacctaaaatttagcctgaaagacttgttcaggccatgatggggaagtgggggtcagatatgcctcattatacccctccagcattaacatcaatgcagacttttaagtctgatatgaaacatttacaatctagtctcactgaagcctgttactgctacttggaggcttcatctgcaggataaaactttggtctccacaaccctttatcttttttttctttttgagacgtaatcttgctctgtcacccaggctggagtgtagtggcgcaatctcggcttactgcaacctccgcctcctgggttcaagcgattctgctgcctcagcctctgaagtagctgggattacaggcgcccatcaccatgcctggctaatttttgtatcttttagtagagacagggttttgccatgttggccatgttggtcttgaactcctgatctcaggtgatccacctgcctcrgcctcccaaggtgttgggattacaggcacgagccatcatgccyggcttcacaatcccttatcttaatcacagtataattaaatctacctatgacctggaagcaccccctmatctgccactgcttcaacttgtcccacccttccagatcaaaccaatgttaatcttacatgtattgattgatgtattgtgtctccctaaaatgtataaaagcaagctgcacccccaaccccatcccctgctgaccaccttgggcacatgtcatcaggacctctgaggctgtgtcagttgcatccttaaccttggcaaaaataaactttctaaatttgttgagatttgactcagatactttttggtttaccaaggatactcaagaaagtggttggccgggtgtggtggctcacacctgtcatcccagcactttgggaggctgaggtgggcggatcatgaggtcaggagatcgagaccatcctggctaacaaggtgaaacccctctctactaaaaatacaaaaaaattagccaggcgtggtggcgggtgcctgtagtcccagctactcgggaggctgaggccggagaatggcgtgaacccaggaggcggagcttgcagtgagccgagattgtgccactgcactccagcctgggtgacagagcgagactccgtctcaaaaaaaaaaaaaaaagagtggcaaccgtgattgactttgagggcaagaaccaaggtgatcaccagtgagaaggtaacttctctctcactatttacatattgtactgtagaaatacttttcttttttctttttttcttttttgagacagagtctcactcttgtttcccagtctggagtgcagtggcatgacctctactcactgcaatctccgtctcttgggttcaagtgattcttctgcatcagcctcccaagtagctgggattacaggctcctgccaccacacccggctaatttttttgtattcttagtagagatggggtttcatcgtgttggccaggctggtctcaaacctgtgacttcaggtgatccacctgcctcagcctcccaaagtgctgggattacaggcatgagccatcgcacccagcctagaaatactttttaacatgtgcttgtattaccaaaccctaatatgtatgcttggatgacaatgaactaagctgacttgaagcctcattttggttttatagactaaataaattgtacaacattgtgtgtgtgtgtgtgtktgtcttttacagagtttcactcttgttgtccaggctggagtgcaatggcatgatctcagctcattgcaacctccgcctcccgggttcaagcgattctcctgcctcagcgtcccacatatctgaggttacaggtgcctgccaccatgcccagctaatttttgtaggtttagtaaaggtggggtttcaccatgttggccagactggtctcgaactcctgacctcaggtgatccacctgactcagactcccaaagtgctgagattacaggtatgagccacaacacccggccagaactttaatacatctctatagatagagatgtttcatcagtattgcctaacacatgttaaaaagttcaaataacttttaaaaactagtgtcctgctgtagttctagattgtcatgactattaccaacaaattcactgaaaaatatattttttaaagaaaaaaaagagaattcatcccagtaaacagtttgtaaaccagggagatgcagtctttggtacaaaacaaaggtgcattctgagagaataaagagagaagttatcttttatagagaaagttccctcccaggttcccactctggtctgcttatgcaaatgaaggatgcaaatttatgtagttctgattggtcaacacttgctgagttccagttggctgatgcagatcacagtctattgactgatttaggtcatgtaaatagaaatagacaattcacactactatatggcccaaatgttaaatacgtaaaattcaagacaaaaaatttttctcttatgtccattgctgtgatctagtgttagccatggtcttttgttcaaataacatgaaatgagggcataagatttttttttttttttgagacaatctcactctgtcgcccaggccggagtgcagtggcacaatctcagctcactaccacctccacctcctgggttcaagtgattctcatgcctcagcctcctaagtagctgggattacaggcatgtgccaccatgcctgggtaattttttgtactttttagtagagactgggttttgtcatgttggccaggctggtctcgaactcctggcctcaagtgagccacctgcctcggcctcccaaagtgctaggattacaggcgtgagccaccatgcctagctgagatttttatatttatcatgctgattttgataaatacatctcagggactaacatctacgtgtggaagaaaaggagggtcaggagttatagtaatttcttcccccatttacagccacatgaagctctatcttgctactagctgaagacaagcagtaaataataaactgcattggcttattttgaaaaatgactttgagaaaggttaagaaacactattcagtggcaatcttatcttttaactgaggctttgcaagcagctgctgctggggcctcaagagatgtgataagatgacaagattaactttggttatgtaggggaagaaaaataattttctttctaccctccatagttcttaactgggactccctgagcagattaacaagagaaaaacaaacaaaagtttattagcgtgtatacctcatgtacgcatggaagaaaaccgtggagaaatgcataaacctccagagtagatctccaaggaaaagtttaatcttcaggtttaaatgctgccctttttattaaacaaagaaagaaaggtgtggggaaagaccccacagtctttcaagatggccagaaaaagcactgaaaagcaagggtcagttttgttgttttgttttgtttttttgagatggagtctcactctgtcgcccaggctggagtgcaatggcgggatcttggctcactgcaagctccgcctcctgggttcaagggattctcttgcctcagctttccgagtagctgggattacaaggatgcgccacagcaccaggctaatttttgtattcttagtagagacagggtttcaccatgttggccaggctggtcctgaacccctgacctcaggtgatccacccgccttggcctcccaaagtgctgggagtacaggcgtgagccaccactgctcctgrccaagggtcaggtttgttatgcagagttaagtccaggccttctccatcctttaggagtttctagtgattttctttatagatgtaaatttccttacaaaagggcgacttttctgaaatactcctgtgtctgcagtttctcaaaataaccagctcgaaataacccatacataaaagagacatattttggggtagcatattctggtctcctgcagtcatatttgggggtggtgtgtcctgagacctatcagtcaccttttctaaatcttttccagttctgccctctctctctttgggccaccacactggctctccttccatactttgactcttttgttccagcttcactgaggcctagaactcccttcaaggtattcctcctgggccaggtgcggtggcttgtgcttgtaatcccagcactttgggaggctgaggcaggcggatcagttgacctgtaattccagctactcgggaggctgaggcaggagaattgcttgaaccaggaattggaggttgcagtgagcagagattgcgccactgcacttcagcctgggtgacaagagcaagactccatctcaaaaaaataaaaagatatcccggccaggcacggtggctcacacctgtaatcccagcactttgggaggcggaggcaggcagatcacaaagtcaggagattgagaccatcccggccaacatggtgaaaccctatctctactaaaaatacaaaagttagctggrcgtggtggcgtgtgcctgtaatcccagctactcgagaggctgaggcaggagaattgcttgaaccaggaattggaggttgcagtgagcagagatcgcgccactgccctccagcctgggcgacagagcaagattctgcaaaaaaaaaaaaaaaaaaaaaaaaaaaaaaaatcccttctgtttcaaccaaaatgcttaccttttgaatgctactctatctgctatatgtaggtcatctgattaaattagttcattcatattacaatatgaatgaggcttaacttttccaggacatatttatatttgtattttctttttttctttctttctttttttttttttgagacggagtcttactcttttgcccaggctggagtgcagtggcatgatctctgctcactgcaacctctgcctcccggtttcaagctgattctcctgcctcagcctccctcagcctcccgagtagctgggattaccggcgtccaccaccacacccagctaatttttgtatttttagtagagatggggttttaccatcttggccaggctggtcttggactcttgatcttgtgatccacctgcctcagcctcccaaagtgctgggattacaggcatgagccactacacctggccttttttttttttaaggtagggtcttgctctgtcacccaggctggagtatggtggcactatcacagctcactgcatccttgaactgggatcatgccattctctcacctcagcctcctggttagttgggaccacaggtgcatgccatcatgcctggctaatttttttcttttgcagttttttcgtggagatggaggtttgccatgttgcccaggctgtatctgtattttccaaagagaattttattagcggaagtgaacttccagttggcaagtgttgccagggaaatggctctgagcaacgacattacttccctcmttgcttcccttatcagtcagttaatagctatttctggagcactgactgtgtcaggcactggtctacgtgctggggatgcagccagtaaagacagagtcagcccttgagaggcatgtgttgtgtgggacatttattggccrtaataaggatggcaccatgtctgagaggctgaaaaagagacccagagccagtgagcgagacatagggtttattgaggacttctacatggagtggtccaggggcagtgagctggacaggagaaccgtgacctgccaccacacccagctaatttttgtattttttatagagacggggttttgccatgttgcccaggctagtcttgaactcctgagctcaagtggtccatcagcctcagcctcagcctcctaaagtgctaggatgacaggtgtgagccatcgcgcctggcctgccctgctcatttttctacatagcacttaccttaacccttcatctatttgtttattatttatttatttttgtctttcttctcccactatgatgtcagcaacttcagggtagagattttgcctgctgtgttcacaactgtgccagcacatggctgaccttgaagaacagtcctggagtaaatgaatacttggatgaaaagtaggaaaagggagaaagctgctgatacaggtcagcagagccagatcacacagggcctagtagaccaggatggggagtttgcattttgttctaatttttttttttttttttttttggagacagagtctcactctgtcgcccaggctggggtgcaatggcgtgatctcggctcactgcaagctccgcctcccaggttcacaccattctcttgcctcagcctcctgagcagctgggactacaggcgcttaccaccacgcacagctaattttttgtattttttttagtagagacggggtttcaccatgttagccaggatggtctcgatctcctgacttcgtgatctgcctgccttggcctcccaaagtgttgggattacaggcgtgggccaccatgcctggcctttgttctaattttaatgtgaagccatggagcatctaagcagaagagtgacccaatatgttattttaggatgatcactcagttgaacttccagggcctagaacttgatgttatgattgacaggatgcacatcactttttgaagaaacccacttcattgctgaaagtctttaattattaaacattagggcaggcgccgtggctcacacctgtaatcccagcactttggaaggccgagacaggcagattacttgagctcagaagttcaagatcagcctgggcaacatggtgaaatccgtctttacaaaaaaatacaaaaattagccaggcgtggtggcaagcacctatagtcccaactacttggggtgggggctgaggcaggaggatcgtttgaaccccagaagtcgaggctgcagtgaactgagattgtgccactgtactccagcctggaggacaaagtgagaccctgtctcgaaaaaaaaaagaaaaagaaaaaaatccattttttcacacattgaatctttctttcttctctaaaactggtacccattaacccaaagtctgtgctcagaatccactgaraacaagtttaaaactccttccacataatggtttttgaaatatttggagactttcttagtcttctccagggtaggctttcatgatactttgacttattatcctgttacatgactttcagagttttcattgtccttcagagaggtctggcttttcagtatgctcctgaagaactgccaaactttggtctgaccaacacagtgcaaagcagtaattgtgttcaagactggagttttctgtgtctgaacacagcctaattcaattacacttcagctgtgtcactagcaggtcaggctaaacttgtggttgatggaaacatctggaacttcttcaagctsatgctgcttcctcctccacttcacctgcatgctgagatttgcagtgatcttgtgaaatgtatcctgtggtttccggctgaagtggtaaggtttttgagatcaactctctctgcgttctctcagttgcgtaacatctgaaaatttgtagttttgttcttatactttttttttttttttttttgagatggagtcctgctctgtcacctaggctggagtgcaatggcgccatcttggctcactgcaacctctgcctcccaggttcaagcaattctctgcctcagcctcccgaatagctgggattacaggtgcctaccaccacgcccagctaatttttgtagttttagtagaggcagggtttcaccgtcttggccaggctggtcttgaactcctgacctcgtgatccacccaccttggcctcccaaagtcctgggattacaggcatgaaccaccacgcctggctcttgtttttattctttatccaatttgttgaagatattgaacagaataggactgtggaaataattctatagtcttgtttttttttttacacagtctcactctgttgtccaggctagcgtgcagtggtgtgatcttagctcactgcaacctccacctttcaggttcaagagattcttatgcctcggcctcctaagtagctggcattacaggcatgcgccactacactcagttaattttttgtatttttaggagagatggggtttcataatgttggccaggctggtcttgaactcctgacctcaggtgatccgcctgcctcggcctcccaaagtgctgggattacaggtgtgagctgctgcatccagcctattgtcttattcttgaaattttttcttcttcgttttcttttccaagatggagtcttgctctgttgcccaggctggaatgcagtggcgcaatctctgctcactgcaacctctgcctcccaggttcaagcaattctcctgcctcagcctcccgagtagctgggattataggtgcccaccaccataccgggctaatttttgtatttttagtagaaacaggatttcaccatgttgggcaggctggtctcaaactcctgacctcaggtgatccccccacctcggcctcccaaagtgctgggattacaggcgtgagccagtgtgcctggcctgaaattttttcttaactgtcagcttttaaaataatgaactggggggtagaggagtatatttgtgtgtatgtagtgtgaggttccttagctgtgggatattggcagacagacaaaagtgaaggttttcaaacagagccagtagatgaaggggacatgccatggtgaagaaaattaatgagagaacacatagaaacaaaggggaaagcacagatattcttgacaggttaaataataagttgaatttcctttgatctaggagacaagggcagtcatctgtcaagctccttgacgtatttttgcttgttcacatatccagacattgtgaacccagaaaatctgaggcaggtctcagttaatttagaaagtttattttgccaaggttgaggatgtgcctgcgcccgtgacacagcctcaggaagtcctgacgacatgcgcccaaggtggtcggggcacagcctggctttatacattttagggagacatgagacattaattgctttatgtaagaagtacattggttcggtctggaaaggcgggacaacttgaagcaaaggcaggaagactcaaagcagagaagttacattcttttgagtttctgattagtttttccaaaggaggcaatcagatatgcatctatctcagtgagcagaggggtgactttgaatagaatggggggcaagtttgccctaagcagtttccagcttgaggtttccttagtgattttgggggctgaagatattttactttcacaatatcataagactgcttcttaagatccatggtcctctcgaagaggccagtatgaatcaacatcggtgggtgttcatactcactttaaacttaaagatttaggccaggtggggtggctcaagcctgtaatctcagcactttgggaggctgaggccggcagattgcttgaggccaggagttcaagaccagcctgggcaacatggcaaaacgcagtttctaccaaaaaacaaaagaaaacaaaacaaaacccaaaattagttgggtgtggtgacttacacctgtagtcccagctacttgagaggctgaggatcacttgagtttgggaagttgaagatacagagagtggagatcatcccactgtattcyagcctgggtgacagagtgagaccctgtttcaaaaataaatataaataaatatatataaagatttaagcttaaggccgggcgcagtggctcacacctgtaatcccagaactttgggaggccgaggtgggtggatcacaaggtcaggagtttgagaccagcctgaccaacatggtgaaaccccatctctactaaaaatacaaaaattagccaggtgtggtagggcatgcctgtaatcccagctactcaggaggctgaggtaggagaattgctttaatctgggaggcggaggtttgcagtgagctgagatcgtgtcactgcactccagcctgggcgacagagcaagactccatctgaaaaaaaaaaaaaaaaaaagatttaagcttaaaacaaaaagcaatagatgatatttgtgggagacattcatgcctctactctcttaaaaaataatgaatcattccccaagtcctcattttactttcatataatctagacctatggcagctaataaacctctgtggagtttgggtgtttcatgttatagctattgagcagaacttttcatatacagtttgtacaagcagctgtcaaatcacttagaagtaccatatcccaagccacagttcrgtatsttactcccaaggatgccagtagataactcatcaaatgctttactaaaagagggatatacaytgtagctaaagtgttgcccttttctactaacctaataacaatgtcaaaaaacatawttggatttaatttgttgaaaccttcaaatgttttgaagagagttcatattatttttcagtcatcatttcacattcatctacatacccataaaccatttgtttaacaattcataccattgggctgtggatttatgtcaaacttactgaggcttggctgtcagaatctattgcttttccttctgtgtcttcaggcatctttgtgttcatcgtttttgaaaatgtttttttctcccatcatgaaataatacaaacacattacataaaatttggaagcagagaaaacaagaaaaaaaaatctccttctaactcaaatactcaatattttggtacactaacttccagcattttttctagatatattctttttaaaaaaatttttaggccgggcatggtggctcacgcctgtaatcccagcactttgggaggctgagttgagcggatcacaaggtcaagagatggagaccatctggccaacatggtgaaaccccatctctactaaaaatacaaaaattagctgggtgtggtggcacacacctgtagtcccagctacttgggaggctgaggcaggagaatctcttgaactggagaggctgaggttgcagtgagccgagattgcaccactgcactccagcctggcaacagagagagagaccccatctcaaaaaaaagaaaatctttatgttaagttccagggtacatgtgcagaatgtgcaggtttgtgtatgtgggtatatattcttaacagtatcacagtgttgtacatgtattttttttaattgagacaggttttagctctgttgcccaggctggagtgcagttgtgtgatctcagctgactgcaacctctgcctctgagttcargtgatcctcctgcctcagcctcctgagtagctaggactacaagcgtgtgccaccatgcgtggctaatttttgtatttttggtagagatggggtttcactatgttgcccgggatggtttcaaactcttgagctcaaatgatctgtcagcctcagcctcccaaaggtctgagattacaggcatgagccacctcacccagccaattgtacatgaattttaaaatacaattttcattttattagattgtcctccttaccatcctatattgtaaatattgttgatagtgaacttcccagggtcacaattacacgttttaacaacttggaatatgttttcctgggtttctagcccctaaattcattttggacagctagtttcttgtattattttctagctggacttttattccatcttcctgatatacatttttatttttcagtgtgagtgtaatttctttctttctttcttttttttttttttttttgctatataggtgttttagtctgttcttgggttgctgtgaagaaatatctgagactagaaaatttacagagaaaacagttttaattggcttatggttctgcaggctgtttacacagccagcatttgctgggcttctggagaggcctccaggaaattttattcatggtagaaggtgaagagggagcagggagcaagagaaggagctgggaggaggtgccacacacttaaacaaccagatctcatgaggactcaactcacacgtgccaaggaaatggtgctactcyattcctgagaaatctgcccataatccattcacctctcaccaggtcacaccttcaaccctgggaattacacttcagcatgagatttgggggcacaaatattcaaactctaccaataagtcagaagaaaactaacaattaaataatcggtctctctctttgtcagctttcaaccttakgtttagaaacttcatccttgtaaatcggaacaaaaattgggctaacctttcaggaaggcaactaggcagtatgtttgaagattcttaaatgttttaccctttgcttaagtaattccacatctaggactctatcctaaggaaacaatttattcaaaaattttataaaagggccgagtgaggtggcttatgcctataatcccagcactttgggaggctgacgtgggcggatcacttgaggccaggaatccgagaccagtctggccaacatggtgaaaccctgcttttgtaaaaatacaaaaaattagccaggtatgggyggtgggcacctgtaatcccagttacttgggaggctgagacaggagaacagcttgaacccaggaggcggaagttgcagtgaataagatagcaccattgcatctgcactccagcctgggtgacagagcaagactctgtttcaatgaaaaaaaatttgtaaaagaatcttggttgctctgcctatggggaagccattcttttactcctttactttcctaataaacttactttcacttaaaaaaaaaaagaatcttaactgtacctttattcataatggtgaaagatagcacccaaatatcccaaagtaaagaaatggtcaaaatagagagcatctacatgatgtaagattgtgtagacattaaagaaaaaagcaagctttgaagacacaaataataatctgggaaagtgctcatgatatgaaaataaaatayacaacaatataccgaatatgattccaattctgattatgacatatacaaatgctgaaaagaaataaccctaaatggtgatattataggatttttagtcatttcctgtttgttttccagattgatttaaatgatactgtattactctcataatgagaaaagtataattccatatgtacgaatcatcttccttgtgaaatacaataactcttccttcctctttccatcctgacttctacactttattgtctttgcattttttctgatctttatcacatcttggatttagtttagtcagctgagctcctgacattttatggacttggtttatactgtacttcgtttttttttttttaattttttttgagacagagtcttactctgtcacctaggctagagtgcaatggcactattgctgctcattgcaacctccacttcctgggctcaagcgattctcgtgcctcagcctcctgagtagctgggattacagacgtgcaccaccatgcctggctaatttttttttatttttagtagagacggggtttcttcatgttgaccaggcttgtttcgaactcctggtctcatgtgatccacctgcctcggcctcccaaagtgctgggattacaggcatgagccaccgtgcccggcctctatgctgtacttcgaatycatcccatgtaatattccccttcctccatcctttttttttctttcccaacctgagctcatcagaaaaacttcctgggaagtcayattagtttctctggctgcctcctcatcttctgcaccagatcgtcagcaaatgcatttccagaatcttattatcargctctcatctgttaaacctcattcccttttaggttttctggtgatgagatcatccccataatttctttctaattctcacaatatgtttttctaaatagtccgtgacacttgtgtgaaaggtctcaatgttctcttcttctttctttcgagatggagtctcactctgtcacccaggctggaatgtagtggtgcgatctcagctcactgcaacctccacctcccaggttcaagtgattctcctgcttcagtctcctgagtagctaggactacaggtgcgcaccatcatgcccagctagtttttgtatttttagttgagacagagtttcaccttgttggccaggctggtctccatctcctgacctcatgggatctgcccgcctcgacctcccaaaatgctgggattacaggtgtgagcccccatgcccggcctcagtgttctcttctttgtattccaaagcatcatggcctttttgtctcaaacttgtcctaactcagaacttcttgtgaagcaggaaaatgaagtgagctggggggctgataccagactctcacactgggactggacagagggctgagatgatccagccagctgaacagctgactctggagggactggctgcaatttgtggtggtcattggctgagagttgggtgacataatgaccctactgaatgtcgcagaaacatctatattattttctataccaagataagttggggagacttacaattttgctactcatggggactaaaaccgggtaagcagtatcattatgggacgctcatttaacctgcatgaaccacatgcctacctttgtgtgattttgtgtaggaatttcaaattctttggagtaagacatcagaggcatgtatattaatgacaagaagaatgttaatgagaactaactttcattaaacactcattataatatcaccacttagggttatttctttcagcatttgtatatgtcataatcaaaattggaaccatattcagtatataattatgtattttattttcatgccataagcaatttcccagatcattatttgtgttttcaaagattgcttttttttctttaatgactacataatcttacatcttggagatgctctctattttaaccatttctttgctttgggatattttggtgcttactttcaccattatgaataaagctacagttaagtatcctgcctgcattctaattgaatcctgactacacccatttgaagggggatttgtttatttatttattatttattttttgagacagagtcttgctctgttgtcaggctggagtgcagtggcgcaatctcagctcactgcaacctccgcctcctgggttcaaacgattctcctgcctcaacctcctgagtagctgaaactacaggtgtgtgccaccatgtccaactaatttttgtatttttagtagagatggggtttcaccatgttggccaggatggtctccatctcttgacctcgtgagccacccctgttggtctcccaaagtgccaagatgacaggcatgagccacctgcacctggctgggggttttatttattatctccattttagacatgaaaacttgactagagaatgttacttgcccaagatgacacagctactaagaggcagagccaggactccaactcaagtatacggtgattaaaacctctgtccttagccatgacaccatggtcttgccacagtgatgaacttgcccccattctctgatggggtcactctatgaagagccagagactatgctcctttttctatttggtgcacaccatcctccacagactcaatatcacaattatatctaagcacctttctccaaatccaatctaacacgtaacatatgggttggtgaatttgcctagcaaaattcctgccagtttctaagtaaagactttggcccctagctaggactccgttcctctggcatttcaggccttgatttcggggaaaaggggaaggaaattccttccttctaatgtatgcttcacaagagcagcacatgttctggttcatcagaatggccagtttcatattgttcatctcacagatgaacaccacagaagatgccattggtttggagagtggaatkaatggaagatgagtttatgtggcaacatactacggtttttcttcttccagtctctctttctccctgcactactctctgatcccagtgtgtcttctacactgctatcgatatactttcgaaaatacaaacctgatccggttcctccccttcaccgccttcaagataagttctaattcctaaacgtggcttacaagagcctttgccagctgggtgcggtggctcatgcttgtaatcccagctctttgggaggccaaggcaggtggatcacttgaggccaggagttcgagaccagcctggccaagatggcaaaaccccgtctctactaaaaatacaaaaattaggcccagtgttgtagctccgtagctaaggttctctcctttcacagtggtggcccgtgttcgattcctggcttagagaatgagtactttctggttaatatctgtgtgacttttggggctgggtatggtggctcatgcctgtaatcccagcactttgggaggccaaggcaggcagatcacttgaggtcagaagtttgagaccagcttggccaacatggtgaaaccctgtctctacaaaaatacaaaaattagccaggtgtgctggcatgcctgtagtcccagctactcaggaggctaaggcaggagaattgcttgaacccagaaggcagaggttgcagtgagccaagatcacaccactgcattctagcctgggcaacagagtgaracactgtctcaaaacaaaacaaaacaaaacaaaaaacaaacaaaaaaaacaaaagagcctttatcatctagttcctacccactctccacctttgtttgctgctattccttacctgaaatattctgcaccagcaacactcaacaatttgcaactgttgggtgcatgatgctgttttatgcctttgctctttggcaacaacctggaacatcctcatcattgccactacatccttatgtgcggggatacacatgcatctgacactttcttctatgattgtaattgtagcattgtacctcagtcttagtaaactgcgaactccttatagccagtagtcaactcttgtttatttctgaaattctgctatcaaccacaaattacagcttagtaagggcttagtagcagtttgtaaaaaaataaaataaaataaaaaagaaagcctgggcacggtggctcatgcttgtaatcccagcactttgggaggctgaggcaggcagatcacttgagatcargagtttatgaccagcctgggcaacatagggagacccccatctctacaaaaaataaagaaataagaaataaggctgggcgtggtggctcacgcttgtaatcccagcacttcgggaggcagaggtgggcagatgacttgaggccaggagttcgagaccagcctggacaatatggcaaaacgctgtctctaccaaaaatacaaaaaattagccagacatggtggtgcaatgacttgtgatcacgccactgcactccaacctgggtgacagagtgagacactgtcaaaaacaaacaaacaaacaaaaaacacccaaataaataaataaataaaagcattaatggcacttaggagaaaatgcacaagagactcagagctgtgtcatattcaaagtacagaaaatagtctcacttggcaagggagaaaatgtatgtggtagaaccgtattagctgaacttgtcttaggtgaacattgacgtgctagatcagtggatctttatccttacttcaatcatacttacctggacaattgttttaaaaatcactataccggccggccgcggtggctcacgcctgtaatcccagcactttgggaggccaaggcgggtggatcatgaggtcaggagatcgagaccatcttggctaacacggtgaaaccccgtctctactaaaaatacaaaaaattagccgggcgcggtggcgggcgcctgtagtctcagctactcgggaggctgaggctggagaatggcgtaaacccagggggcggagcctgcagtgagcagagatcgcgccactgcactccagcctgggtgacagagcgagactccgtctcaaaaaaaaaaaaaaaaaaaaaaagcactatacccagaaattatgagtattggtatttttaacaaacaattgggaacatctactatgcagccaaggataagactaactactctagataaaaatagaaattgcaacatatggatattagttttttcaaggtaaaagctacctgtattcagaggatcccagtgtccacacaaaaatgtcccagtgctgacttaggcccattattgatttctagacatatttaatcatgcccattaagccctgtgacatgtttataccccttataaatgcatatctagttcctgacatattttatcataaagagaaggcatttgaatcttttctctgaaatgtggttggtagatattgactagaattccaactcagaaggagacaacattgaaagtaggtttttaaacaaatagtctaaactgttgctaaatgtttaatatcatggtcaaagtctctgcttgggaagtaaataagaaagtttttgaacatgtgatgcaatgtggtttcaggaatacaaaaaccttggactctgaatccaggtctctatagtttaatttacaaattagcgtaagaaacgctataaagtcattaacagtttcaaaagacgaggtcccatgttacttgtgataaaaatgttgttattttatatattcttaaattctcaggtattcttgatcatgcttgtatatatatatacgtatattttatatattatatatattatatatacatatatattatatatatattttcagatggagtttcactcttgttgcccaggctggagtgcaatgagtgatctcagctcactgcaacctctgcctcctgggttcaaatgattctcctgtcttagcttcccaagtagctgggattacaggcgcccrccactacacccggctacttttttgtatttttagtagagatggggtttcaccatgttggccaggctggtctcgaactcctggcctcaagtgatccacctgcctcatcctcccaaagtgctgggattacaggtgtgagccaccatacccggcctgttaaaatatattaatagcatgttaagtgtaacattaaacccaagagttgccaatctttactgatgagtataaaccctgaaaatacaagacagccacttgatttgccaaaattccatattttttaacagtttttccacttgctctgccaaataaaacttcaatggtaagtttaaatgtgtctttaaaactgtcatttaacattggtaagcagccagctcctcagttattatcataggttagttttgggaatgtgaatcgaagtgcgtggagggaagatagatcagttaactgatcaaccagatggtgctaaagttatgtggcccaatgtgtcacaaactggaaggtgaaaataattgaaaggtgcaattgcatcttatctctccaaagacttcttcattagggccatgtgtgtttctggaagagttttaggaataccttgtagttctctctctttttttttttttttttttttggagatggagtctcgctctgtcacccaggctagagtgtagtggcgcaatcttggctcactgcaagctccgcctcccgggttcacgccgttctcctgcctcagcctcctgagtggctgggactacaggcgcccgccactacgcccggctaactttttttttgtatttttagtagagacggggtttcaccgtggtctcgatctcctgacctcgtgatccgcccgcctcggcctcccaaagtgctgggattacaggcgtgagccaccgcgcccggccaggaataccctgtagttctcagacatgttcaagttcagccggaggtaatggctcacacctgtaatctcagcactttgggaagctgaggcaggcggatcacttcagtccaagagttcgagaccagcctggccaacatggcgaaactctggctctactaaaaatacaaaaattagctgagcatggtggccagctgataatcatcataatcccaaaattatgattatgaataaattaatcataattatactcataatttattaattatgcagattaccatttattatctttgtatttaattgttcaaacaagggaaatttttaccagccgaagagtaaacatgaaagttgtaattacaaatgcatgtaacagcccacaaaagccgtcaaactaagtttgatttagtggtttctccattttcctgtcactgttattttgcataatttttcaaagctcagtagctggcaaataggagctgagtgtcaatgatggcggtggggtgggggccaagcttgtattcctctttagggggcgatgcaaataaaatttgaggcctcgtatgatccagtttaaaaatcacatctcaatagaaggactttcaaggaaaccacaaaaagcgtccttccttccttccttcttttcttccttccttccttccttccccttccttccttctttctttttctttcttgtgctctctctctccttctttccttctttctttctctctctttctttcttctttttctttttcgttattttttaaatgatttcaaattacaaacatacagaaaagttgtaagaatagaacaaaaacttccttgttctctttacccagagaccctagacccttccattcaagtgtcaccaaatgccccttcgggcccacactgtgcacccagttctcatgtccacctgggttccctaagtctttctttgcctttcatggcttttgcccttttgaagatgacagggcagtcattttgcataacgtccttcaatttgtgtgtgtacagtgccttctcatgacacaatccaggttactaagcttttggcaggaatatcacagaagtgacgctgtgtccttctcattgcatcctcttggtggaggacatacatgccaatttatcccattagtggtgacattaattttgattacttaattaagatggtgtctgccaggttcttcccctctaagtttctctttgtcycctttataataaatagttattttatgtggagacatgtttaaggctgtatgaacatttctcatcctacttgtatcccctgattctagcatcaattgatacttctttgccagaattaaatcgtttcataattatttccaaattacaattctctaagtccagtattcctctatattaattgcttggcattatactctaaggaataactttcttatctcttcacataattgttaatgtgtttattactatcactgtggactcactgattcctattttattcagtggagtataatccattactattattacttatttggacaaactgtcacatatttgaccagagaaagcaccccccgccccccgcttttttttttttttttttttttttttttttttttgagatggaatctcactctgtcgcccaggctggagtgcagtgtcacgatcttggctcactgcaacctctgcctcccgggttcaggtgattcccctgcctcagcctcctagctggcataacaggtacacgccaccatgccctgctaatttttgtatttttagtagagacgggatttcaccatgttggccaggctggtctcaaactcctgacctcaagtgatccacccacctcggcctcctgaactgctgggattacaggcgtgagccaccgcacccagtcaagaaagccactttcaaatggcttctctgtcctttggacatgtccctatcattctctgagcattacctaagttgttcaagatggtgttccaggctcatcttgtacttttccttgacccagttcaagaatcagccaattttctaaggagctttggtgcctttcgatggtggattgcatttatttatttatttagatagtgtctcgctctgttgcctaggctggagtgcagtgttgcaatctcattggctcactgcaacccctgccttctgggttcaaatgattatcttgcctcagcctcccaagtagctgggattacaggcacctgccatcatgcctggctaggttttgtagtttttgtaaagacagggtttcaccmtgttggctaggctggtcttgaactcctgacctcaagcgatctttctttcttcctgaagtgctgggattacaggcattagccaccacggcctggccaagaattgcatttaacaaccaatatttaggcactgtgtgtgctcattgctactggatgtactactgctattatcctagtggacagaactaagaattatatgtatattcaggcatacattcacacacatgtacataccattatatctatattgatttctgtatctgtttatatatacgcacaatttgtactgtctccattttcaatccaacacctcaaggttcatgctaactttccttctttccgcattgttacttctcttgttagtgagaaacctgacccccattatcctcaatatatttgcttgtttgctcaatctcctatatgtagctaagcttgtgacaccatcacgctgccatccttacacagataagcatgactttccccttgaggccttccttgtgacttttagactgagttaggatgaaaagaaggaggaagggaggaagagaggaagggaggaaaggagaaagagaggaagggagggaggaaggaaggaaggaagggaagaaaggagggagggaggaagggagggaaaaagggaggggagaagggagggaaggaaggagaagggagggagggaaggaagaagggagggagggaagaaggaggaaaggagtgcatagttttccarttgaagtataatcaagtaaacacacagatcttaaatatttggcttgatggcttttgaaaattgcatgtagccaagtaacaaccacctaaaatagaatataaactatttcgacacccctaccccaagtttcctaatgcaagggagcccagccaccaggaaacatcattaaaaacccttctccttgtcctctctcaatatcaggcactcagtttgtagctgttgctgaaaatattctcgtctcaattttaaccttttctcaaattttctttaactgatgcccgacctctttggtttctctctccttttccccttctacttcagatcttactatacagaacgacttggctcctcctgacttcattagttttctttcttcttcattcatcaaggagattctccacaataaagcggaacctgggaattatccagagaacaagaatctccttccccttagaaggacaaatagggaaggaccactgttatttcacattagtggcagcacactcttcttatcatggaacacaatgttcattaggatcgtaatttaagaatcatctgcctgacagatggagatttctcaagctgatgtgtctcagggaattttagacctctggatataaaccaagatcacccaaatgagagcaagcggaggttatttattcagagcttgctatagsaagggaggcagccattaacagttgtgtttggcagagactcaaagtcaaagtcagacagaggagtgggaaagctttataatagaaaaaaggaaaggcttcaggtgtgctccaacggattgttggtatggggaggatggaaggaaactaactagaagtgaggtgtccatgtgattggttagagaaatatgtttggatttctctggttggccttaagttgggccaactgctatagaggttgtaggtttggctttctagacctgttgctacagatgtgtgggtcagagttctgttttcacatatggcctggctattgtccatttatatatccttttttttttttttagagcaaatgatgtagaagagaactagggaatcaaagacaaccccccttccgaaccctctcaagcaacaacatcagcactggcccattatcttatcctactcaagtttttttttcttcttcgagtcccaagttgttaatttcaaatcaattttcaaattcctgaaacagatctagaaacctgtctagacagatccaagacataytaagaatggatgaggaggactttgtattgatctgacgtaagagaagatagagaattcaaggatagctctaaggtcctaactggagctataggagcttgcaagagaggatgttgagctcagtttgtagggaattaaagttgtaagtgcctcctggaagacattctttgtaattatacatctgaaaactggaacatcattttagagaggtggagactgagaacagagagtaggtgtttgtccaaagtttatatgccaaggctgtgagtgaaacaggagcttygatcttttggtgttccatctacaacatacacaaaacaaaagatggagaatgagaagtccaggcaaccccggaaacaacaagtttctgtcaaaagcaataatgaactgttttgtgccattaacaaaaacgttatgaagacagaaaccatctcccaaagatttcataacagagccacataagtggaaagtaaatgattaaagaatgtgggtctcagagttccattcaaatcaygatactttatcttctatttacaaagataaaagtacaccagaaaatggttaatgtttaagcgctttcatatttggctctgtctttttagcagacraaaacmactttggtagtgccagtgtgactcatccacaatgatttctccagygctcatcttgttctcgagttttctctgccatgttgctattgcaggacggagtaagtactttttgcttttgaaaaaataattaatatatccaaccccttcgtatatgtcagggatcaataatgataagtaggccgggcgtgcttgctcacatctgtaatctcagcactttgggaggccaaggcaggtggatcacctgaggtcaggagttcgagaccagtctggccaacatggtgaaaccccgtctttatgaaaaatacaaaaattagctgggcatcatggccgaggtgggcgaatcagttgaggtcaggaattcgagcccagcctgggcaacatagtgaaaccctgtctttactaaaaacacaaaaattagccgggcgtgatggcaggcgcctgtaatcccagccactcgggaggctgaggcaggagaattgcttgaacctgggaggcagaggttgcagtgagccgaggtccccccattgcactccagtctgggcaacaagagcaaaactcagtcaacaataataataataagaagaagaataattaaattctttttttttttttttgagacagagtctcgctctgtcgccaggctgaagtgcagtggtgcgatctcggctcactgcaagctccgcctcctgggttcactccattctcctgcttcagcttcccgagtagctgggaccacaggcgcccgccaccacacccggctaattttttgtatttttagtagagacggggtttcaccgtgttagccaggttggtctctatctcctgacctcgtgatccacccgcctcagcctcccaaagtgctgggattacaggtgtgagcaactgcgcccagctgataactaaattctctttagagtggatgctggagggactggattgatactgattctttaatattgccatgtgtaaagctcctctgtaagatacgtagccaatttaagcctcagcatactgacctgtaaaatggggataattataatacctccttcaaatggttgttgaggggattagatgagatagtgtatatgaggtatttggcatgcaacttggtatgcttataattggtaacagtacacacatttttcatttgtgggcttagctgaactttaaaatgcaaatagagatttgttaaccatctgctttgtgccctctttcagcctgtcccaagccagatgatttaccattttccacagtggtcccrttaaaaacattctatgagccaggagaagagattacgtattcctgcaagccgggctatgtgtcccgaggagggatgagaaagtttatctgccctctcacaggactgtggcccatcaacactctgaaatgtacacgtaagtcagtaccttctctcacattctcttccctcatttggattctgggtattttggaggaataagctacctcgtcatgctcagagtgcagagggccagtagatgctgcagaaagccaggttggagagaaatgagaaggtcttggggagttctctctgtgcaaagagagtaagggtaataggtgctattgatagaagaggagaagatcatagcctgaaactagggtaggtttaaaaatgagatctggtgtggcaaaaggagaaagaaacactacagaagttaaaagaacagtggagaggctttgaaatgtcaactgatgccaaagagacatttggaaaaacaaaatttggggaatcatcatatctttggacttcacctgaaaatgaaagcggacttaatagttactgaaatgaatacaaatttcatctacattatgtatatattatattataatgaaatacaagaaaagaggtcaaattaaaataataatataacgtaaaatatatcaatctcactatggctttactgtaaatggttgcttttatttatttcttagaacatggttctatgatatcatgctagcattattctttacagtcaagtattatgcaatcaaccagattgaatttatggtacatttaattatatgtagaagttaagcagtaaaaatagatgtatggatctggtgattttggttatatgaacaggacctttgtcaaagttatgcatgttcatgcaagttgattttactatgcttttttgcttaaagagcctaaacataatttttagtaaaaagccaatgtaacatcattagggaaaatttttctttaaatcagggccaggtgcggtggctcacacctgtaatcccagcgctttgggaacctaaggtgggtggatcacctgaggtcaggagttcaagaccagcctggccagcatggtgaaacctcgtctctactaaaaataaaaaaaattagccgggcatgctggcatgcgcctgtagtcccagctactcaggaggctgaggcaggagaatcacctgggaggcagaggttgtagtgagctgagattgtgccactgcactccagcctgggcagcagagtgagactctgtctcaaaaaaaaaaataaataaataaataaaataaaaatcagctataactctggaacactaaaaatttcatttttttattttccatgcatatctttttgcattactgcagagagcaggtataattttgtatttttctgttttcatcagcatatcataaaaattgtatctccacatatttcacaattcatattttattggctacataatagttcaacttttgatttaccatgattaattaaaacagtcccctgatgaacccttagactatccaattttttttttttttttggagacggagtctcactctattgcccagtgcagtggtgccatcttggcaccctctgcctcctgggttcaagctattctcctgcctcagcatccagagtagctgggactacaggcacccaccatcatgcccagctaatttttgtatttttagtagagatggggtttcaccatgttcaggctggtctcaaattcctgacctcaagtgatccaccctcctctgcctcccaaagtgctgggattacaggcgtgagccactgctccccgcctgtccaaattctgttattaggagaaacagtataatgaacgcttttgtacatatatcacttgtcttattttgaattgctttcttagaatagttaccagtaaagttattgaaccaaaggatgaaaatgaatttatatgtttcatttaatgaaaaattctataaatagaaatttacctgtttatgtttttttttagcccaaagaaaagtaacattttttatctttgtatcacagccagagtatgtccttttgctggaatcttagraaatggagccgtacgctatacgacttttgaatatcccaacacgatcagtttttcttgtaacactgggtaagaactttcatggaactaagcagttaacagactgagcacatttttgtatccttaagctaaacatcaagactggtctatattttgttttcagcctttaggttggactttcaaatgcaaatcgattttagtcctgcttttttttttttttgagacggagtctcgctctgtcgcccaggctggagcgcagtggtgcagtctcggctcactgcaagctccacctcctgggttcacaccattctcctgcctcagcctcctgagtagctgggactactggcgcccgccaccacgcccggctaattttttgtgtttttagtagagacggggtttcactgtgttagccaggatggtcttgtagcattgagggtggggtaaggattggagaatataacaactagtgcaatacgtagtcaccactgtatctaatttttctgctcctgattaattatctcagaggaggtacattaaaatgattgaacctggatgataattccatatgatctctgggccaaatcttggatagggttaaaatactttaggaataagacttgggctttagttattaggctaatttgattgaccaacctggtagtctctagaagagaattctatggagaaggttgggagtgtgacagtggagaatgcaatgcagttccacatccccaggaagcaatcacttgtggtgggcacaggctcatctgggagcaaagggaggcagtcacttaacggtgggcatagactcataaggagcaaaggcacccctgtgacattattgagagcacattggctatccactagggtaagtttctactgggattggaggttaaggaatactacatgtgagagagaaatacacacctttcatctgaaacaccaatctaccaatgggtctggtaacaaatgaccttaagaaaattggcttcgaagacataatgttacatttttctttctttttttttttttcctttctttttgctctgtcacccaggctagagtgcagtggtgcgatctyggctcactgcaacctccacctcctgggttcaagcaattctcctgcctcagcttcccaagtagctgggattacaggcgcctaccaccacacccagataatttttgtatttttagtagagatggggtttcaccatcttggccaggctggtcttggactcctgaccttgtgatccaccctccttggcctcccaaagtgctgggattacaggtgtgagccaccatggcatcctgctcctttcctttcctttcctttcctttcctttcctttcctttcctttcctttcctttcctttcctttcctttcctttcctttcctttcctttcccttcccttcccttcccttcccttcccttcccttcccttcccttcccttcccttctcttcctttcttctttctttctttctttttctttctttctttctctttccctccctcccttccttccgtctttcttttcttttctttctttctttgtctgtctctctccttccttactttttccttcctttccttcttttcttttctttttttttttttttttttttacaggatcttcctctgttgctcagtctagagtgcagtggcacaatcatggctcactgcagcctcgacctcccaggttaaatccttttgaatccttccttccacctctacctctcgagtagcttggactataggcacacactaccacggcctggtgactttttgtagaaattgggcctttgccacattgcccaggctcaaactcttgggctcaagtgatccgcccatctcggcctcccaaagtgctgggattacaggcatgagccaaagtacccagtcagaatgctatattttcattggaaatagactgcattgcttttattcattggtgtcagtaggcygtaagaaaatgaataatgaagattactcagtttggttcacttttgtcatcctgaaaaagagatggttctttgctttatattagaaacagtcatcttggccaactctttaaagatgagggatttaagggtttggattctccactcaccagctgtggaascctgcagtgattcacctgcatcattggttgggaggctccatgagcyatagatgagtactaagtttgtcaggaagacagcattatacgatggaaaagaagtcaatagcattaacatgaarcaatgctcaatggagaagatatttgagatgtcagtgatggattattttactccttgatagaatgaattttccttttgcaggttttatctgaatggcgctgattctgccaagtgcactgaggaaggaaaatggagcccrgagcttcctgtctgtgctcgtaagtctgtgggcaaggtgatcagctggtttgcccagaacctttctggttttagcactcaaagtctcacatctggaatctcttcagtcacagctcaatgagatgaatggtcacccttgtgggggatattcatcctggtatcttgctctagaagatgaaacaaccactttggaatgacagaagggaagcattttactcacggacacattctgtattctccacctcgcggtcattactctatctaagccagtcatttctgggtgtgttgactccaatgctctcatagtgctttggaagtggcttggatatgtgtggcattggtatatcagggactgtcaccacttaactagaggaacttctgcaaacagtgagatcaaacaaacatcttcctcccactctggaattcattcattcatttattaacttattcaataaacatgaattgaggatctactgtatgctggatcctcttgttagcactgaggctgcaaggccaaaggaggcagctttgccttcagagagtaagcctagtgacttacgggacagacgaggaggaaagtcaccctcacagtaagccaacagcccatcaaaggggcttgcatcctaggagctgattggcattcctccaaaaagcactgttgttttttcagaggatcctcagccaagctgtcagagtcatctctgggctttgcttatgtagggaaggacgttcttatgttccccaacttgtgatttatacatctttgaccaggaggcccaggcatttcaatactaattatagttcttcaacatgtcagtgargtctgtctttagcaaaagcaagaggagggcaggtgcagtggttcacgcctgtaatgccagcactttgggagtccgaggagggtggctcacctgaggtcaggagttcgagaccagcctgaccaacatggagaaactccgtctctactaaaaatataaaatcagctgggcatggtggcgcatgcctctaatcccagccaattgggaggctgaggcaagagaatcacttgaacccgggaggcggaggttgcagtgagctgagatcgcaccattgcactccagcctgggcaacaagagtgaaactccatctcaaaaaaaaaaaaaaaaaaaaagcaagtggaaagtaaagcaatttcaaataaataattgtttaagaagacctgaacaagcaaaaacgaaagtttttaaagkacaaattaagtaaaattttcactcagcagtaggaatcacgatggttcctacagttttcacttaaaacagatttataccgattatgtaaatttgcttctttatttagaggtagggtcttgctctgttgcccaggccggagtgcagtggygtgatcacagctcactgtaacttcgatctcctggggccaagtgatcctctcagtctcctgagcagctgagactatagatgagcgccaccagatctggctagtttttaaaaattttggtggagacagggtcttgctctgttgcccagactggtcttgaactcttggtttcaagcaaccttacctgcctcagcctctcagggctctgggattacaggcgtgaaccacggtgcctagccataaactcactttccaaaagggttgtaaatagaaagactgcttgagctttaatctaatttaaatgagtatttctcatacttgaatgcacatatgagtctcctgggcaccttgttaaaatgtagattctgattcaggcacctgcagtggggtctgagcttctgcatttccaacaagctattttcccaggctatgcccgtgctgctagcccctggaccacattttgagcagcagggatctagggaaktcaaggtaaatcgcattttggtcagcactatcttcttttatgctagtataacttgttgaagctccatagtactcaggtcagggtgacaagccactactatctctctgggttcctgaagctacttgggtaagctccatccataccaagaatccaaaagcagggaggtattcagcagaaacagactgaactggtaatggaactcattcccaaactactatgtaccaagttgctgtcaccagccattatttcaggatggtccctcagcactgagggacaaattctgccttccagaagcatcttccaaggtagtatatgaataaaagattttataaaacctaaccattgtgttgttgcaaaaggcagtggcaagacttaaatttccttcatttttttggtgttttgactggtttggacatctgacttgagggcttccttccttcctttccttccttccttccttccttccttccttccttcctccctccctcccctcccctcccctcctctttctttctttcctttctttctttctttccttcctttcttccctccctccctcccttctgacttccttccttccttccttccttcctttctttctctctctctctttctttctgtctttatttatttatttatttatttccttccttctttctttctcttttctgagacagactcactctgttgcccaggctggagtgcagtggtgcgattttggctcactgcaacctccgcctcccaggttcaagcgattctcctgcctcagcctctggagtagctgggaccacagacacacacctccatgcctggctcatttttgtatttttggtagagacggggtttcaccatgttgaccaggctggtctgaaattcctgacttctagtgatctgcccacctcagcctcccaaagtgttgggattacaggcgtgagccaccgtgcccggcaggtcatattttcctattaggcatccacaattgacaatttttaccctgctaatttgatcagtttgcattttctcaagtttatccttagggttttttttttctttctggaaagagtatatttaaaagccttaactattttcatagaaatgatagttctttattttcccagccatcatctgccctccaccatccatacctacgtttgcaacacttcgtgtttataagccatcagctggaaacaattccctctatcgggacacagcagtttttgaatgtttgccacaacatgcgatgtttggaaatgatacaattacctgcacgacacatggaaattggactaaattaccagaatgcaggggtaagtgcaatgatcagacaaaatacgyatggtagggcamgatcccatttgtgaaaggtattgaaaattctgactatcatrgagtgtttccaatgaactcattcaacagctgtttattgagcatctaccatgtgccaggcagtgtgctgggcactgtggattcccgatgaatgagacctggcttctgacccaagggaattataaataatgcaattaactgtctggagctgcctgggacagcttcccataggtggtgacctttgaaatgggtcttggaggagcagtagagaatgaggagaaggcataccacacatgggggagacatgaaaggcaggatgtatccatggacagctggacatttcagcgaggctggtgaagttctcttctgggtgaagttcctgggttaaattggagagtcctaggagatgaaggttaagactgggttgctgtctgattgttacacattttaaaaatctttacccaagtttaagaatcacagaaatatttgatttttaagaaattatgaaaattatttcgtctctaacttgacctgtcattactatcttcaagtttgtcagctgcataacaaacagacaaattataaagtttatcatgtgcacaaatagtttgtttttttcttttttttgagatagtctcactctgtcactcaggctggagtgcagtggggtgattttggcttactgccacctgggttcaagcgattctcatgccttggcctcccaagtagccgggattacaggtgcccgtcaccatacttggctaatttttgtatttttagtagagacggagtttcaccatgatcatcyggctggtctgaaatgcctgacctcaagtaatctgcctgcctcagtctctcaaagtgctgggcttacaggtgtaagccactgctcctggccaagagttattctcgtgactattaacttctccagtggtagatattacagatatccagtgaacgattcaaaacataagtgattttcagcatggaggagctaccaataacagtagtaacttgtacctttctgggcactcaactatgggccaggcactggtctcctgctacatatgtgtcatctgacytcattctcccaagtcctaaaaagtaggttcctttttttttcaatttcacctagacgtatcaactgttaatatgttgtaacatttttctctctgtttctccatagaaagatcccttttatttcctgcatcatctgaaaataagttgtatatattacgatacttgcccataaagmcttcagcctgaatatactaagaacaaggacattttatatcatcacttcatatgttttggattattaacaataataatccaaaccattctaataacataacaacaacgatatcatgcaacatttatctcagatgcaaattttcccaattgacccagaagkatctcttatacatgagttttgttttatgcaggatctaatcaagaatcacacctttaatttagttgtcatgtctctctagtctcctataataataattattattattattttgaaatggtgtctcactctgtcacccaggctggagtgcastggtgcaattttggctcactgcaacatctayctcccaggtttgagcaattctcctgcctcagcctcccaagtagctgggaatataggcacctgccaccacgcccagctaatttttataattttagtagagatgggatttcactgtgttggccaggctggtctcaaactcccgaactaaaatgatccgcctgcctcagcctcccaaactgctgggattacaggcgtgagcctagtctcctataattaagaataagtccttgcctcttttgttgtctttcattgacatttttgaagagtacaggctagttgtcttgtagaatgttccataatctgaacttgattggttatttactcatgattagattcatgttaaatattactgttaagaatacattctgcactttgggaggccgaggcaggtggatcatggggtcaggagttcaagaccagcctggccaatatggtgaaaccccgtctctactaaaaatacaaaaattagctgggtgtggtggcgtgcgcctgtagtctcagctgctcaggaggttgaggcaggagaatcgcttgaaccaggagggggaggttgcagtgagccaagattgcaccactgcactccagcctgggcaacagagtgagactctgtgtcaaaaaaaaaaaatacattctgtcatatcaggaagcacatagtgtcagctgttccatcactggccatgcttagtttgatacttagtcagttgaggggtgctagatcaccttttggtaaaggcactgctttttctttggaatagtaagcaacctgtgggtgatactttgaaaccatgygaatatccactgttgggcagtcatggtagaatccaatgatgatccttgaatctgtcaattatgacattggaggctgaaaaatggtgactttctaattctatcttttccttctacatttattcactggcttccctctatagagaagagctttccctccatccaccaktttttagtattattatagacacatggattcttattttttttttgagttggagtctcactctgttgcccaggctggagcataatggtgcaatctcagctcactgcaagcttcacctcctgggtttgagtgattctcctgccttagcctcctgagtggctgggattacaggtgcaygccaccacacccggctaatttttgttagtagagatggggttttgtcatgttggccaggctggtcttgaacttctgacctcctcagcatccacctcagcctcccaaagtgccrggatgaccgaagtgagccactgtgcctggccacatgaattctgttttatttaatgtgtggtagaaccaaaattgagccaagcagtctgactctggagtttgtacccttaattacctccttaaactacctctgagaatattgtgctcctggctccagccttgctttctcgcactgcagctcataaggacgtgggtttgggcctctactgttgaggatcttaaggaggccaggaagcagcaccatttttctttgacgtatttcctgctggcttcttccatagtctgaattgaataacagtaagatttactattttaaagccaaataatggtgtactaagtgtgaatgggggggggggttcagtctttgcattttaattttatggtttgttagaaatagactttgcttttcttctttcaaacccaccatcttagactgtgtagagatgaagtttgcaataaataataccttatgattatatgtgaaaacccagagaacttagtgaagtctcattaatttactttcaaagtgtggttgtttcttttttaatatccagggtaccacagatataagaggagtggggacagaattaagcacaaggtaactataaattgcattccagttacaggaacacacagtgattcagtggtgtgacagagacaaggatgtaactatttcatgactattsgatagcactatttattactaatatgtctyattgaataaatgttttagaagtaaaatgcccattcccatcaagaccagacaatggatttgtgaactatcctgcaaaaccaacactttattacaaggataaagccacatttggctgccatgatggatattctctggatggcccggaagaaatagaatgtaccaaactgggaaactggtctgccatgccaagttgtaaaggtatggaaatataggcgaggtcctgtaagatctctgaattgatacagtggatcacctttacttgctattttcttgttccaacacttttccacttgttgctcagacttgctaggaaactgctggcatgtgacttcaggactcacaggtgcatggggaagcctcatgcttaggaagtatccttgaccttaaacagtatgaaataaacagatcctttgtaagcattggtgatatggtgggagatcatgtgggctttctttatttgcttttaagtctttgcctctgagcactctttttttttttttgagatggagtcttgctctgtcgcccaggctggagtgcaatggcgtgatctcggctcactgccacctctgcctcccgggttcaagcaattctcctacctcagcctcccgagtagctgggattacaggcaccccaccaccacacctggctaatttttgtatttttaatagagatggggctttgccacgttggccaggctaatttcgaactcctgacctcaggtgatccgcccgcctcagcctctgtagagaagagcttttcttccatccatcattttttagtattattgtagacacatggagtctttttttttttttttgagatggagtctcactctgttgcctagctggagtgtaatggtggaatctcagttccctgcaacyttcacctcccaggttcgagtgattacagatgtgagccaccatgcccacccctttttgtgctctgtctagccaaggctcttctcattgcaaaaaccaaccacacattcgagtgagttcaaggaaattggggatattataaggaggcaacaggcaagtcgatcatgtgggcattgaagatgaagacatgaaatacaactgatactcctgaagattggaactgaaaggcaggaactattcctactttttcygtatctcaatggtctctcccatttccgtctctctgcttattcatcttgaacatggcttgatatacaccagaccctctcagttacaggattcatcaccaactggcatctttcctggagacactggttccttttgagttaggtgtctacccttgatcccatcagtgtcatgcataagtaaagaacaacaacagcctagcattagaactctgctcaggtcactatgggctggacagtttaagcagaaagaggaactctggggcagcaggcaagatgacaaataactagcatcttaggttacagttccctagaagcagagcctgagacggggattcgagtacagttgatttagtgaatgtctcaggagaagaaagagtgaggcagatttgcgagggtaaggcaccggttctcaaacttcgctgtggatcagcaacacctggaaggcttgttttaacacaggatttttgagctccactcttagagtttctgatttggtagatctgggatggggcctgacaatttgcatttatgccaggttccctggtgatgctaatgctgccgagccagggagaaatgtggtctctgctaaaatgaggttcagtttgatcccactgggagctctggagtgtgaattccacccttgagttaatcccactaagagccaaggggacctgctttttatattccctcatcagtcagtctttggctttgagctgctcccttccctgaccctgggggtggtttgcataaactcctgggagaggtggcttccctatggctgaaggcaatttttcagagtatttatgagctgttatcagccaacactcacaatggctggtggatagatgcacctgcttaatgaatgcaatctgagagggcagagtaggcttacatgaaatgtcaatatctgttagttgcttttttttttttttttcactgaaatggaggctctgatgcttctgttctgaccttctgtggctactgtaggggaagagaaggccatcttggaagctatgaataatggttctattgacagagaactgcaattagcaatcatattaccattacttactatatatattyttggatttttcttgccttgaccaatttgtgtaggtgtactcatctactgtttcaaatgctatactctctttcagaaagacttcctgaactcttaagtcctgattacaagtattctctctttcagcatcttgtaaaktacctgtgaaaaaagccactgtggtgtaccaaggagagagagtaaagattcaggaaaaatttaagaatggaatgctacatggtgataaagtttctttcttctgcaaaaataaggaaaagaagtgtagctatacagaggatgctcagtgtatagatggcactatcraagtccccaaakgcttcaagggtaagtctgcattggaacgtttagctaggactcccacttgccygtcatcataatcagagcctttgttctataatgattgtcaaaaaccagatgaggccaggtgcggtgggtcacgcctgtaatcccagcactttgggaggctgaggcgggtggatcacctgaggtcasgagtttgagagcagcctggccaaaaaggtgaaagtctgtctctactaaaaatacaaaaattaattgctgtggtgccgggtgcctgtaatcgcagctacttgggaggctgaggcaggagcatcacttgaacctgggaggtggaggttgcagtgagccgagatcgcgccattgcactccagcctgggcaacagagcgaaactccgtctcaaaacaaaaacaaacaaaacacagatgaatttggccactgggtttttaaaaagaggggtgagagggagaaacaatgatatgaagcagtgagctgcagatggcgtccccacttgcattttcctttccaattttttttttttttgagacaaggtctcactgtcacccaggctgaagtgcagtgktgcgatcacatctcattgcagcctctactttctgggctcaagtgaccctttcacctcagccttctgagtagctgagattacatgcacgcaccaccatgtccagctattttttatatttttattagagaagagattatgccatgttgccaaggctggttttgaacccttggactcaagcaatccacctgtctcagtctcccaaagtgccaggattacaggcatgagctacgcgcccagcctcttttctaagtcttttctgtaaaactcagggttgtggttatattcaatgaatgctgaggtgaatgatgccatcttgtataattccaagttgagcttgaataataatgaaccaaatattgaataataaaatatctacctcatcttggtcccacattatagagaactcaccccaagtgacaaaacaactcatggcaatgataattggtctaaagatctaacatttcccctttctcmagcaattcgtagagtttgaaaagtatccattagagcaaagtatccattagagcaaaatattttaaggagaatgataccaggtttgtgtgagataaagaagtgtgtaatggccagcgtttagagctgctaaccttttaaggtttcagatttagggttgaaatgtctctgatgccagaaagtaagaaccagccagaggctgaagctgtccttggctctaggtttagaaatctttcaaaaacattgacaatcttgttttagcagstgggagaggacagtagggagcagacaaagctaagaagagaggagtctgagaagtgtccagctagtgggagagaagggaatgataactgattaaaaatacccacctcatggggttggtttgattattagaaatatgcatgacatggaggaatataattttaattgtaaatagttacaaatgcactgaataaattgccattattcaaaagacagcagagccctggtgagatgttaaatacaaaacatgacaaaatacaataagcttaaataaaaatcagtagaaaaaatgtgagaaaagaataattgaaaaaagtcttagctttgttgatatatttcttcaggatcttctcccttatggtctttggacagatgcagtactgtaaagggccgatactgttttttcccctttaatcttgactgttatagaacagtcttcactgtatatagaacctttaattttatctcttgaaaatgaggatcttggccaggcgcagtggctcacacttgtaatcccagcactttgggaggccaaggcgggcggatcacttgaggtcaggaggccagcctggccaacatggtgaaacccagtctctactaaaaatacaaagattagccaggcatggtggcacgtgcctgtagtcccagctactcgggaggctgagacaggagaatcacttgaacctgggaggtagaggttgcagtgagctgagattgtgccactgcactccaacctgggcaacagggcgagactctgtcttaaaaaaaggaaaaagaaaaagaaaaagaaaatgagggtcttatcatttccctaatgttttctcccatcacttaaacctcacactaaatggtttcattcacataatcacatgtattctatatactygtaaaatgtatttggtttggcttagctatttacyacatttaagaaatgattgtttctcttagaatgtttatctttttctcccccaacagaacacagttctctggctttttsgaaaactgatgcatccgatgtaaagccatgctaaggtggttttcagattccacayaaaatgtcacacttgtttcttgttcatccaaggaacctaattgaaatttaaaaataaagctactgaatttattgccgcacccattgcagtgttagcttcatggtagcttacttttagttatgtcatttggttaagaaatgcaaatatttggaacgtcatcattctatggctgtgaagttggcagtataaacaattgtctgggtgtcccacttttcctgtgcgtaaccctgatctcggctgggtgcggtggctcacgcctgtaatcccagcactttgggaggcagaagcaggtggatcacctgaggtcaggagttcgagagcagcctgggcaacatggtgaaaccctgtctgtactaaaaatacaaaaattagctgggcatggtgatgtgggcctgtaatcccagctactcgggagactgaggtaagaaaattgcttgaatctgggaggtggaggttgcagtgagctgagatggtgccactgcattccagcctgggcgatagagtgagactgcatctcaataaataaayaaataaacaaacaaacaaacaaacaaacaaatcctactttcaagcactttcacgtaaaacacctgcaatacaatatttttcatagaatgggccacagaccccctccttccgttactattacctatctgcttatttcaaagaacaagtgttgtgccccagaattgttaagaatggcccagagttctgcatttatgacaaagtttccagatagttcttgcgcatcctcaagtttgagaagcattgccatacagaagtaagcatggacttccaggtcaataggactgaatttgcatccttgatgctgggtttacatagtgccaaaaaattttttctgtatccactacaattccatgacccatcattgacgtcgttcctttgcatatattcaactcccttgctcttctctcctttggtagtgtttgctggccaaactcatccctggcaccatctgccttccttatgcctgcacctaaggaactgaacgtggctggaaaaaaaagagaaactcacaaccatgccaataggtcccattttaaattcataaacacaaactttacatgggcctccagctctacccgacaatcctattatatttctctagtttgttcactcccttactctctaaagtggctatttcacttctcaacctttctcaagccaccttccttctcctcacccttagctgataacttggctccttatttcactgagaaaatggaaaagatcaaaagatcatttttttttaatctttccactcccgaatccatcattctaccagcatcggcaaccacagaatctgccttctgtcaggttacaatggatgaacatctaaggacaaaccctctctttatgtgctaggtcccattttctctctcctacttaaggattttactcctctaattaatgcttatccatgtttattttttcctttctattggaacacttcaatcagcatacagatatacagtaatatcacccattaaaaaaagaagccctgttacttcacatctttcttccagctactgctccaactctttagtccctgtttttacaaaagtcctggagttatttcctctgccatctgcactaggtactacccatcacttctccacaatctgcattctccataggatttccccacccatgcctctttctcagaacttaacccgattccgtgtgatgtggaccagatcttttctccaagatgcttctctgctcctcctccttttacagaaaccagagtggctcccctcccttctaggctttcattcaaaagctccaaattccctttacttaaccttaaaaaacaattttatgggcaggtgtggtggctcacacctgtaatcccagcacttttggaggccaaggcaagtggatcatctgaggtcaggaggtcgagaccagcctggccaacatggtgaaaccccgtctctagaaaaatacaaaaaattagctgggcatggtggcaggtgcctgtagccccagctacttgggtggctgaggcaggagaatcgcttgaacctggcaggtggaggttgcagtgagtcgagatggcgccattgcactttagcctgggcgacaagagcgaaactctgtctcaaaacaaacaaacaaacaaataacaacaacaacaaaattttactttttcttcctcaattctttccttcagactctgtgtatgtgtgtgtgtgtgcgtgtgtgtgtgtgtgtgtgtgtgtgtgtgtgtgtgtgtgtgtgtgtgtgaaggtggagtttgagaggttgtggtatttcccctttgtaaaccaaaagccctatttagggatttttgccaaacaaaaaaccatctgctctggtttcctcctctcaaagcacaaagctttagaaccattgttttctttaatttgttgcatgtcagtttaaaaatagacctctcttatcctacctaacagctctagacatggaaggagggcagtaagcatttagaatgtcttctcttgcccacacatagtcactgcattggctctgaaaaaggggagagaatatttttgtattatcccaccttttgttgcaaatgcttcataattcattttattgtttttaaatttaaaatatatgttggaactaataaacaaattcagtaaatttccaggatatgaaattaacatacaaaaatcatagcatttctatacactaatagcaaaccgtctgaaaaacaaattaagaaaactcccattcacatagctacaaaaatatataaatatacttaggaagaaatttagccaaggaggcgaaagacttgtatgctgaaaaatataaaatattgatgaaaggaatttaaaaagacacaaataaatggaataatattaatgttcatagattggaagaattaatattgttaaaatgtccatgttacccaaagtgatctacagatttagtgcaatccctatcaaaattccaatgacatttttcacagaaatagaaaaaacaatttgtatgaaactacaaaggcccctgaagagccaaagcgatcttgaatgaaaagaacaaagctacagtcatcacattatctaacttcaaaatatactacaaagctatagtaatcaaatcagctggtaaaaatacagacacatagaccaatgtaagagaataggcaggtcaaaaataaactcacacattatagtcaattgattttctacagaatgtcaggggttggccagggctgcagtcttatctgaagggtcaagtggaggaggattcacttccaagctcactcagtggttgttggcatgattcaattccctttgggctattggaagagagcctcaattttttactgtttacctgtgacttccctcaattcattgcccttcagtccttaaaggaaaattggatggcacagtacagtacccatgacaatacactcttttttttttttgcttgatccactgctttgtatgctttctgagaatagctcctccaggattctgatagacctcttttcttgggtgaaactcagtagagtaaggttagtgagataaactacaacacctgatgctgcagttggccttcgaactgcaactgatactcatcttcttcctccaccaccatccatttcgtattctcctcayccttggctggctcttctgttggtctcagtggctcttctggtggtgtgacaaagaccttcatccttgaggggtctgaaaggcctctatgcctttctgatgtttctatgatttttataatcaaaattgtatcaaggagtactgaggaggcagcagccctatttgctcctgatgatcagagtcaatgaccctttctaagatggtgagatctttgcttgctggttccttggcaaaaggagcccaaagttgccaggcaccatctgtagtttatagttcaataggacttgctgtgcccctagtggaagtgtttcccttttggaaacaaggccttttaaactatttatagatttcagatgtggaacaaaagcataagtgtccccaagtgagtcaaggggagagataataacttggccactgctgcttcaaatccttgattcccagacccatgtattgttcctactggggagacaatgaagatgtttgatttaaagtatatacttcatcatagaggatcatatctcaaagctggtgctttgattatgctttcaacaggccatttcaaggttctatcagctggcagcttctggatggtttggtaggtaatgtgatcagttggtcctgtggtcaggggcctattgtcatacctcctttactataaaatgggttatctggtctgatacaatgttatgtgggatcctgtatcagtggattcgaactccgtaagtcctcagatagtgatgcaggaaaaacaaatgcatatccaaataagtattgattcccagcataatggatctgtactccttcagtagaagtaggtccaatgcagtcaacttgataccttatgtgccagtggatctgcttgtgagatggtgtcatcttggaggctcaacattggcctctggtctctgttgcttgccaggttggacattcaaccaaggcagcatccagatcaatctatataagtaggagaccatgctgttgggcctatgaattatctccatccttgttaccatagccatttcagtcatgtggccattatgccagcactggggtggccagtgttagaggccagatgctgtcaactggctgagtctttttctctatctggttatgtagtaccttgctagtgggagttaacatgtgcatcaaagatcttcacactttgtgcccaccccatttattcattcacatgcctctactcctagtcctctttgtacctgatctacccatctttcttctcacctctcagactctgtcaagccactacctatgagttcatatatattctaatcataagccacttctttttccacacaaggaagatgaccatccaaaattcttcccatggggaggactttttctcaccactgtttttcaagatgctctttgaataagctgtattgtagctgtcatccttttttttacctacacacatgtacagaccttcatatccatgaaccaagctcaggctttttcctccgctctaagctggtcctacgggatcatatggggtcatatggctatagatgtgcacttaggaatgccattagtacaacagtgatggatgatgtggagttttgaccttctgatcacgtagcttcagggtatatccattatcatcttatcatgagttgttgctaggcacacttgacctcatgacttggtgggtatgacagaatatagctggtgatgggcagctgtaactgcctggtcacttggtgccaagcatctagtatattagaaattgtttctcaagtggcatctaattctccactgtagatgagatggccctgctttttagtcttcttagatctagaagagttcttccatttttcttcctcctttcttacaatctatatatatttgagatggagtcttgctctgttgtcctggctggagtacagtggtgtgatctcactcactgcaacttctcctgcctcagcttcccaagtagctgggattacaggtgcccaccaccatgcctatttaatttttttttttttttttagttgagacagggtttcaccatgttggccaggctagtcttgaactcatgacctcaagagatttgcccaccttggcctctcaaagtgctgggatgacaggggtgagacactgtgccccctcacaatcttaatatttttaaagagtagaggacaatcatttgggtttgtctgaagttatgttatgacgcgatttcagttgtattgttgccgggattacaagagaagtgagattgtaatcttcttagtgcatcatatcaggaagtacatgatatcaatttatgccattactattggtaatgttaactatgattacttggctagaaatctgatgtctgccagatttctacattgtaatcttactatattgtcctttgtaattaattaatcagtatctcatggggagatacttcacaactatgtggatatcctgtttttcatcaaa

SEQ ID NO: 12253 - DNA, 129011 bp, Homo sapiens
acccaggctgagtgcagtgacatgatcacagctcactgcagcctgacctcctggactcaggtgatcctcccgccttagcctccctagtagctgggactacaggtacatgccaccatgccccggtaatttttctgtagagaaggggttttatcctcttgcccaggtgggtctcaaactcctaggctcaagccatccgtcagcctctgtctcccaaagtgttgggattacaggcgtgagccactgccctggcctaacaactgtttaactataataaaaccagtactacttggcaccactgtaatcctaaacacaaaagcaaattacagcattttccctaagacaaaaaaaacaaaacaaagcagtaagtactagctgtattagttctaggacagtactgttttaagtgttttacattcattaactcattaatcctcaaaacaagtatgatgctcatttttacggaaacagacactaacgcccagggcttcaaccatttgtccaaggttaaaaaacctagaagtagcagaggccagagaattcaaacagattggctccatattctgtgagcttttaaatattttaacatatttgaatcagctttcacaaacttctcctagattactatgcagacttgaattatggccaaggatacttgtttaaaaagccactgtaagtaagatgtgcacctgtaatctcagctactcaggaggctgaggcgggagaactgcttgaccccagcctgggcaacttattaaaaaaaaaaaaaaaaaggcctggcgcggtggctcacgccggtaatcccagcactttgggaggccgaaacgggcggatcagatagagggcaggagatccagactatcctggctaagacggtgaaaccctgtctctactaaaaatacaaaaaaaatttagccggccgtggtggcgggcgcctgtactcccagctactcgggaggctgaggcaggtgaatggcgtgaacccgggaggcggagcttgcagagagctgagacctcgccactgcactctagcctgggcgaaagagcgaggctccgtctttttttttttttttttttttttttaaaagagcattatagatgatgagggaatcaaagagatttgaaagtaacagttgcaaagctaaacttatgataaagaatttcttagaaacatttattcaattgtgccaacgatttgctatgagacataacatttgtaattcctttcaaaatggtctccaaaatgcttcaaatgtaaaaagaaactgcttgtttggaaccacagcaaaaaagggaagacaattcttgatgcaaataatagtctttcattagtttaggaaaggctgctttcccaataaaataagccaaatagcaattctatctgaaaactctgctgaaatagtgagtcacttattgggaccacaaaatatatttttagcaaactttactttttggtaacaggaattacggagaaaaagtttatcttttataatttttctaaaaattcggatccactaaaatcaggattctgattgtataaaacaggttttactttaagaaaacaaaatataataaattctgaatgtacagaattagatagtataaaaaacttactttacataacaaggtattttcagtggaagaggaaattagcgatttgacacaaagtcaaattttattagagatctgacaaagtcaaattttattagagatttgacataaagtcaaattttaatatagtgaaactaatcagaggtgctggggtactttaaaagttaaggaacttaaaaaatatcttggcatgagaggaactcctaatgtttgacgtgggtctggaggaattaggttggttagaggatgagagaacttctattctggtagaggctataaaatacacttgttggtagaacctgtcaatgtatatgacatgctataaaccatggagttggtcaaatagtagtgcttgggaaaatctgagtaaaatatattctacatcaacaacagaagtagacagaaaattagactgatttgtggtttaatttggtgaaatctctgaactctataaagtaatgaataattaaacataacgacagaggtgatacttcagaaggaaaatattaacacaaaaacaaaactgagtgctaaacatcaataagcaaagaatatcataattattaactctagttaatgtacacatcaaaaatacacaaattttttggccaggtgaggtggctcatgcctataatcccagcgctttaagaggctgagaccagaggatagttttgaccaggagtttgaaaccagcatgagcaacatagggaaactatctctaccaaaacacacaaacaacccccattttacagttttggtgcttaatactttttctaagcaaatctgaaagcaagattgtaaataattatatattgttttgatatatctgaatgggaagacaatttaaagcagacaattttaaagcttaaaaaattcagatcttctaatccagtctcttccaatttcagttagtaaacagacaaaggaccttatcctatttcatacagctgcatattagttagatacaaatgtccaacccgcggccaggcacggtggctcatgcctgtaatcccagcactttgggaggccgaggtgggcggatcacttgagttcaggagtttgagaccagcctggccaaaatggtgaaacctcatctctactaaaaatacaaaaaaaaattagccaggtgtggtagcgcacgcttacaatcccagctactggggaggctgggcaacaagaatcgcttgaacccgggaggcagaagttgcagtaagctgagatggcgccattgtactctagcctgggtgacagagcgagactctgtcacaaacacaaatgtccaaccaactggcccattaaaaaaaatggcagcgccaggtgaggagagtagtggtttcttttcttttcttttttttttttttttgagacagactcctctgtcgcccaggatggagtgcagtggcatgatctcggatcactgcaacttctgcctccaaggttcaagcgattctcctgcctcagcctcccaagtagctggaactacagacatgtgccaccatgcccggctaatttttttatttttagtagagacaaggtttcgccatgttgcctaggctagtctcaaactcctgggctcaagtaatccacccagctcggcctcccaaaatgttgggattataggcgtcagccactgtgcccagccagtaatttcagttaaatgcaaagggaagccttaaggttatagaagtattaaaaaaaatcaaaagaccaatgataatgactattgtggcttatttttacataaaggacataggccttgtgacaattcacagaacactctagatttttctcaaagtagcacagacttaaagaaaaaaaagccagatgcaatggtgaccacctgtagtcctcgctgttcaggaggctgaggcagaaggatggcttgagcccaggagtttgaggctgtagtgagcataatcatgcctataaatacctactgcactccagcttctaaaaaaagaatttttttttttttttttttttttgagacagagtctcactctgtcacccaggctggagtgcagtggtgcaatcttggctcagtgcaacctccacctcccgggtttaagcgattctcctgcctcggcctcccaagtagctgggagcactggtgtgcaccaccacgcccagctaatttttgtgtttttagtagagatggggtttcaccacgttggtcaggcttgtcttgaattcctgacctcataatccgcctgcctctgcctcccaaagtgctgggattacagatgtgagccgccgcacatggccaaagcattttttttttgaaataaaattgttagatacgtgaaaagttggtgtagcaaatgctaagactgaaagaaaatggaatgacaatttggtagtgacctctaaaaatgctagttttagtcgctcgcttatagtaagttttcagggctgcatatcagcaagtttttttaaattaaaaaaaacacaggtgccaagagtaaaaaattttaatgacataattcttcaaacatctgccatattcactccaagtgtgctctttggatacaacaacaggtattaaagtattctcttccaagcctgctaaagttatatctgattcataacaaaattttacataggtatttcaatgtatcaatattttgtggcattaatacaaagagaaatttgacgtcccagaaaaatatttacctagataaattcagaacatttggttcacacatgtaatcccagtattctgggaggctcaggcacgaggattgcttgagcccaggagttcgagaccagcctaggcaacatagtgagaccctgcctctagaaaaaaaaaaaaaaattagccaggagtggtgggatttccctatagtcccagctactgggaagctgaggagatctcttgagcccaggaggtcgaggctgcagccagtggtgaccgtaccactgcacttcagaatgggcaacagactgagaccctgtctcaaaaaacaaacaaaaacagaaaaacccaaaccaaaccaaaccaaaccaaaaaacccctaacacttgcaaatagaaagctatgtggtaataacatccattaacttgacacatcttgttttgacatcatagtgtcacttactgtttcaatgaaatggtaatgaaagaatataataaagtattgcaagttgaatgcttgaaggtaattggaataaaaagtttaaaaaaattttgctttttccgggacttcaatttgaagtaaatgagttaattactacatggtaagtgtcataagagtacaatatttattagcctgcagtaggtacacgtggacaggaagacttttcagcggtccactcccccaagagggaattttcatttccgcgaggttacaaatgttcttcactacaggaaaactcaacatagaagctcatgttctggggactcaaataacagtcgtaatacatgaaaactgtaaaggatattctgcataaagggtcgttaacatctcacaggccaaatagccctctcagaaacaactaggaaaggaaaaagttcccttggagctgtgcgtttgcgtatgtccgtgtgtgtatacaactgagggagaacgaatacgagagagggaactcgagtctgaagtactgtggtgtgggcagggtgacatgtaatactgaaggaaagaagtctgctggtgaagtaagagccacagttaattttccgaaaggaagatgagtaagtgcacctgacgttattctacgaaagctgcttctgcagggtgggaatgttgggaagcaaggtctagtgcgacagaattgaaaaggtggagagcaggtgattgctggatccctaatgctcagcaagggggacgcatccacataacgtgagaacgaacgaatgaatgaacgctgcataaaagcagctttggcttggggaaggtaagagtctgcagagaaggtcttggggagaaaaagcaaagaaaaccgagggaagaggccgaacccttagtgtcaggaggaggggtggctgcggggttagtgagggcactgaccagagagaactcggtgccgggccagttgactcggaaagggatgtcatcgctgagttgaggaagggctcggccgccgccggacgcctccaggaggccgcagaggaccagtaacaccggcccgcccgggaccagactccgtacgccgccgcctccttcctccatcctccgccgccgctttctccagccaccgccacaacctcctctgctccaggaggagaggaggaggaggaggaggtggaggaggaggcggcgggactataaagcgcccgggtatcaccggcccaaccgccgccacgtctccttccggagagcccggcaacgccgcctccgcccccttgagcctcctgtcaccgtttccggggcagacgacatatcaacatccgggggtcgcggagccgtccgcctacgggggccgggacgtcgcctgcgcgtctctcgttttcggacggctgcagcatcgcggtgggratcgaaagcgggggcttctgggacgcagctctggagacgcggcctcggaccagccatttcggtgtagaagtggcagcacggcaggtcggtgagtctcggaggcggcagccgcttcctgaagccattcccgctgctctccagtgggcaggcagaggtttgacccacacggagtgatagcgggaagaagacagtgtgaaccrtgcgggtgcgggtccttagatgagaaaattcgaagtagcgatgagatgtgagaaatggcggtgttcctgactgacctgccttcttgcagcttttcttctttttctccgcatttggcatttgtacacttcatttttcccgcttgaggcttatctccatctcttctgctgtggaccgtggccatctcgttacttaacagcttctgactaacgcagggcagtttgttcagcgactgcaactctgtgttaggggaaacctggggtgaggtagcccgccatctccccgtaggtgaataccgcragcctccgaatttggcrtggtgggcgactctcgtggaatgggcagctagacatcacaaccctacatttttaccctccatctctagattgaagtgttggggtgttgttttatcaaggaagctggtaaggttccttatgtgaggtttagcgccagatgaatgtgtgtgtttatgaactaagtcacgtctgactgcatccccaaattagacaaaaagttttgtttttccctccccctctttagaaaaaatgccattgtctgttttgatctccaatataatggacatagagtgttggctttagagaaattaccattccctaaagctcgacagtcttgctagatctgttaaagactggtcgcccccacttcctcagatttgaaccaaatcaaaaagcaggaaggacagtcccatattctatcttaaaaatttttttttaacatcaggaatccatagtatcaaagaagataactttcttcagaattgttattcgctaattatattcagcacttcttattaatgcttaatgtgatccagactcctgggatttttgttgttgttgtttgttttgagacaaagtctcgctctgtcacccaggctggagtgcagaggcataatcttggctcactgcaacctccrcctctggagttcaagggattctcctttttctcagccttccgagtagttgggattacaggcgcgcgccgctacaccctaatttttgtatttttagtagaggcagggtttcaccacgttggccaggctggtctcgaactcctgacctcgggtgatccgccctcctcggccttccaaagtgctgggattacaggcctgagccactgtgcctggcccccctgggcttggtaaaatgccaaataaatgggtttctgtctttggtcacacagtctaggcagggagattgtacaaacaaataattgcaaactattatagtagtaatagtcaattttttttttttttagcatttattctgtgctaagcactagtcttaagtcatgaaggaaaagagatgtatttgacggaataaaaatgaaaactgtctgtgaggtcctgttttagcatttagggctatagtgattgaatctgtgttcaatagagctgatgttcaagtaagaggggaacttaaataagtaaaataatttctagtattggtaagtgctgcaaagaaactaaggttatgtgaaagacaatacctgtaggatgtgttgcttttagtacgtaagtcagaggagacttctgtgaggaagtgacatttgaattgtgacttgaatgatgaaaagaagggagccagacaaatttctaggcagaggccctgaggcaggaatgagcttgatgtgttggagtgatagaaagaaggccagtgtggctggagtgtaagaggaaagtggtagaagaagtttgagaagcagaaagaggccagggagacagctctgtaggcaggagagtggacaggacccgatgtacatttgtgaagatcattgtggctgctgtgtggaaaattgattgtagggggtgttgtgggttgaattgtgttccccaaaaagacatgtttaagtcctatcccctagaacctgtgagtgtgaactacttgggatagggtctttgcaaatataattcaagtaaggatgaggtcatactgaatcaaagggggccctaatctggtgactggtatctttataagaagagggaaatttggatacacatggacacacagggagaatgccatgccaggaaggaggaggcagcaagattgcagtatgtgtctataagacaaggaatgctaaagattgccagtaatcaccacaagctaggaagaggcaaggaagaatccttctttagagctttcagagagagagaatagccctgctgacatcttgatttctgacctctagtttctagaattgtgagacaatcaatttatgctgtctaagctgctcagtttgtggtcatttgttacagcagcctcaggaaggtaatagaggatgaaaaccaaaaagtagttgagacaagtctcaaccagtttagaagtttattttgccaaggttaaggacgtgtcacagacagcctcaggaggtcctgacagcatgtgcccaaagtggtcgggctacacttgggttttacacattttaaggagccacaggacatcaatcartacaagtcttttatgctttatttataggttgattcttaaacattgaaaacttatcaactatttaccatattgtaattatacaatcatcattcgctataaaactattaagtatgattgcatctgcagagaaaaaatgtaattctacctctgccaattaaggtatcctattagcttcctaataatggcaccatgtttgctaaaataaactcattttgctcctgaagctgtatttccagctctcacacatgtaatttagactagttgctttacaagtcagttgcatacctgtttactgagatttttttgtatcatgcctgggttaggtctactgctttatgtattccatgtcctcatttgtcatagatttttttcccaccttgtaggggtataactaatttcaagcaatttttttcaggaaggattaaacaggtaatttaatttccacagacttcatatgtctgaaaatgcctttaccttgcctgctcatttaatgatagcttgggaatagacttagtccacaatcattttgttttcttcaaaactctgaagacattctcttgctttttgtgtctagtgtatctgatgacaagtctaatgccagtctctttcttttgcaggtatcatacttttttctctggaagattttattagactgttttctttatcattggttctgtgatattttatcagtgtttctaggtggtgaatcttttttcattcatccttcttggcactctatgaatcctatttttcacttctgggaaattttcttcaattatttctttaattatgttcttgacattttctctgttctattcagaatttagataggttcttccaaatacatttagatagattcttccaaatacagaggaaaaatataaaaagaaaaaatacataatacgaaggatcaatccaagaggtccatttccttgattttcagttcttttcactttcttttttcagtggttttttccccacagtttctagtcatctagttatttttaatggatgcattgttctcatgacatgaatttctttgaggataacacttataacttttaaatatttatgtcccattcccggaaatagctctgcttctttcaggtcagttgtttattttcatcctttctgtctgttgtgcttttacttcaaaaaaaaaaattcttggcggggcatagtggctcacaccggtaattccagcactttgagagatcacctgaggtctggaaggtcaagaccagcctggccaacatggtgaaaccctgtctctccgaaaataaaaaaattagccggaagtcttggcaggcttctgtaatcccagctactcaagaggctggggcaggagaatcacttaaacctgggaggcggaggttgcagtgagccgagattgcgccattgcactccagcctggatgacaaaagtgaaacttcatctaaaaaaaaaaaaattattgagctcttttgtaagtgagcagggtactagctgttgggtctaactttagggtccttgagtgaagtgcaagaaacgagttrcctctttcctcctctccttccaccctgtacccaaataaggaatgctttgttatggaacatgaagatgctcaaaggcttccagggtagactgttaaattaaaaagagcaataacaacaaaatagatgtggttttagccagaaacaaatactgttgctgccaggcgttttgtgtgtaaagggctgtggtaaaaagtttggcttgctgtttcatataaatattataataattctgattttagtcctacgtccttcctctgcttgtttctaagattggtacctctccaggctctgctggcaagaatgtcttctacattgctatagccttctcatgtatgcatgtgtgtgtgttctggactgcagttttctctgcactggcttaatcctcagcataatcctacctgctttctcttccagaatgaatgagtgcatttcagtgcgattttgttaggaagcggaggaaaatgtatgtgcttagtttgccttgcatagagtgagtaatccattgtttttttgtttgtttgtttrtttttgagacagggtctcgctttgtcacccgggctagagtgcagttgcatgatcactgctcactgccatcccaacctctggggctcaagcgatcctcccatcacctcagcctcctgagtagctgggactacaggtgtgcaccagcctgcctagctaatttttttattttttgaattcttggtttcccagagtgttgggattacagatgtgagccatggcacccagccagtacttgttgaataaatcaatgctgttgaaaaaattgggcaaggcatactgttgtttaaaaagaaaattatggctgtaggagataagtaattaggtgaatcttttaaatcctgttttaaaaagtcctattttattttgtcctaattaaaaaagaatctccgccgggcgtggtggctcacgcctgtaatcccagcactttgggaggctgaggcaggcggatcacctgaggttgggaattcaagaccagcctgaccaacctggagaaaccctgtctctcctgaaartagaaaattagacaggcgtggtggctcatgcctgtaatctcagctactctggaggctgaagcaggagaatcacttgaacctgggaggcagacattgtggtgagccaagatggcgccattgtactccagactgggcaacaagagtgaaactctgtctcaaaagaaaaaaaaaatggaaagaatctcaaaggggttaagccctaccaatggaggtacaaaatgagataactaccatctctcacttttttttttttttttggagacagagtctcactttgttgcctagactagagtgcaatggcatggttttggctcattgtagcctcaacctcctgggctaaagtgatcctcccacctcagccttctcagtagctggaactacaggtgtgcaccaccacgcctggctaattttttttgtattttttgtaagagatagggttttgccatgttgcccaggctggtcttgaactcctgggctcaagtgatttgccccctcaagcctcccaaagtgctgggattacaggtgtgagccacttgcccggcttccttttttgttctttttaaaattgtaggccttaatttcattttgttcctgttcagtgcttagcacagttcctggcatgttgtaaatgttcaataaatgatactacatttgttttacttaagcaattttcatcatcgtagaaaataaggattaaatgagttaatatacataaagcacttggaatagaatctagcatatagttagtgctacataagtgttaaccattattctctgacacatgaacacctttttgttttttctatgaagctttctctgattctgctactttgaattggtaatttgcctttctgtattctggttgtattttatttatttgttattagttttagagacagagtattgctgtgttgttcaggctgaagtgtaggggccttatgatagctcactgcagccttgaacttctgggctcaagagatccttctgctttatcctccagagtggctaggactgcagacatgtgccactatgcccagctaatttttacatttttgtagagacatggtctcactatattgcccaggctggtctcaaactactgacttcaagtgatccccttgctttggcctcccaaattgctgagattacaggcaygagcaccatacccacccctctgcttgtattttatatcacatcttttatattaaataacatagatttgtttgcttgtgtgtttctccaccaaatatgattcttgatagccggggactatcttatttattttggtggtctcagtgcatagtcattgcttgccacataacattagttcgctcatttgagctaggtcttaaagaatgaggagggtggtgtgattggagcatgaggggcaggggagtacgtcagtgggaagtgaaatttgacaaatacactgataccagattgaccagatggtaagtagttgaatgccagattaaaggatttgaatttattttatatgcagcaggaagacattttgattactgacctcagtttcatattttaggtaagtaattctgagtgcacagtagagcgtgtattggaaagaggaaaagagattggaaacaagaagaatatgtaagaaactctggctcttgakgtatgataaggctctttagttgagaatctttcagcatgtaaccttttactatcatgtaatcttttaagccttatcacaaaaagccttcagggcttccttggtaacttcattttgactttgttaaaagaaaaactttagacgaaatcaatttatcagaatttgtttttgtgttaaaggattaatgaatttggcagcacccaaaattagaagtagttcagggagctcttgttttaacagagtaagcggcagacctttgcaggctgaatgtggaagcgaagtaaagaaattacttgattggactgggcatagtggctcatacctgtaatcccatcattttgggaggctgaggtaggtggatcacttgagctcaggagttcaagaccagcctgggcaacatggtgaaactccatctctacaaaaaatgcaaaaattagccaggcatggtggcacatgccagtagtcccagctacttgggaggctgaggtgggaggattgcttgagcctgggaggttgaggctgcagtgagttgtgattgtgccactgcactccagcctgggcaacagagcgagaccctgtcttgaaaaaaaaaaaattacttgattgtcatagctacttgtttgtcttatttgggtacaatctggcagaaagttgcttgttagagaatagttgttggtttctgattaaaattaagttgtgacatcctatggattgggaggaaatatttgcaagccatacatgagataagggattaaaattcagaatataaaaggaactcaaataactctatagaaagaatacaaataatccagttaaaaaatgggcaaggaacctgtatagacatttctcaaaagaagacatacaaatggccaacagatacatgaaaaaatgttcaacattactaatcatcagggaaatgcaaattaaaaccactatgagatatcaccccaatatgtgtcagaatggctactatcaaacagatgaaagataagtgttggcaaggcatgtggagaaaggggaacctctgtacactgttaatggcaatgtaaattagtacaaccgttatggaaaacartggcagttcctcaaaaaactaaaaatagaattaccatatgatccagcaatccaacttctgggtatttacctaaaagattggaaatcagtatgttgaagagatatctgcactcccatgttcattgcagcattaatcacaatagccaagatacggaatcaacctaagggtccttagacagatgaatggataaagaaaaatctggtgtacatacgtagtggaatactattcagccttaaaaatgaaagaaactttgtcatttgtgacgacatggatggattggagaacattaagctaaatgagataagccaagtacaagcagacaaacaacatatgtgcttacttatatatttaatctaaaaccgttgaactaaaagaagcagagagtagaacagtggttaccagggttggagggaaggcatgggggaatggggagatgatagtcaaaggggaggaatttttttctttgagatatgttgcacagtatggtgaatatagtgactaataatgtactttatacttgctaagagtaacttttaaaagttttcactacaaaaaaaatttgaggtcatggatatgttaactagatttaattattccacattgtattcataaatcatcactttgtacctcataaatatataactatagtcagtttataattaaaaaataaaaagcaaagattaagttttgtttcactgtttacattgggcttcagtttgcttacataggaacccagagtcctaggaccatcttagccaaatggcctccaattaaagattgcttacactctttttttttttttttttttttttgagacaagaatcctgctctgttgcgcaggctggagtgcagtggcgccatcttggctcactgcaacctctgcctcctgggttcaagcaattctcctggcttagcctcccaagtagctgggactacaggtgcccgccaccacacctggctaatttttttgtatttttggtagagacggggtttcaccatattggtcaggcaggtctcgaactcctgacttcaggcgatccacccgccttggtctcccaaagtgctgggattacaggcgttagctaccacacctggccaagattgcttacactttttaaaaaatgttatattgtttttagtaaaacaaagggtaaaatttaataaaaaggcacaaacacattttgtgtatattgtgaaaataccatctatttcctccaaaagcttataaattgatatgagtatcataaacctgtttatttttctcctggactaagtattgttcaacgtttaatgtgtattatgtacagggaggtaatgtgggaccagattttctggttgggaaaggagatgagtactggttttagtacaataagtttccatgcttgtgtagcacaactggagatgccttcatgtaacagacatatgaagaggttgagagagtaggctggagattggaagctatccaagtaaaattgaagcctaggatttgatgastttgtgtatttgataaagaatagtgtaagagttgtaactggaaacacaatgaaatgtttttgtctttggctttagtgacatgggatgcttgatcactagtgtctgatgcaccagagaagcatgaaaattgcaatctttgggttcagtgaggaagtggtcattggagacttgatactataatgattgggtggtatggcagagtaaagttgaattggaaagggattaagacgagttgataaggaagtgaagcactgtgtagttaaaaaatttctgtgaagaataagaaagctggaagaacacaagaaactgtaggattagtggtggtttttccagttacagtgtgtgtacatgtgtgggcgaaccatttataaagagaaggaggctcagtacaattaagtaaaacaaccaagaaaatgaaactgaaatatagtattttagaaaggtaaaatgaaccataggaatgaaaagtccctgaaatccaataaagctaattttcatcatataaatttgacatacagaagaaaaattttggtattttaattgtctttggaagagttaaaattcttcaacatagtagccacaggattacaaaatctttgagtctgtaatatatgcttagagtgaattcaaggttttattttagttttttgagacagggtcttgctctgttgcccagcctggagtgcagtggtgtgatcatggctcactgcagcctcraactcctgggttcaggcaatagttctgcctcagcttcctgagtagctgggcctacaggtgcatgccactacacctggctaatttttaaattttttatagagatggtgctcytctgttgctctggctggtctctagctcctaacctgaagtgatcctcccttcacagcatcccatcacagcactccagagtactatgatgacaggtgtgagccactacactggccaaattcaaggttttagaaatccataaaaatagattgccaaaagctgaataaattaatagacaatacagtcagtatttttgctgaaaaaagataggcataacaggaacatttgataggtaacttttagcgtgatgtgatgaagagaattttaaagcacatttatcatctaattgcctggaaagaaagaaccagggatggtaaattagaaatttaataaatttatcaccctttctgttttacaggacaagtgaaatgccgtctggaaaactaatatttaaaatgttggaagatatttaaagtagatatgtagctgagtaaattactaagatgttaataaataggaaaacatgaaaaggacatgtaggacagctttatgtgaaaaacttctgtactaattattagtcatgcctgagtttaaggagcttttagtaagtatattgtgtttagttttatactgaagttcttatggtgaaagattctagagagattatatgtcctcttgagaaagaaataacctataatcaggaataacctgaatggtttgaatcaaagttaattctatgtgagttaataacttgtttcctagttgagtagcagcatacacccaattgatactcttctttaggtgacaaaataaagaaaaaagttacstacaaataatcaggtaatgccacttcttaaaaaaatacaatctatgcaggtaacaaaatggcacttgtagcccataaatttgtacaaataaaaaattataggccgggcatggtggctcacacctgtaatcctagcactttgggaggctgaggctggtggatcacctgaggtcaggagatcgagaccagcttggccaacatggtgaaaccccgtctctactaaaaatacaaaaattagccgggcgtggtggcacatgcctgtaatcccagctacgcgggaggctgaggcaggagaattccttgaacctgggaggtgaaggctgcagtgagctgaggttggcaccactgcactccagcctaggcaacagagcgatactccgtctcaaaaaacaaaacaaaattataattccaggaggtgcctgttcttggcttctgccagaggttacactttccagcctgtgggatggccagacgcaggctgcaaagaaaaaaaaaattttatatgtatatwtatgtatatacacacacacacacacaaattgagatagtgacagacaaagaattccaaaagctgttttaaaaactaaattttcattatatgtgccattaatttgtagtatcagcccatctttttcagttttggtataagattaatacaaagtgaatgacagactacatcattagtgatcatgatttgtataatgtaatttatgctttagtgagttattttccatatagtaaaatgyctttatttaaaaaagaagaggtacagtacattataattccaaggaaattttygtattttaaaaatgccaatttttggctaaaaactcaaaagatttcatttaatacttgaataacaaggaaattcacaattaaggctgaaatactgttcatattattgtgtatttctaagcatgttattttaagcttgtgtattttaaaccatkgttacagaattgtataggaatatattgaaggcataaccttatatttattggaattttggtttaattgtttagaatttcaaaatagtattgggatgtgaaacaggatgattatcactctgataaaaacaagactgaactgagtccttcactgtatttttctaaagaactcacttctagtgagtaagtgttcaataacataaagttaggaaatctttatgttattaaaatttgaatttttctttcactgtatcccaatattttaaatatgtgtttcaggacatttccagttaaaataaaagtttaaataatatcctcactacattaaaaataagatctttaagtaaacgtatttccaaatcatattgtcattgtgcactgaagttaattctctgaagactaaattatatgcaattgaggttctgtttcccttctaaacgttcctttactaatttttccaaagcgaaaagatgctcatctgcttcttctggcacaaggttcctaatagaatttgcaagttcaaaaagatattctgtatttcttccacttggaccagctgcattaaaaatttgttcagcaatgtcttccagaggtgcaggaccaagataatcaggattatcacatgttccaatatatagcaatacactgaatggttttgttgtgggatcttttggataaaaaatgactgttgtggttctgtagcctcctttttctctgaagtcaaggtatgcttttacttcttcttcctttcctactggcaatctgtaagcaacaccccatacacatccctgttgaaaaatgaaaagaatacactggtattataaggctaattaaaataggtgaagaaaggttgtgatctaagggagtatctcatatattcttttctgtttgtttttgagatgmagtcttgtctgttgcccaggctgtggtgcagtggcacgatcgtggcctactgcaacctcagcctcccgggttcaagctattctcctgcctcagcctctcaagtgactgggattacaggaatgcaccaccatgcccagctaatttttgtatttttagtagagaaggggttttgtcacgttggccaggctggtctcaaactcctgacctcaagtgatccacctgcctcggcctcccagtgtgctgggattacaggtgtgaaccaccatgcctgcctgtatcttgtatatttttaaaagtgggccaggagcggtggctcacgcctgtaataccagcactttgggaggccgaggtgagtggatcacgaggtcaggagtggaagaccagcctggccaagatggtgaaaccccgtctttactaaaaatacaaaaattagtcaggcacagtggcaggcacttgtaatcccagctactcaggaggctgaggcaggagcattgcttgaacccgggtggcagaggtggcagtgagccgagatcatgccactgaactcaagcctgggttatagagtgagactgtctcaaaaaaataaaaaataaataaaagtcaatacagtttttcttcacttaaagtgcacagaagaacatactaaacaataaaggaaataagcactttaaaatctccattgtgaataatttctttgtatcataggcacagcaagatattttatcttaaaaaaatttttttttaatttggtctttttctttaataacgggactgaaatgaaaaatatgagcctttcacttggtcattaaaaaattctagaaacaaagtgccatttgtttattaactgtttaattaggagttataagttaccaatttgaagatcttttttataaatgcttttcgtagtatcaattatgaaagcatttcctaatccacaccattatttatctgccattactaactgcttgatttttgtttattaaagtcctttccaaagttaaacatttaatttcacaatataaaattctgaatctgtaccccaataaaatgactgaaaatatttaagaaactgaggattgttggttaaataaaactttctggtgctccaaaccagttttaaaatcacaggttctactggggtctacgggagggtggagggtgggaggagggagaggatctagaaaaataactaattgatactaggcttaatgttaatacctgggtgatgaaataatctgtacaacaaacccccatgacacatgtttacctatgtaacaaacttgcacatcctgcacatgtactcctgaacttaaaaacaaaaacacaaaacacaacacacaggtgctattgatacaattaagcaataaagaaaataagaattcctcacttagatttctgctgaaaatgagactggtagcaaaagtgaagagagcttttaagggttccatttaattctcggtggtagtctggctgtcgggggcaggtatttccgttaatgtcaaaggggaccacaaaattcttagttaataaacttgtttttaaaaaaatcccacggctgggcgcggtggctcatgcctgtaatcccagcactttgggaggccaaggcgggcggatcacgaggtcgggagattgagaccatcctggctaacacggtgaaacctcgtctctactaaaaatacaaaaaattagccagacatggtggcgggcgcctgtagtcccagctacttgggaggctgaggcaggagaatggcgtgaacccgggaggcggagcttgcagtgagccgagatcgcgccactgcactccagcctgggcgacagagctagactctgtctcaaaaaaccccacaaaaacgaaaactacatgctatttgtctgtacgttgttgtctaccttgcactctgcattctaacttttcttattggcctcagttttcacaaacacaaaaaaaacccacaaatacagagaagaattctaaatttagggtagttcaaattgtctgtgatgattgttaatcaaattgaaacagaaacatcgcaacattttataaaattaaaattatacaaaaaagaatatttataccataccgcaggatcttcaacaagagtcacaactcttccaggctgttttaaaaaggtaaaaaaaaatttttctgaattaataaagttcattaagtagctgagcattagcaacatttttgacatggaatatttgaattatatttgctcataagaagcactatttcttaagcatagttattttttatgataaagcttaagtgaattaagagaacctaccttatctagagactgtgttggcctttctaaaagatttccatcaatttatacgtattaggtatattatattcactttacatggatatattggaaaacataccagtaactaaaggtcatctaaaatgaaaggcaaatggaagcagtaattataaatattctggtttttcccttaaggaaaaaagaatgttatagttttatttatttatttatttattttttgagacggagttttgctcaacaagcccaggctggagtgcagtggtgcgatcttggctcactgcaacctccaactctcgggctcaagcaattctctcacctcagcctcctgagtagttgggattacaggtgcccgccaagacacccagctaatttttgtatttttagtagagacgggtttaccatgttggccaggctggtatggaactcctgaccttaggtaatccacccgtctcggcctcccaaagtgctgggattacaggcgtgagccaccgcacccggcctatagttttattargggaaaaaaaatatgacataaagggtgctttcctatatatagggaagtgactttcaaatttagtggatcaaaatgacctagagggcttgacaaagacattgttaggccacacctccagagtttttgattctgtaggtctggagctgtctaagaatttgcatttgtaacaactttcctgctgatttcagaaattgttctggggctcatactttaagaaccactgctaccaggggatattaagaggttttaagtgagagagaatgagtgatttacacttctgagttatgaagtgttcttacctttctgtatatggtaatggtgcttcaaggtaggcatttcttttacattcataaatgaactttactttgccctatttaaaggtcagtattagaactggcctattcgtgtagttcttatatgggacaatcagaccacttgtgttctaggcaattttattttcccattttggttttaacacaggtcagttaacaatattatggaaagcttcactttttactattcaacttgaggttgaaatgatatattatgaagccaaaacaagttttatttgttctcccatttcaaagactgataaaacagtctttgtttataaatggaaagccttagagaaagtccagacttggaatgttccataatttaaggcacaaaggtgacacctatcagtgcctgcaagctttttttttttttttttttttttttaaataaacttcgtccacggagtaccaaaggctgtatgtgtactgataccttaacatcattcatgggaatgctgagtcataagccacaattttacctacttgtatgcccaatgtctggcacatagcgagcctaaatcatccaggcatttgtgtcatctttgttgctatttccttttagtcttcatctgttcgtatagataatttgtaatcatggaacacatgggattttggattatgatttctcatttaattttcctgttagtcttctcatacattttaatagttgcataatattgtgtcattgatgaactataaacgttcctgtgttcttggacatttagatttctgacttgttttctttttaagatgatgctacaatgaggatatatatatattggtgagggtcaagtagataatgccatattattttcaatttcaaagtgaattagaagttatttatgcatagctactgtgtgctgtggagaagatgaaatcttgattcttggttccagtagcttatattgtcattctagaatgcaaactaacatgtgaaataaatagagctaagatatgggctaagatgtatggtattaagtgcagttagaattctgagtcttaggtgatcagaaagacacctttttttagctctttttttttgagacggaatttcactcttgttgctcaggctggagtgcagtggygcaatctcagctcaccgcaacgtctgcctcccaagcgattctcctgcctcagcctccagagtagctgggactctactggcgtgcgccaccacgcccagctaattttgtatttttagtagacagggggtttctccatgttggtcaggctggtgttgaactcccgacctcaggtgatccacccgcctaggcctcctaaagtgctgggattataggcgggaaccaccacgcctggccagcccctttctccttttaaagaatcacggactgttgtgttgactaggcaatttctaatcatcagtctattctgacagcatacatatctcaatgtgttttgtaacacactgtacattttsgtcaagactagtaaagtatgttgttatagccacatacataaatatttaatacttggtcattataattggagcctgggctaaaggttttcttttcggaatggcaattttaaatattcatatcaaaactgacaactctcaaactcctggcctcaagcagtcctcctggctcaaacttccgaagtgttgggatcagaggcgtgagctaccgggcccagccaaaactgacaactcagaagccatttaatttagcttagttctttaatgtcttgaatattgttctagaacattcttggagatactttggccatgacatttctgttgatctgtaaatgtgcatttatcctaagccattgccccttttcaggtcactgtgtccaacatcccaataggccagtatagtctacttaaaagccaagttcttaactgaccaactctagttgagatagaatggtttctaattcaggttcttttcgtgattttaatcccatgtctctcttatgagcagktgcaaactactttagcgccttgatcttttccactttccattgaccaatttccaaattattagttacctcaatcttagttttctttatggattagttgttttgtagccagtacaaagctgatttgcataagcagtgagctgctgctaattctctatacatatattgagattaatgtctttgtaggacygactgaaaagtgaatcaatgaacttacatttcatattataattatgagaaccatcaagaaagtaacattaaaataatgctggatatagtaatgagtttggtactatgttattcatataaccagaacttcatttaacttcactagtactgaaaaccaaagtgagttccttaataaccagcgaaaattttggaaactcattctgcaatcctrtgtgtcagaaaataaaacttttgaaagatgtaaagaaatcctagaagtaacatgcacgtttaatcgcaagctcatgaaagtcggctagaatgcagaaatgccaacaaatttaattgctaaaaagctgaatttgcaacttgatttactatttcaactctgtggtgacatgagcattcatcttcccgccaatgggactttttttcttttggcagaggttgcagagagatggagtccccatctccgcactcagcctggtgcgagctcgtgcgcctgtgcccgcgcttctcgccgtctctagaractaaccaccggcatcttaagcagcttcggaaggagtgcccgggctgggttagagatggcgggcaggtggcagggaaaatctacagaaatgttaccccaagccatgtgctttggccccatgaagcgctaaggtgtggttctctagggtgtgggtgctgtgtgtggagttggggagcaggggtcagggggcagtaagtgtggggagctgaccggcgcctcaccttgccggggaccccgcggtggtccgtgctgccctgccagaagcgcctgctgtagttggtgatgtatccgaccagcttgtcctgataggggaaatccaccttccagatcagggacccgtaaccaaaaacccacatcttctcgcggctcctctgccccagtggccgtgaaccctagctgtcgccgcgccgccggggactgaagcctccggtaagcgagtaaccggccgcgcggggcgcaggcgcgatggccacttggggcgcaaagcgcactgggagtttagatccagaaagattttccgagcggatctcagtcagctttattttatttccttgattagggtgtcaagaggcattgaccttcggtgtagtaagcaatggattcttttgcagcatccgtaaatcaccctaacctacctttagtgcccgtgtgcagaaaactacaatacccacaatgctttttggagctatttggctctgaaattggaactgggcttatttctaacggggccgaggaaggagaaaagagcaggagtcgtcactcgtgtccagatacggaggcggtgtaccagcaccgcaggtagcaaagcacctagaaacacgttttgttctgctttggaaattagatttttgcctatataacagcagccagaggaatgtaattcatatttgattttatgtcctgaaaaaaaagtcttttgcctttcaaataaaagcagaaagtttacaatagaagtttacgcttgtgaaagagtagctgtcatttcaatgggaattgtttatatatttaaattttacacaaatttattcatctttagtattatcattggcttgttcacaaaagagcaggcaaatgttcttaacttggggcccctgtaaaggctttggaaacgagctggggaacctgaatttgtatacaaaatttggggtgtacacttttctagggggaaactacagctttcatgagtttctccaaggggtcaaggatcctaaaattttttkaagatctgctcattagagctcttgctgcaaaatattgtttaggaaattcgcttggactatcatggctgtgtctctgtgtgtgaaaacagaaaccttaccaagtgattgttctttcttgaagatttttataccatgatcttgaatgctaaaacactcagattcaaggggtattatttgttttcttataaagaaatcagcaggaagctgctaccagacaaacaaacaaaaaaaaaagcaagtcttttcctattttctctaagttgtggtttcaaattgcctgatatggttgctaacccttcttttttgaaaaattttgaatacacagaaaactcagataaaaagagtgtaatgaccaatacctttcatctagatccagtaattaccattttgcacagttgctgtacttcctttttactttatttatacttttaaatggagaacatttgaagttgcttgtgttatgacattttactgccacatactctacatgtgtctcataagaataaggacattcatcctagaacaagttccctaaaaaaaaagaataagggcattctcctaataactgtgatgccattatcacatctgagaaaattaacaatagttatgtaatcaaataagtattccatatccaaactgcttcatagagtcactaayaagaaattgtgtcttcgagagagtcacatgagagctatactggactctgactggaggggaacttgaagtgagcattggagggaggtgatgatgtgggcaagaactctgttaagaactttctgggctatgtaggaaaaccgggctcatctcttcatggtgttctctgttggtttcagtatgctcagtcagtgggtctatttggtcaagcatagagaatctgagtgtttaacctcttctggaaaggacaagcaggtgcaggaagactagaatgacacctatctttcactgcttttctggcctctttgggtttagttgtttcctatagagggctgtatattgaggctgagcattgctggtagttgaatggccatctctgcataatgtagtgtacactggggattaagcagaggtgctcttatcaatggagcaccaaagagggtgctcttatcaatggagcaccaaagaatgcgttgtggtggggtatgaacaggagcagaagcctactcctcaaacatttccagaggaggaaagatagaacacttaaaagtcccttcatgtttttagtgggaaccttccaaggaattccaatctgccaaacagagaaacttcctgctttaggcaccagcagagactgtggcatggcmgtcactttctgtattgtgggcccttcttcgtcagtcatgtgagagatactagacaggcccaccgtgatttgctgacctctaggagtgaagtgttgttttattgactatagtattatccttctaccttgttttgtagactggtcaaacaaatggattttacagaggcttacgcggacacgtgctctacagttggacttgctgccagggaaggcaatgttaaagtcttaaggaaactgstcaaaaagggccgaagtgtcgatgttgcwgataacaggggatggatgccaattcatgaagcagcttatcacaactctgtagaatgtttgcaaatgttaattaatgcaggtaaagtaaattcaaggtatggaggctttgcctacaagctggattaataaaacataaaaaagtataatacataacttattaacagtagtatttgtttccctttctatagtcataaaataactgcctgaatttatttattaaggatagtaagattgcctgccttggattcaattagtatgatactctagttggacatcttatacggaagtgcctctgtctggcctctttttattgactgagctaggtgatatgggagaagtagtctgctgtttgaatttaagcatttggtagttactggtcatgtttattctttcttcctttaccaaacagaaagagcaattgtactgaaattgaggatgtgttttgattgaattagtctttttctttttaaacactttttaatacttttgggaatttttacaactacttagcatgaaacaagatgcctgccttcctgatgctttttcttgtcagaggaaacagatgacaaatatctaaataattaaacaagataatttaaaaaggtaaaagtgttatgaagaaaataaaacaaagtagagataataaaacagatgggatagacaaaaatggtgtgctactgcacatctctttacatctctgcattcagtgacttcatgcttgggatcggccatggtaggagtatttacaccacagaaacaagccagtgctacaaaccagtgctataaactgggctttcttccctctggacagctagttattaaatgttaaccagcacactactgagtgaaggtcattgactaaaggcgagattctgacatttagtatagagggggtaggaagaaaacaaatggtgactgagcattgctttgtgatagtcattgtgccacatgctcaatttatcttctttatctaatatttataaaaatggtgttagaggcagtattatcctcattttattggtgaaaagaccaaggctcagagaagttgacttgtaaaaggttacataataaactagggtatttgatttgaacccatttctctgactctaaagcccttttttttcctctcataccaagcttctaacatttaattgaatgaatttatagcattcagttaaaatgaggttgactataatactctgcattgtaacactcagaaccaatttcatttcattgatcgtggaaattcagaccctctttcctgcatacttgtcatcaccaggtataggtccttaaaatrtaaacttctgggtccatagcccatcagaactactaatttgttacctgctggacgggaaaggaaataatctttacattgtttttggtagtggtaggtgttttttttgttgttgttgttttgtttttttcttttttttgtcttaacaggtaagagatggtaaggctaaacttcctaaatcataatgcaggaaatttgtcatgattgtttttaaaatcacatgttcaagtgtctagtgtctattatagttgagtgtttgaagatagtggaaaaatagatgttattcctctaatttcaaacgcttaagatatgttttcagaatctgtttgaagttaactataaagcttgagttcccaaactatttttagtaacaaagacatgagtttgaatatccttttctaggcaaaaagctcatttccaatatactgttacatctcttcttcatatcggaatagtgtagtttatgttacagatttttttcatctgctgagtaaacttgggcatgcttttgactaaaggcatttgaactggctgttaaattcatctctacagttgtcctgccatatccacagggaattggtcccaaaatgtccacggacaccaaaattcatggatgctcctcaagttcggcagtctgccctgaagataggaaaacgtcctatacacacatacaaaaggtcagccgtctgtatctgtgggttccacatcctacaaatgctattatcttccatcccagttggttgaatctgcaggtgcaaaacccgtggatacagaagcccgactgtatttcctttttttctgagacagagtcttgctctgttgcccaggtgggagtgcagtggtgcgacctcagctcaccaccacctccacctcccagattcaagcggttctcctgcctcagtctcccaagtagctgggactacaggtgcacaccaccaatgcctggctaactgtctcactttgttgccgaggctggtctcaaacccttggctcaagtgatcctcctgccttggcttcccaaagtgctgggattacaggtgtgatgcatcacacctgctgtcttttattatataattttcctacctccctgaggtttatctaatattaatacactgtcagagattcctaaaagataattagtgcacccaaataagaaggtatgtaggcctacacaaataaaatggaaatatctaaaatgattagaagagttttgcttcactgtctcttcaatttagatttggaatccattctgagtaccatacatggtcttctgactcaagttggagaagagcattcaagtgtggtgtagattacatagaagtttaatatgcatacatatttttgtatttcttatgtatctcattttagttttctgtttaacatattagcacagataacaaatttgcttgtcttctctcctgtattggaggttgggtgtaatgggtgttgagattttatgaagcttgtcatcctggagggcagtaatgatcttcactgacaattaatgccattcaataataagtcatttgctgactaaaagtcccttaaaaatcttataattattaagcatatagctaaaaaatacttttatttggctaataaatgatctagctcatagtattttttattagttcatgttaaataagaaaatacgcactartactgggcacagtaacagatgcagaagttccttagacaaataaatcattgtagcacagcgattaagagttacggtcagatggacctgaattctagtgactctaccattttattggtgtgactttggacaggttttttaacctctaagtggtttagttttttcatctgttagatagaaatattccattgttccagctcaggccagaaactctgggccatcattaattcctttctttttctcatatttctcatctagtcagtcagcaaatttgtgtatgtgtatgtctatatttgtgtgtatgtatmcacacacacacacacacacacagttagatcacttctcactaccattaataccttgtctgcgttgctataatagcatcttaacagatmttctctatctgccattgctccttctgcatcctatgacagaccaccctcaatatattagagggatcattttaaaatgcaacagaccaagtcactcttctgctctcttgagtgaaaacacttttgtgtagtatttcatggtagagatgtaatgtaatttatgtaaccattcttctattgatagatattttgtttgtttcctaaagttttgctgttataactagtgattcagtgaacatccttatgtatatatctttgtctacatggttaaccatttctgtaggatggagttttagaagtgcaattactgtttgataagttagagtttcctggagaaatagaaccaatagaatatatatagatagacaagaggggatttactatgggaattggctaatgtaattatgggagctgagaagtcccatcatatgctctctgtaagatggagaaccaggaaagctggtggtgtaactcaccctaagtctgaaggcctgagaaccaggggaagtgatagtgtaactctcagtctgaggccaaaggactgagaactggggtgtgggaggccactggtatgagtcctggagtttgaaggcctgaggatcaggatctccagtatccaagggcaggagaagatgcatgtcctagttcaagagagaatgaattctccttctgccttttttttttcatttgcaggattaatagagtgaaaacagagcccccatacaacgggaggggacccaaagggggttgctgctccctgctcgaatgcctgagtttatatcctgatcattgtccctccctctgtgctctcaggcgatatatgatttgactatttctttacctcatgctgtagcctaatttgtattttagtgagccctctttactacctgattggtcaggtgtgagctgagttacaagcccggtgtttaaaggtaggtgcggtcacctttcccagctaggcttaggaattcttagtctgcctaggaaatccagctagtcctgtctctcagtcccccctctcaacagtaaaacccaagtgctgttggggaggttggccgacgactgctcttaagtgcttcctgctgtattggggcatagtaggggtcgtgcagtttagatttcatcaggaggagtgccttcaatgtcattaacatcggagcatgggctagcaggctgttccaggggtccacggtagatcttagtcatggactgcatctggggttctatttgaagaacaatttgtaattttacagctttgattctggaagagacaaacttaacaaggaggttaaagatacagggattgaaatgtaggcctgaagtgccagggattatttcttcggcacacttcacagatcctgactatctgcttgatagttttgaaaaggcctggtctagtaaataatgatttggccatctgatgggtgctatcaatgcctaagtgaaaggtctagtgaagggttttaagtaatttccattggttagctgcaggcaaaagtatttttccttcttcagtggctagccatcctgaggggaagaagctatgtactcttgaggttccccattctatttcttctgctgagtactgggccttggtttcctggaggggattaccccatactaggggtccttctgtaagcatttctaatggagggtcctaccttgcaactcttttggcttcaatatctgcttggcggttcccttctacttcttttcttttctttctggtgaccctggcagtgtaaaactgccacctctttaggtttctgtagagccaaaaataatctcctaatgtcttcctgatgtttgataggtattccctcggaagttaggaattccctttctctccatattgttgcatgggcatggagagttaggtaagcatacttagagtctttatatatatttaccctttttccttctcctaattctagtgtataacggcccctgcttttcctaggatgtctctccctaacaaaggagtggggctttcaggcataattagaaagacatgtgaaaagagtaaagttcgccagtcacaacttagtggctgggagaagtatatagtgactgcctgtcctaggatcccctcagatagtgacagatctggaggacagttgtccaggacaggagagtaagactgagacagctgcgccagtgtccaggagacagttaacctcctggccctcaatgatcaagcatacccggggctctgtgagggtgatggcrtgggctggtgcttgccccggacaccctcagtcctgctgctgtatcatctggttagtggcttctgactcagaggaccttcgtcccctggggcagtgggccttccaatgattcccttgacataaggggcatggacgagggggaggcttatttctattcggacaatcttttttaaagtgtccttgtaaaccatactggaagcaatccctgttaggcattcgatttgcccagcctttccctgttccagagccttcaaagtccatttgcctgaagaccatgactaaagtggtggcctttttcttatcccgtttatcccgttctgcctgctcctcctgatctttattataaaaaactgaggttgccaagttcagtagggtttctaagttttgctccgggcctaaggcggacttttgaagttttgttctaatgtctgcagctgactgagtgataaacttatcctttaagattagttggccctcaatagagtcatgcgacagagaggtatgctttctcaaagcctcccttagtgtctccagaaaggcggtaggatttttcttccttttcctgtgttatagtggacatcattgaataattcatagtcttcctcctagttttccttagccttcttgcacgcaagttagcaaatgtctgcggcaccaatctccatgttctgattttgcgtcccagtgagggtctacactgggaactgcctcctggcctgtggagaattgttctctttcttctgttgtcatcctatcattgacctgactgagataccagagattgccaaactctctggctgcagttatggtggcacttctctcttttgtggttagcgtctgatctagcagcaacattatatctgtctatgtccgataaaagcattgttctaacccttgtaaaacatcaatatagccatcagggttatctgataatttacctaggtctattttaatttgcttcaagtctgacagggaaaaaggtacatacactctgggccgaattctccagaatatatcttaggggcgtttttgccttgtggggaacatgtcccatctgaaaaaagaacatagggatgccagcacctctagtcattttccaatgagcattatcccagaggactagagcgtcctctgtggtcctagtgcttattcctttccagggtgtacaactacccatggacctctgcttatcggattagttacactcaccaatgtagcagtcctgcaccccttttcccacctttcttgaccacaaagaaaggggtccgggctgctggattctagtggtcctttaccagcatgcccaatattgcctttgcgctcaagggtgagttctagagctgggctgggttcctgagtattttataacaacccagctgccccatcaagatgcgttcccataaacaacagttcttatgcaaattcttttcagagagggtgtaggtaaccttttgagttaggattgaggtagagtttttgcccactagggcctttgtccttttcccttgtaggaatacgccctaattatcaatcttaaactttttgttgccccggattaagtccttgccggtatgaaatttgagagatggatcctgtttatcccatgtgcctttttccgtgggttactgggttaaggatttttgataggaaggctatgtgttgtcagtggtctcagtgttttcaggctacgcccttgtttacactgacaacaaggtagtattggagtgttatagggtcacagagaagaccttcagttatcaattataggttttaaatttaccctggcttttaaaggaatagggtgcactgttttttctttactacttctatctctctttttctctctctccctctcttttctctctctctctgtctcttctctccttgagttacttaattcgctttcatcctgatctattatgttgtcatagacccagttccagttgttaaagtactgggtcatgagtttcaaggccctggccaaggagccaaggcttggagattgtattgcagagggataagctgggtaaaaatcaggggaggagagcatcttacatgatgrgagagcaatcctcctagccatttacaaacttggggccctggcaagggtggtggggaatgggtcccacataactgcccatgttgagagctgtatatctaaactgggacaccagggacaagattccctgggttcayagcctaggtacctaaggacacagcatagaacttccttagatccctttggagatacaacttgctctaatacttgggagaggaaatgaagtctgaaccattagtacctaggaggcagggatcggaggaagtagattcagaagtaaggagaattttgggctacactttcaagaaagtcatggtcgggacccaggaggtatgggtcagaaggaaaggtaggggtgcatgcacgggcgactgttgagtagagacttcggctgcgccatgatctcaaccagctaacgccgggagttcgggacgacagctttctgcctctagtcggccctcggcctccccaggaaaattgaaagcagaagctggttccaggcagaccaacgctcccaacccagaagggttggacgttgttagaaagccctttcccagatagcctcacacctgagtcttaagtctggcagccacactaattatttttaactggctgacaggtgcccggtattttcctccaattctaaggaaggataggacagaatagcaagtgaaagtggtccaatattactcaccgcttttgaggyccctttgtggtcaccaaaatgttactggggggtccttgttcttagagctcctaagatggtggtaggctgcttccaagatggtggcaagcctcttgttctctgacctcgggttcttgacctcacggattccaaggaatggaatcttgggtcatgcggtgagtgttacagctctgttcagctcgattaggatgaaccccaggcacttagcctgtgcaggaacaatggtgagcctctagcccgactgggagtggcaatgggcgccgcctcgctggatcagaagtgcagtggacaccctgccagatcggaggggtagaagtcaacagcgggtctgcgacgacggtgatcagcagtggtggacggtgagtgaaagctcagtttgaactggaacaaacacggaccagagagtgtgcagttgcaagatttaatagagtgaaaacagagctcccatacaatgggaggggacccaaagggggttccctgccttttttttcttttaggtccttgaaggattacatgatgcctgcccacattggtgagggcaagtcttgtttattcagtctgctgattcaratggtaatgtcttcctgaaacatcttcatggatatacccagaaatgttttagcagctatctgggcatcccttaacccagtcaagttgacatgtaaaattaaccatcaccatgccaagttaaaatatttatagatactgctaaattgtatgctatgttaatcaggattctttcagtactgagtgaaagaaacctagttcaaactagcttaagcaaagaaagggaatatagtagctcaagtaaatgtaaatctgagtgatgggtctcttcagagactgctggattctactattagaatgatgtcgttagacaggcaggatttccctttggaagttctagacttaccttatttttatttttttaattaaaaaaatttttttaaagagatggggtcttactctgttgctcaagctggagtacagtggtgtgatcatggctcattgcagcctccaactcttgggctcaagtgatcctcccatctcagtctctggaataactgggaccgcagacatatgccatcacatcaggctaatttttttattttctatattttgtagaggtggggggggggtcttactattttgtccaggttggtctcaaaactcctggcctcaagtgatactccttccttggcctcccaaagtgctgggattacaggcatgagccactgcattaggccttgccttatctttaaagagctctttatgtattctggatattaatccttcggtgttatatgtgtttcgggtattttctcgtcacttttcttaacagtgtctactttctttgtaatgcctttcaacctcttcctcttcactgacttcttccatgcatcttgtgtgcattatgaagtctctgctgagggttgtctgagaagtttgcacataatacaattccttgcattgtggaaattattttatatataaccttttcttataatacctawataaaacatagtaagatgatataaattgtgtaaatggtgtggcgatataatcttgacatttattacacttgtgattggcacatagtaaatttgtcatcaaattctggctcagctgttgagaaatattctggtcttaatacttaacctatctcctctactgaaaaccttgtggtttgactttccctgttagagtttgcagaaaacaaaaagaacggtctatcacccattactaccacttttataagaagtaatagacaagtttattattcataagtaaaaagacactttgtgtcagtaaacatagggtgtggttccattggcagtgtttgggccaactcttgtcattgctacacaggcgtcagtggctggcattggttcagctgaggtggctctaattctccaagtattcccaggaaataactcacaagttgtgaaagacctgaagtgctcattgtgtttgtccattaagaatgtctttaatacccacaccatttaaagtttcaataagttgagaaggagaagccactttgccttcctttgagggtaaggagagattaaagcattaaaaacagtgaataggatgagccatttctttttcaagaagcacccctgtagagaagggaagagagtgagaaggtggtggttgatggtccagtacaaggtagataagatccctttgctaaaactcatgtatcagtttaaggaaagcagtttatctttggaactttcaaaactaatttatagtgggtggtgaaaattttcttaaaatgatactttggagactttaccaaatgtgtaacaactttgacagtacttaaattgcatatctatctgcatttgtattttacaaaaattcagactatatacctaattctattgaaccctattgagagttggtccagctaatttatcctcgtttcactgttatggaacctgagcctcagagaggtttaagtaattggcccgaagtataacccatattatttctagcagagtcaaagttgcagcctcaatccaacttcaaatgttatcttcctggtccagtgattttaaagttagcttaatatatttttttctataggtaaaatatttcaagatctcaagttagtagtaaattgacttcagtatttctcacctgtgtgagaagtgccttttattttctttacttcatatataatcacacaggagattttatttccttttcccaagatgagtgtgtatgcaagtcactaagggtggcttgcactccagaagtgggaattaaactctacttcyttgatggagtagtctttacataaattatttggaattcttctacatgggagatttatctcttctctcccgttaatttatatatttagtcatttatatctgcatgaactcattgttacttattttatacctgtactttaggttacaatccaatacaatgtaatttattttgttgctcatattgttttggtcataggatgccctttcagagtggctcctattgtctcttttgcatgcccccattgtttgttttttgagcacgttttactttttggacctacagtgtgctccgactctttgtatgtttcccacctcagccttagaatcagccattttcataagagtgctggtttcttttacgggagaatgatagtgaaaaccaagatgtaaggccaggcatggtggctcacgcctgtaatctcagcactttgggaggccaagtcgggcagatcacctgaggccaggagtttgagaccagcctggccaacatggcaaaaacatgtctctactaaaaaaaaaatacaaaaaattacccaggtgtggtggtgcgcctataatcccagctactcgggaggctgaagcaggagaatcgcttgaacctgggaggtggaggttgcagtgagctgagatcacgccactgcactccatcctgggcaacactgtctcaaaaaaaaaaaacagaaagaaagagagaaaaccaagatctgaggactgggtgtgcttgttgctactggactgtcattgattttaagccctttcagcagacagatctagaacatatatttatatattataacccatgtatatatacatctatagttgtttccgtgtctagccatctgtatctatattaagctaaacatgaattcatactgatgtctggactctactccagaacacatggttcattctagccttccctctttccttatatgtaaccttcctctccaacagtaagaaacctggcccccagatctgccatctgtttatttatttgtttgttcttagtattcatgtagagtggtttcagaattgttaatctctactcctagaaacaactttaccaactagactatagtgtttatgtgcagttctttttgtctttagtcttacagttttcagtcatagcatcatttatcaaagttatgtagaccagtgtcttttttctctatctctcagtgtggttatgacatatatttgtaattcaattagattcttttgtcacagtctgcatgctatcctaggatcacccttccttttacctcctggttgattttttttttttaaattgcgtacattaaggttcactctttctgctgtaaggcataatatttaaatggtcaggattaaactttatgtcttttttttctttttaagtggaggagaacatcttttctactttacaagagaaagttccttggcttctgtaatgtaacatcggtctaggtctctgaccttttagtgaccatctttcttagtctcttactgcttctgttgattcctttccctgatgggtaccttcctttctgcatttgtaccaggagcacattacttcactttttctaactttaagacatggtttaatatatagtaagtctaggcacgcttcaatgcttgtgttgttcatttttctaaattatttgttactcttacctgccctactgatagagagaggagacagccaaatgctgcccasgtcattgtgcacagggggcttgcctaaacatgcccatgggggcgaaaaattccgtgccttaacacgtgcacagaaagggaaataaatcaatgtggagtggctcagaataaggggctgcctgtgcactggaagaatggggtgaagccactgggaattctcaccttatgcagtggggaggagcctggcctcttcagctcatgtgtggtggtctggtattcaatctgtggggtgggaacctgttggcaggacccccttttttagctgggagctttcctttaataaattctgctctcctcacctttcaatgtgtccacatgcctaatttgtcctggtggtgacacaagaacccggattttagctgaactaaggagcaaaaaatcctgcatcactaccctagacttatcaacttgagttactttatcaagtataaaacaagcaaatagctctactggcatttttattagaagtgtattaagtttattaattattttgggaagaatcagcatctttataatattgaaattttccatttaggagccaatctactgatgtctattatctatatatgtctttgtgttcctaggttttcatgtcatttgtattcacaaaactgtcaggttaatacatgaaataagggtcatgtctgactaatctccgactaatctcaataaactactttgaataagagtcaacttctgactaatctctgaaaccctatttctgtgatatgtccttttaaaatatgactactctatcttgccctttagttgtgcatctgtgaagtttgagactgttttctttgaatatatgtacttagaagctgttactgggatatcatggcttaatctacttgtttcatcagtgagttacaatgacaagaattacttaaaatagataactagttaggagcatttgtttcaattctgacacttcaagaaaatgtttaagtttttttttttattttctgtttagtttattccagctctcagaaatgtcttcacccttcactttagagcccatctttctataatgggcatagaattttattgtgtaaatatcatttgtataatttgagtgttaccagaaccttgacgttttcatgacaaatacatttcggaaactttaactcataaattccttattatatgtcactggttgtgttagagtgcattttattcttttagaactgcagttttcattaacaattaaaccatagtcttaagttagaaaaggagtatttaaaactgcctcatggtattagttgactacaaggaagtaatggtaagagatcagaccatttcccttatagaaatttaaaaataaaaaaataaaattgatgaatatttcgataaattctgtttaagcaaatatttagtgctgcatcctcctcagactattgcttttgttacctttcaatttctgccactcctcttcccttattcaccaaaaattagagaagagaaaatgggagctagtggacaggatttgtgtattaagaataccaaagagctgttcacagtgggatctctgtagaactttttcttgattttctatagttttaaatggtgaaacctgtcatttatacattacttacattttaatagttcattaaattcctcttggaatctttgctttttaaaaccaggaaatagaagtaataccttctagttgatgggctttgattcttccacagattcatctgaaaactacattaagatgaagacctttgaaggtttctgtgctttgcatctcgctgcaagtcaaggacattggaaaatcgtacagattcttttagaagctggggcagatcctaatgcaactactttagaagaaacgacaccattgtttttaggtaagtatgctatttgtggtgcagatgcaatttttcatcattattatttttttgttaaactaagcttaatttttccttcagctgttgtgcttatagtatgttcttttggcaactatcataccactacttccttgatttttgaaactgaaaagatatttttaaaggttttgctcttgttttctattcttgggtggtagcttctgggactttgtttatttaaagttgcaaaatctgtttcgaattgtaggcaccatcattgttctcactgtagttctgaagaccaggtatcacttaaattgtagcagtagttgcaaggttacctgtgaatgctttatgtttgcttttgccttttcttaacattaaaaaattaagaagcttttatggaagaaatcaccagctaatactttaatgccagttaatgtgttgcctgtatggatctgttttttaattcagacctcttctgttacagactgttttttaattccttaaggacgacagccaaattctaaatggctttcttccaataactgtcttttttcttcttttcctccttttttctattcgattctatttgtcttcagggacattgtgtcccataaagtttagtggaacatgagaaaattgagtcaatgaagcgtttggaatagaatcagtgcatctggactatagttttggtcctgccacatgtaatttgtatatttatttatttactatatgtttcagtatcctcacttataaaatgagagtaatagtacctatctagtctttgttattggtctgagaatgaaatgagttgtctgtgaaagtactttttttccttgtggacttaaaaatattacttaaatttatgtactttagtaaaattcattctttttaatataacagttctgtgagttttgatgtattcataaaattctgtaatgacaacaatcaagatatagaaccattccatcactcctcaaaattccatcatgctgccaatttttaatcaatattttcttccctctccccagctccacccctgacagtgactgatctgttcatatatatgaattaatatacaccatatagcctttgagactggcttcctttagctgtcatgatacttttgagattcatccatattgttgcatgtatcaataatccatttctttttgttagctgaatcgtattctattaaatagatgtgattaaatagatgtgatacagtttatccatttatcagttggatatttgagttgttttcactgtttagtggttacgactaaatctcctataaacatttgcagacaggttttgtatcaatataagtttttatttctcttgggttaatacttaggattggtatgacatatggtaaatatatgtttaactttgggaaacaagttggaagtttttttctactggtttgcatttcgttcagtaatgtttgagacttttagttgccccatatccttgccaacatttgctattgccagctttttctttttctcccttacatcttagtaattctaatggaggtttagtagtatctcactgtggtttttatttgcattttcctaattgccaatgatgttgagcatctattcatatgattattttccatctttcctttttcctcattacttttgtatttagacgttttgttttgaaataatttcagacttatggaagtagtcaataacagtacaaagggttccttatatacttttcacccagattttcttcttttgccaggtttgtcatttaatttccttctttgtattttttttaatccttttgagattaagtggtagacatcacgctcctttacttctacttcagtgtgaactcctaaaagcaataaaattctgactaccatatgatgatcataatcttatcaggaagttaacatggatagaatagtattatttggtctacagccctcattcaattttttcgtgaatgtcttttatagcaacagaaaaaaagattttggtccgtgatgaatccaagatcacttgttatatttagttgttatgtctctttggcttcctttaatttggaacagttttttagtcttttatgattttaacttttttaagagttcaggtcattgattttgtataatatccttcgatttgggtttgtctgatgtttcttcctgataaggttcagggtttgtgtttctggcaggaataccacagaagtgccatggtatcttagtgcatcttaccaggaataatatgacacattactagtaatgttaatttatgaaagtactttgaatatgcgaaaagtattttacacgtttcatggaagctttggtttaatgtagcttgggtttcctagaggagtgattgcttttttatattaagtttcttttttcccctgcacctgcatttaacctactttggatattctgtacaactacagaggaagcatttattgaggctcagctatacgcaatctccattctagccgctttcctcaagaaatcgtctacgtggaggagtaaaaaaggtgattttacaagtttgagattttaaaagggagaataattagtcacccttgaatgacagaagacttcatgtgcagagtgctgtattaacagtaacaataacatttattaagcagagtgtatactaagccttgtgtgggtgttttacatgaagcagataattggatcttcactgtgattctgagacatgtactattattattcccacttttacaggtgaggaaactttaaaaagactggatttaggaagagaagagctatctttgaatcttgatcttgctgttgtctgtgttttgggtagaaaactgattcagtgaactattaaaaacatgtttattgacaaaaggtttcctaatcacatacatttgcgaaacactatgtgctatatcccccagtgtagaaaaacatgaagacattacatatgtgacttattgtgcccaccctgtctgaagtatccactgatctctttatgcattctcttttagtgtcttcatcactgactccagttaattattactcccttgtttatttactgcccccttaactagaaagagtgttccattaaggcagggattttattcatcttgttcactgttgtaactcccaaactcagtttagtgcctggtatatggtaggtattcagtaaattatttgttaaataaaagaatgaaggattctgagaagacctctcttaaacaacatttgtttatcgcagagctttgaaacgtatttgactgtactgttctttcagtctcgttgtccagcctggagtgcaatggcacaatctcggctcactgcaacctctgcctcccgggttcaagtgtttctcctgcctcagcctcccgagtagctgggattacaagcccccgccaccacgcctggctaatttttatatttttagtagagatggggtttcaccatgttggccaggctaatctggaactcctgacctcaggcgatctgcctgcctcagcctctctaagtgctgggattacaggcatgagccactgtgcccagctgtattctttttctttatggaacatttaggaatacctccagaaacattgatattccatgggactatttgagaaatgctattctggccacatagtttacagtttcaaattattattattattattagagtcccatttatgaaattcagtattgtgcctacttttattagtatttggagaaaattagagatgcatagtttttaggggtttatatttcaacatgtagttaacttgtacttttttatgttaatgaagcaagggatgggagataattcaaaccagtaaataactttaaatcacttatttttagtagtaggatttattttgtttctgtggcagtgaatttaccattttgtaaatggtaaatttgtattgactaagaaataaatcttttgtattgactaatacaaaataccgtgcctggccaatatagtatttaaaaaaaggaaagtagagccttagtgtttgtaaaaacataatgtggaagggccaggtgtggtagctcacayttgtaatctcagcactttgggaggccgaggcgggcggatcacctgaggtcaggggttcgagaccagcctggctaacatggtgaaacctcgtttctactaaaaatacaaaaaattagctgggtgtggtggcacatgcctgtaatctgagctacttgggaggctgaggctggagaatcacttgaatccgggagggcggacattgcagtaagccaagattgcgccattgcactccagcttggacaacaataactctgtctcaaaaaaaaaaaaaagaaaaaaccccccaaaaaacagtgtgtggaagaatgggcatgtatacatcagtgttgtgtatggaaaaaataggaatggacatataactctttagttagataatatgggtgtcagtgtcttctctgcatcatgaataataggacaaactttagcactctgccttgctcacctttacctttttttattttttgatgtagggtcttgctcttttgccgaggctggagtgcagtggcaaaatcatagctcactacagcctcaaactattgggctcaagttatcctcctgcctcagcctcttgagtagctgggaccacaagcaccgccaccacacccagctaatttttttttaatgtttaatttttgtagagttggggtcttgctatgttgcccaggcttgtcttcaagcgatcctcctcccttagtttcccaaagtgctaggattacaggcatgagccactgcacttggacaatctttttatcttttaaataaccatatagtgattcctgcttcagtctataatggaagagttttaaaattaaaacaaaatccaaaataattcaaggtttgtatcaaactacaaataatttctagatgaggaagagtagctggactagttggacttaaagtgagaaaggaaggttaacctgtctagaatagcttcctttcccatctgtagagttagcttccaaaactgaaaatttggaatatgttgtttgaggtattttgtttctctccctcaagggaagctatactctattacatgttataggacctgtcctgatggcccagttagcactagcctattgctagaggctatagaatataaacccagaggatctaggggtagaaagtgaatatggaactatggaaatctcccaggtgaccggaaaagttgttgacatgagaggtgtgttggatctgattatgaytgaacataaagctaaatggagggactctggaaagtcgactgctccactgtttgtaatgggactatcttctttacacagagctsaccaacattttaataaagatgagctttaaaagggaactcttcaacttaatggcagtaggaatcaaaatgagaaaacctcacgagaaaggggaaattcagggaacatctcatctttctacatgaatattgtccttccagaacatctttttgctagcacacaggttagagtttattttttaacaaggagtcttgctgccttatttcttttctctacccttgtcttgtccttcccctgctctctttcccttccccttgctccatatacacataataaatattctaagggtaggtaaaactgctttggaaataaagatattcttgttgatagctataataaattctaagtgaaaaatccagctaatatttaggaaatagatttcctttttattttgttatatttagaaaacattgctaaattggaggctcaaatccaaactagtgtgatttcataggacactccatgggaactgcatggcatgcgcttttggcttttgatggatggtttttcattttttgtttttctgagtttgcttattctgtgtaatatttaataagaacagaatgttttataaatagtgttgggtgaggctgcctatttcaatatttaactgtaaaatgtgtcatacttcagctcacatagcatatgctttaactttgactctgctgacatattctaaaattgaacaaaccaccatgtgattcacttttcattagtgtcttcatggataagtgatcattcataaggctattttttgatgtgctatgaattttgtggtttcacattcatatctctttatatattatgttaataaaactttgctttggaggtttttttttagatttttcaactggaagattaatcttcagtgattgtcatgtaagcatttttacttgaggacatgttctttaaaatacgggtttgagttttcttagattgaaagtatggagtttactaaaagttacatttaaaaagtgttaatttcatgttctggttttacttttgtttgtttttttagttttatggttcttgatacaactttatattacacctatgttttattttttttaatttttttatttatttttttgagacagagtctcgctctgtctgcccaggctggagtgcagtggcactatctcggctcactgcaagctctgcgtcccgggttcatgccattctcctgcctcagcctctcaagtagctgggattacaggcgcctgtgaccacgcctggctaattttttttttttttgtatttttagtagagatgaggtttcaccgtgttagccaggatggtctagatctcctgacctcgcagtccacctgcctcggcttcccaaagtgctgggattacaggcgtgagccactgcgcccagccacctttctatgttttaacacaatgtcttttaattacttttttttttttttttgagacagagtctcactctgtcacccaggctggagtgcagtggtgcgatctctgcctactgcaacttccacctccagggttcaagggattcttgtgccttagcctcccgagtagctgagcttacaggtgcctgccaccatgccaggctaatttttgtacatktagtggcgatgaggtttcaccatgttggccaggctggtctcaaaatcctgacctgaagtgatccgcctgcctcggcctcccraagaactgggattacaggagtgaggcactgcacctggcttttaattctttaatgtaagcaattatgaaactaggatacttattatctttctggttttaccttcatataattaaatgtatttatataatgtgttattttattagtcacatttgattaatagatttaaacctccagcttttaaagatgaggaaatcagtatccttatattgttcttacataactctctttctccccccgcttttccaacttttgtcagttatatttgcattgttagtgggaataacattttgcattttgttctggcatcttaaatgcatcatttaactttattcttagttccacggttaaatagcttagaagtttatcaccagttattttggcatgttttttccagccttgtttggttagctaaataattcctttaacacagtcctttaacaggacctatggcagtactattccctgagtttttacatgttcaaaattgaataatttggctgggcgctgttgctcacgcgtgtattcccagcactttgggaagctgaggtgagaggatcacttgaggccaggagttcgagaccagcctgggcaacagagtgagaccaccccatctctgcaaaaaaaaaaaaaaaaaaggtaaaaaaattgaatcacttaaattgaataatgattcaaacttgaacagcagtttgatcaggtacaaaatccttgaattacatccctttccttgagaactttaaaaatgatgatccattctgttctagagttgaagtctgaagctagcctaattttcttctctttttgtgacaatacttttgcttgtccattccttatcagttttctctgacacagtgtgtgtcctttcaatatgtagacttggatattttaaattttagttaatctttctggaattatatctttaaatatttgtctgttctgttattatggtggtgttcttgggccagcgtgtttacatgttggtatcttatctgttttcaatgtctattgttttttctctatttttctttctctgtgtttttgttttacttttcctgttttttttttaagcctctatgttcctcttcagaaatgtctattctgtctagtgtttctttcaatttcaattggattttttatgattgtttttgcttttcccaggtattttctgaattcagtttaaattatatcatttcctgtcagccatttttttactgagcacttgtatttcagtgttggtgctgttttcacagagacaattgcttccttaacttcttttttaaaatttacagttgtagatttagctacaattttcctttggtttgtggtaatatttttcagatgagaggtttttgctttcttttgttgttrgtctattgtttttctataacttttcttcctttattcttgtatctttgtatggatttgtgctggtacctttgtgataattcatcttgggaatatgtgagtttttgctcaattagctgctttcaggaggtttataataggaaggaggtagaggcacattccatattatggagttttcctttagactcaggatttttggacatgaattcatttagctagtatctttcactagccattgggggttggcagctgtgggatttttgcaatacagtttcccatttgtggtagcagagatagaccactttgtgtgattctttttttggatccagtccctctgattttcggatttcaactggtccagagaagttcctgctgctagcctgtgcattttttcctggtacttagttttgttcctcagagggagcccctgacctttgagaagtgttctttgctagctttttcttagatgtgcagctgacacatctgtcctctttctcccacaagtacccaggattgatcgtcattcttttggagccccttttacaaattttgatctggagttcaaaaatctaaaactagaattatagttttactaaaaatggagagtgtgtttttattttatttttcttgctgatgttggattaattgcttttggatgatttctaagaaaagtaaagggaaatgcctatattgtgctacaatattaaaattggaagtccatattcatttttaaagtaaaacagaaattctcgatttcagtatttttgtaataatttgaattctagtatatggtagcartgaatagacctagataaaatctccctcaaccccagtccatacaatacaatctctgttctagttaggtaccgtagagcagtgccactcaaaatgtcagtcgatttatataagaagcttgaaccattatataaatcaatatattggtttcttcatcaaggaagtcctgtctcaaggaaaatgtcagctaaaataaagtgtgcttagagacatagttgtttatattctgttcaaaacttcttaccttgttgaggactgataacaatttgcacattgacagccagtttgtgacaatgttgagtagccctgctgtacagcatgccatgcctttgtggctatcaaactggattgttacatggttaatgcaattgtctcttcattcttcatgattactaatgccattggccaactaatgatatgtgattatcattggttagtatggctaaaatggaaatgttgctcctacataaataggactctttgggattaaggatagtctgtccatacactttttctttgatagggaactcccagaatattttgtttctctaagccttagtatgggtcattcttacaaggtggatctagtaaggagaatactgctgtatgaatgcttcaaaaagttgaataatttctgaaagtagtagaattacagtgttatagccctagaagaaggtgtaagtttagggatgtgttatctaaatcaaatgtttcttgactctgctgctggggagacatayggaaaaataaacaatatataataggatagyggaattttagctttttgtcttttaatactttcatttgattgaaggatgtatttttctggatatggtctctgatgtctaattggccattagacttctccctgtctgttagaaaccatgagaaatgtcagtgataacgtggatgattggattgggatattcgccacaacgtttttgttatatccctaacataatgagttttgcccagaagatcatggtttttcccatcagtatgcatctttaagattgttagccactgggcagacatgaagaaatttataaaacagaaatataactttttagtataatttttwaaaaattctgtatatcaataaaatactacatttcagactaaagattttaataattgttctgctgccttgggtataagtaaagtgctggaaaaacataaacttgaggatacatagaataaatggacaacactggaaaaaaaaattcctttgtcatagcaataatggagtttcttttctagtgccaccagatgtcagtatgaacacaggaccagagaaatactgcaggagataaatgttcttacaaatgttccttttttggttcatgaaagaggtgggggaaaaaagttttacataaactagctatacaatgaaaaaataattttactgttcaattgtatagaaaaatgaaatgcataatggagaacagagtacatgtagaactcaaaaaagtagagataccattaaaaattcatatataattcaaatgtaaaattgaatatatagatgatytctgcatagccagccagcctgctgctataactggaggagatggacagcctgtggttaaacttttcgttacagacttactgaccatgtcattttttagaattattgtcaaaatctgagcctcaaaatgaaagactaggctgggtgtggtggcttatgcctataatctcaacattttgggaggctgaagtgggaggatcacttgagcccatgagttcaagaccagcctaggcaacatagcaagaccttgtctctacaaaaaatggaaaatgagctgtgtgggtggtgcatgcctgtaatcccagctactcatgaggttgaggtgggagcatcgcttgagcccaggaagttgaggctgcagtgagccgtgaatgtgccactgtcctccatcgtgggtaamagagccagaccctatcttaagaacaaaacaaaacaaacaaaaaaatgaaacagtatattttctagctaatagagataaaactcactgtaattttcatttggtacaaaattgtgtttataattgtaatttgtacagaattgttatggtaattccctagaactcatagtcacattaagcatttttctaaaagagcattcactaagataattacatttaaaaaatgtcccttaaaaaagctttttctttaatgaatgctatattaaacaatgatcattatttactatttctagttagatttagtacttacatgtatgtataggtctaccatatttctcccagatgagagtcccgttttgagttcttgctttcatgaaatcttcacatggggctttgcttgtaactgtactcaatatgttgcatgccacaactgagttgattttggtcaaaagttttgtgtgggtcaaaggctgcttctagtttctcaatttcctgttttcaaaaatattttgttacctaagatatgtttttccagattgcttcatttttcctctaatttaggaaatggaaaaaggtgttttttcaaaaccagaaaatgtctccstagaaattattgcaggatatgttctcatgccatttttgctttcttaagcatttacaattagagatttcttccatactatgttatatgatccattgtgggaaaagcagtgttcctaccctcagaggttctggcttttctcttctacctgtttggagtcttacctgtttggattgaagaggggaaagtctttctcccatatctctgtgtactccagacacttggagctctgccttctgaaatgcggtcttttatttcatccttaatctttttccttggtctctggtccctattggataccattttttaataccagatactatgattctgctttctttttctttctaggaacccacagtacttttctagcttctagaattacaccttatctttctgtctttgacacttactccaagacctgcagctgatygcctggctctctgtttccaatgctaaatgggtatcttgaagacaggtatacctagtattctaggttaaatttcaattcaattcaattctaatctctagaccagtcctacccaatagaacttggaattgtcctatatctacattgtcccttatgatggtcactagccacatggggctcttgaacacttgaagtttgtctggtttgattgaagaactcaaattttaattttattccattttaattaattaaaattaaaatttaaacagccaaatgaagcttctgtcttctatattggagaacagttctagagagcaacagaatgagtgcagttcttcatacatccttaactgaacagtagtcctgttttatttttgaaatatttatctcctttgccctaacatgtggtcctagatgggtctcacataaaaaggygaaggagcaaagaaacaccagcttagccaactagttttgcttatcaataggatggtaaaagtcacaactgaatttttctcattatcctccattgattaggtgattatcaggcctctacactatcaggcttagttcctgatatcatgggcttacaatttaattgaggatattataataaccagaattcaagataggctgtaataaataccataagaggtacacagtatatgaagcttagttctgtcctaattactgtgttgttattctgctgtggatttatctatttcttgtctcttctctctccctgtttctttaggttttaaatcatttttcaattaatatacactttagtattattgagtaaataggacagtgttcagtttgatttttattctgatgtgttttaaaaaattcagggtatactatatgcacattaggaatattttagatattcaaagtgttctcgaaattttcgttttgaaattcccttcagaatttgtggcagtcttttttttttttttttttttccttttttaaaacgtcctggacaatttcacatacacaaaagcttggagacatccttccccttcctctcacaagtacccaggattgatctccattcttttggaatagtatggtctcatcactctgacttagccagaagtcttaggagttccatggcccctcagtagtgtttgacttctaattatttctgttccattcttgacccttaagcagtttttatttgccttaccttgtacatgtgcaacctacgcttgaaccaaggacccttgggcaacttccacacagaggcctcctgtctgcacaattcactcttctctagggccttacctgcagatttcaaccacttaaattctaatctctgtctcctcagtttactactgcacttgagcctctttcctctggttggagtacacctttcccaaccttactgttgctctacttggacttcagctcactgtaccgtaacggggaaatgtccccaggtacagagctggggtgatcatgggctcatctcttgtgtttcacttctctcgggaatcacagttgtctgcctgttgattaatacccgagtaagttrccttatatattttgtccactcttatgattgttttggatggatggctagtttagtaccagttatactgtcatatcccaaagtataattctgaagcttattcaatttggcgagggaatcttaaaaagagaaatcaatatcttcttttagacatatttttttcttttttgagacagagtcttgctctgttgcctaggctggagtgctgttgcatgatctcggctcactgcaacctccgcttcctgggttgaagtgattcttgtgcctcagtgtacttgggactacaggcatgcaccaccacacctggctaattttgtattttaatagagactgggtttaaacatgttggtcaggaattcctgacctcaggtgatctgctcaccttggtctcccaaagtgctggggttacaggtatgagccactgtgccctactcaattttttttttttttttctgagatggaatctcactctgtcgcccaggctggagtgtagtggcgcgatttcggctcactgcaagctccgcctcctgggttcacaccattctcctgcctcggcctcccaagtagttgggactacaggcgcccgccaacatgcctggctaatatttttgtatttttagtagagacagggtttcaccgtgttagccaggatggtctcgatttcctgacctcgcgatccgcctgcctcggcctcccaaagtgctgggattacaggcgtgagccaccgcacctggcctccaattttaaggttattaatttatgtcaccaccacctggatatgatagttccacttttaccacatccctgccggatacttactctgtgtttcattttaaatattctggtgggtggtgttgtgggtgctcactgaggttttcatttgcatttccctaatggaatgacaagaaggtgagtacttttccatgtattttattagctatttgcatatcctcctttgtgaagttcctgcacaaattttctcatgttttaaaaataatttatctttttattgatttaaggagttcttaattttaacgtggtccaatttatcactatttacctttatgtttattgcttttaatatgaagattaaaaattatttttctattccaagatcagtttgtagatttttcctttcttttttttttttttttagaaggtttgttgtttctaaatccaatctggaatttaattcgcaatccatctgaaattgggtattgtgtgggacaggggtgaagatttttttccccatatggatattcagtggacccaaaaccattgtcacctttgtcataaaagtgaccatttgttgaaggtatctgtttctgcagtttcagttgttttattagtctctttctctatcctgtgccaataccatgctaccttaattattccagctttattagttttgatagctgcttgtatgagtcctctggctttattctacatgattkttttggctttatttggccctttacattcccatctgtatgaatcagtttttgtttttttttttccaactattaagacaatacctgtagcacctttgggtattttgattrggctcacattgaatcgttagattgttttggggagaattgatatttttaaaatagtgaatctttatatctatgaacatggtgtattctacttttttttttttttttagatctttgcttttctcagtagtattttgtagtttacagtttagaggttttgcatgttttattaaatttatgcctccaggtctgtgttaggcatgttgattttaaggggctgatagaatgtctggatggaaatacttggcaggtatttggaaatttggttctggaccatgagggaaagttcagttaggagcaatcattcgcctagagatgaatttgctcagtaacgtttcagaattgaacaaattcactaatagagaacatgtataggccgggygtggtggctcatgtgtgtaatcccagcactttgggaggcygaggcaggctagtcactggaggtcaggagtttaagaccagcctaactaacatggtgaaacaccatctctactaaaagtacaaaaattatctgggcatggaggtgtacgtctataatcctagctactagggaggctgaggcaggagattcgcttcaacctgggaggtggaggttgtagtgagccaagatcgcaccactgcactccagcctgggcaacagagcaagactccatctcaaaaaaaaaaaaaaaaaaacttgtataaagtaaaggaataaaaaaataaatagagattgaagacagaatcctggtgagtcatcacatttctgaaatagtaggatagaacaactaaactaagaagaatgagttgttagagaaagttgtaacaccacaacagtgctgttgacatggagaaaaaagtttatgttagagaaatatggggaatttaatgccagaggcagtaggaactgaataggaggttcaaggctgagaaaaggccattgaatttgatgatgattttcaagggaatagctttacatgaattatggcagtagaatttgcatgatagttattgattaagtgattaaaaggtccatggaggcaggtatttttgtctcttgttcacttctgtatctctagtacctggaatattacctggtacataataggcactaagtagacatttgttgaatgaatgaatgagtgatttgtgggaaaatgggatcactgaatgtagrctcaagaagagtagtctttgggggtagttcagtggtaaaaaaagaaagtgagagaaaacagtagattggaagatattttgtttgtttgttttatttttagggaaaggaaaacctaaactagtctgcaggttgaacagtggagcccagtagagaaggaatgatgagaaaaaactggagaagagacaatatgaggaacaaactgcgaagtggagtgttgggaacaggccccccaaaatgtggccataaactggcccgaaaactggccataaacaaaatctctgcagcactgtgacatgtttgtgatggccataacgcccacgctggaaggatgtgggtttaccggaatgagggcaagggacacctggcccacccagggcggaaaactgcttaaaggtgttcttaaaccacaaacaatagcgtgaccgatctgtgccttaaggacatgctcctgctgcagataactagccaaacccatccctttatttccgcccatccctttgtttcccataaggaatacttttagttaatctataatctgtagaaacaatgcttatcactggcttgatcttaataaatacgtgggtaaatctctgttcaaggctttcagctccaaaggctgtgagacccctgatttcccactccacacctctgtatttctctgtgtgtgtctttaattcctctagcaccactgggttagggtctccccaaccgagctggtctcggcattggaggaggtgggaggccaaggtgggcggattatatgaggtcaggagttcaagaccagcctggccaaaatggagaaaccctgtctctactaaaaatacaaaaattaggtgggtgtggtgtcacatgctggtagtcccagctactcgggaggctgacgcaggagaaccgcttgaacccaggagacagaggttgctgtgagccgaaatagtgctactgcagtcgagcttgggcgacagagtgagaatccatcttaaaaaaaaaaaaaaggaagtggagaaggtatggaattgagggaaaggacacagatgaaattctaaaaaggaggaagcctgcttcttctcatgagatacggaaaaaataataagtaaatcaagtttctacacagaatataatataaaatgtcattgtgtagttcattcctgttagcaacattgtttcaattggatagagttaatttgctgttgctgacatgtatcattctctctacatctagatagctctcaaggcagaagcactcttttttatactttgatatccttctctatccttcccatttcatctgtattcccactatctccatggaattcacaggtactcaatgtttatagatacgtgagtggttgactctgttcttagaaaagactgtgaagtctgttttatttgctaggtagtttctaaacatgctcttatacttggttttctcagtaggcttgagaaagtatgtctgtataaagtaatgactgcctttttggaagcaaaccattcagcacagttatgggtctcctcttcagcccatccaatttgatatttccattttaatagataaagtgaatgctcctcttccaaagcggaggctttggtagtaaatctgagctctaaatacacttttctaaaccacgatttctcaattagtaactattaaatttgctttattttgaaataattaacaagggctgtgaaaataatatttttctgctcatgtgtaagttttacttttgtcattgggaaatgtttttaatagttgcagatagcagatttcttaatatatttatgatattaaaagtgaaaacataacttgcatcataaggttaaaaaaatgaaaatttttctgtcatctatattgtatttaataatcaaaacacattttttgactttaatttttataaggtcagcctaacttgtggaaaacaaacttaccttcactctccttcatatatcactgttgacaacctgataatcttcaagtcatggactggctatagaatgatttttgctaacartcactgataatgatgtatgaatttgatatgaaacagatttttttccttttatgacctccacccaaaattattactattattttcaggcttttttttaatatggtaatttcatttgtaatttctttattttgctttttttaattttcagttatttttttaaagctgttgtggggccaggtgcagtggctcatgcctataatcccagcactttgggaggctgaggcggaggtggatcacctgaggccaggagttggagaccagcttggccaacatggtgaaaccttgtctctactaaaaatacaaaaattagccagacatggtggtgcacacctgtaatcccagctactcgggaggttgaggcagaagaatcgcatgaaacccaggacagggaggttgcagtaagccgagtttgcgccactgcactccagcctgggtgacagagtgagactccatctcaaaataaaacaaactgttgtgggggccaagtgtgatggctcacgcctgtaatcccagcactttgggaggccgaggctggtggatcacctgaggtcaggagttcaggaccaccctggccaacatggtgagacgctatctctacaaaaataccaaaaagtagccgagcatgattgcgggtgcctgtaatcccagcgacttgggaggctgaggcaggagaattgcttgaacctgggaggcagaggttgtagtgagctgagatcacgccattgcattccagcctgggcgacagagcgaggcttgtctcaaaaaaaggaaaaaagaaactgtcgtggatactgtcagtgtatatatttatgtggtacctgagagccaccccaaattagattgactttagatcgtttatacaaaaatagcttgaagaactgttttttccatggtaaatgcttttgaatattaacttagttatgttagattcctacctcagtggtactgtcacagccattggttacatttctgaaacccttcagagtaagagttttggttttttgttttgttttgttttgttttttgagatggagtcttgctctgtcgcccaggctggagtgcagtgcagcaacccaggtggagtgcagtgcaacctccacctcccaggtttaagcgattctcctgcctcagcctctcaagtagctaggattacaggtgcgtgccaccatgcccagctaatttttttgtatttttagtagagacggggtttcaccatgttagccaggatggtctcgatctcctgaactcgtggtccacccgccttagcctcccaaagtgctgggattacaggcgggagccaccacactcggtggagaattttttattaaagaacttctgagtgtcttataggggaaataagctttggtataaattcaatatataaaactagtacaatatcaatggcatgttacttgtcttcagtaataagcacrcttatcatttcttgttttacacttttaaggatttttatattcccattgtttcatgtgtattagtgttttctaatgtgactcattatccaaatgtgcctttctaattttgtgactgagaagtgttgattcccacttcctgcctcctactatagtgggagatayagaataactgtatgattgaaatgaaaaaaaaatcttattcttcaaatcttttttcttactaatcaaaaccacgatgagataccatctcacagcagtaagaatggctggtattaaaaagtaaaaaaataacaggtgctggcgaggttgaggagaaaaaggaacatgtatacacagttgatgggagtgtacattaattcaaccattgtggaaagcggtatggtgattcctcagagagctaaacacaactgccatttgacccagcaatcccgttactgggtatatacccagaggaatagaaatcattctactgtaaagatggatgcacacgtatgttccttgcagcaccattcacaatcaccaagacatgaaatcaacttaaatcttctttcttacatccaagcacgttagccagaccttcttatacatgtcttaccttcctttcttataaatactactatttctccattttaagtttctgaacttaaaatttaaagaagtcactcagtagcctcacacctaacaacattcacagtatacctaatttgctaatggtgtgtgtgtgtgtttgtacttattttataaagcactttgtaattctattctggcattctgtttttcattaacttcgtgcttraattcctccataattagtgccaccttcatagcaaagttttgtgcaaaataatctgcatctctttaacaacattttttattttttctggaatccgcttttagttcacataagtaagaacgtttacattttcattgatggatataagaacattttgacaatgcttatgatttatagtggtaaaaaaaatctaagatgaagaagttgctttttcattttgtcagttactctttttatttgtgatcaaatgtagtaatagcaaacctttcagtccttttgagattgcttttccagactggtactgttgattctgaattgtccaccttatatcctcccagtttcattttaacaaactagagctakgctgtttccattttcagagagaataaatgtttgcttcttggttccagttcctctgtgtcttttaacatgctattgaaaatcattttgcatgtgttcmgaaacaattagatatatgttaatggatttgggctaagacaattgtgataactgtttaggaataatcagagcattgtggttctgaggtgagtaagtgatgagaacatcaccaaagtgtccagtcctacaaacatgcctttttgctgacattaatttttctaactgctgtattacagctgttgaaaatggacagatagatgtgttaaggstgttgcttcaacacggagcaaatgttaatggatcccattctatgtgtggatggaactccttgcaccaggcttcttttcaggtaacctctgaatttattatttcatttccatgtaaattgtgtgttttaccctcttaaaatgacagtcctatgcagtttttgctttctgcttgcctgtgatttatgatggttagtgcagtacagaaaaggcagtctaaatgctaatgatgattctgaatcagccaacttctgtagtagctgtggaagctttgggctatagggattatctacattttaaaaatgtagatggcatatttaagaaaccatcagttatttgagatataaattgataaagagcaatgggttattttatttacaataatgtgcttagaaattgtgatggctccttagtgctttggttagcaagctaatttttcaggattctataaggtttataattcctagagatcagtgtttcatgtttacatttattgggttaactagaaatataggataatctgatcgtttggccaatttctttccaactaatacagcagtatactgttttgttttttccttcaagttatcctttagtgagaggataaaaaagaaaaaaaaaacacagtaagaagaaagataccttctattttctttgtttttttcttatttaaaatgtgaatctgtgctttaggawaatgctgagatcataaaattgcttcttagaaaaggagcaaacaaggaatgccaggatgactttggaatcacacctttatttgtggctgctcagtatggcaagctagaaagcttgagcatacttatttcatcrggtaagattatccattagcctttgtactgttaagatcatgagctttaaactrtatttcctagaggaataattcttgtctcaaatataaatcaggttgtgaaatttatgrttttatgtaagtggtaaataagagtaaatacaaattgatttataaacctggttattaagtatctattactaacaatgcagtgcacagctactaatttatctgagtaggaacataatgatctatcactaaagcaggtttattggcaagttgaatgatggggctgtcctttcctgtagggacttgagcagtttcaactttctagggtgtaagactagtttaggcttaattaccttattagatggctattttgtttattaaggctctgaggggtatgttaattttgtgattatgtaaataggtttatttcaaagcaggtttacactttgttatgttaatagtaacataacctgctaaaggtttctctgtgacaacccttccacattcagcattgccagggaagttggtgtgttcaggtggcattcttactctaagtgacaattttgtgaccagaaatgtttattttacaggggcttttaaatctctcccaaacaccagatatgctcttcacagtgctaacttgatgaagcgtgaatcacagtaggctaggcaattaaaaaaaaaatacctaggctttttttggccaggcacggttgctcatgcctgtaatcccagcactttgggaggccaaggtgggcagatcacttgagatcaggagtttgagaccagcctggccaacatggcgaaaccccatctctactgaaaatacaaaaattagctgggcatggtggcatgtgcctgtaatcccaactactagggaagctgagacatgagaattgcttgaacctgggaggcagaggttgcagtgagctgagatcgtaccactgcactccagcctgggcaacagagggagactctgtctccaaaaaaagaaagaaagaaagaaagaaaacccaggctttttataaacttcctttaaatagaaaatagatcatacaaagtttgtttgtttgcttgtttattgattgattgaggccaggccttgctccatcacccaggctagagtatagtggtatgatcacagctcattgtaaccttaaactcctgacctccagcgattttgcccctttagcctaccaaatagctgcgattacaggtgcatttcaccatgcccagctaattaaaaaaccttttttttttaagacatgtggtctcaatctcccaacctcaagtgatcctcctgcctcagcctcccaaagtgctgggattacactgtaagtcgctgtgcctgcccaataatccagtttatttaaacagcagggcacatcttttcttatttttgctttcttttagaaaccttcaaacacttaagtcagagtaggaagtaaaagaaacaaacattcattaagtgccaattgaaggcatctgttataaataatgagtctgtaaatcttacagttaagaggaatccccaaaattatctgttcaaacataatcgtttttagattaagagtccagactgtgaatgtttaagtgccttgtcaaagatctagactcgtttcctggcagaatcagggcttggacccaggccttctgacttctgatcttccttctactacatcataccttccggaggactatcctaattcagttaatgacttgcagtcccataagtttcaattattagtgtttagcctgggtcagtggctcatgtctaatcccagcgctttgggaggcctgaggtcaggagcttgagaccagcccagccaacatggtgaaaccctgtctctactgaaaatacaaaaattagcccggtgtggtggcacgcacctgtccsagctactggggaggctgaggcaggagaatctcttgaacccatgaggcagaggttgtagtgagctaagatcgcaccaccgcactccagtctgggcaacaagagtgagactctgtctcaaaaacaaaacaaaacaaaactatatatatatatgtgtatatatatatgtgtgtgtatatatatgtgtgtatatatatgtgtatatatatatgtgtgtatatatatgtgtgtgtgtatatatatatatgtttaattaatatttagattaaataggccaggtgcagtgcctcatgcctgtaatcccaacactttgggaggccaaggtgggcagattgcctgagctcaggagtttgcaaccagcctggacaacatggtgaaaccccgtctctattaaaatacaaaaaattagccaggcatagtggtgtgcgcctgtagtcccagctactcaggaggctgaggcaggagaattgcttaaacccaggaggtagaggttgcagtgagcctagatcgcgcctctgcactccagcctgggtgacagagtgggactccgtctcccaaaaaaaaaaaaaaaaaaatttagattaaatagattaaactgcaccttaatgtctctcctcatgtcaggtgtgttttcttgtcgcctggagctctgagctcctgttttggtttgctttgttctttttatttcttctctctgaattgttttgaataatcagttgaaaaggtatgtaggtatgtttatcatgtaactatacatgtttccaacccctattactttcgtttcagtgagttgtctgtaatttttccaactttttcaccagtagtctttaaagaaattggttccttattctttgtgatactttgaaattgtcactcaaaataacgcattaaaaaaaaagttaaggtttctttcttgacttagtctcttttcagttatagtgtttacttctttctgaaactgacagtgggtgaaacatctaccctatagaaatcatgaagtttctagtttctatcatgagaaatttctgaaggatctatagactctttaatttaccatttgtgttctgtgtagtttttgcgtacataaaactttggtttattcaaggtgcatttatggaatattcttttaaatagaagacagccttttccgtcttgatgatgatctttccaccgaaatgtattctagaaatttaaaaaactctcatggtcatgtaacaacatcatatgtagcatatttaatacattatttgccaacaagaaaagtttggagatgactgctattttcaaaatcttcacaaaaagtgaggttagcttttaaaaatctttatacaatggcgtatatataatttaattagatttgtgattttattttattttttataatttcaacttttatttcagattyagagggtatgcatgcaggtttgttacataggtgtattgcatgatgctgaggtttgggatatgaatgacctcatcacttagacagtgggcatagtactcaacagttcgcttttcagcccttgccctgttccctgcctcccctctctattagtccccagtatctgttgttgctatctttatgtccttgagtacccagtgtttagcctccacttataagtaagaacatgcagtatttggtttttgttaatttgttaattcacttagaataatggcctccagctgcatccatgttgctgaaaggacatgattttattcttttctatggctgcgtagtattccatggtgtacatctactgtgttttctttatctgatccaccaggtatccattgatgggcacctaggttgattccatgtctttgctattgtgaatggtgccgtgatgaacatgcaagtgcatgtatatttttgttgaatgatttattttcttttggatatatacccagtgatggaattgctgggttgaatggtagttttaagttctttgagaaatttccaaactgctttccactgtggctgaactaatttacattcccaccaagaatgtataagcgttcccctttgtctgcaacctctctagcatctgttgttttttgactttttagtaatagcctttctgagtggtataagattatatctcattgtggttttgatttgcatttctgtggtgattggtgatgttgagcaattcttcatgtgtttgttggctgcttctatgtcttcttttgagaagtatcttttcatgtcttttgcccaatttttttttttttttgaaatggagtcttgctatgttgcccaggatggcgtacagtggcactatctctgctcactgcaacctctgcctcctgggttcaagtgattctcctgcctcagcctcccaagtagctgggactacaggcacgtgccaccatgcctggctaattttttgtatttttagtagagatggggttttcaccgtgttagccaggatggtcttgatctcctcacctcgtgatccacccgccttggcctccaaagtgctgagattacaggcgtgagccaatgtgcccagtccttttgcccagttcttaatggggttgttttttgcttgttgaattgtttaagttccttatagattctagatattggacaaagttaagataaagacctttgtgtaatatccagaatctataaagatacctagttagcaaatattttctcctattctgtgggttgtctgtggattcttctgttttacagaagctaaagagcttaattaatctaaagagattaattaggtcccacttaccaatttttgtttttgttgcaattgcttttgagaacttagtcataaattctttctcagggccgatgtccagaacagtgttttctcatttttttttctaactaggatttttatagtttgaggtcttacatttaaacttttaatccatcttgagttgatttttgtatatagtgaaagatagggttccagtttcattcttctacatgtagctagccagctatactagcaccgtttattgaataaggagtctctaactcattgcttatttttgtcaactttgtcaaagatcagatggctgtaggtgcatggctgtatttctggattctctattctattccattggtctttgtgtctgtttttgtaccaggaccatgctgttttggttactgtagccttaaagtagagtttgaaattgggtaatgtgatacctccagctttattctttttgcttggtattgctttggctatttgtgcccttttttggttccatatgaatttaagaaattttttttctaattctgtaaaaaatggtgtcggtagtttgataggaatagcattgaagcataaaaatgacacttcagggactcagggaaaggatgggaagggggtgagggataaaagatcacaaattgggtgcagtgtatactgcttgggtgatgagtgcaccagaatctcacaaatcaccactaaagaactttctcatgtaaccaaacactacctgttccccaataacttatgaaaatcaaaaacaaaaaactctgacatttaacaggggaaaaaataaaaaaaggaatagtgttgaatctatagattgctttgggcagtatgggtattttttaaaatgatattgatttttgcaatccgtgagcagcgttttccgtttgtttgtgtcatctatgattttttttcagtagtattttgtagttctccttgtagagatctttcacctccttggtaagatgtattcccaggtttaaaatttttttttggtggctgttataaatggagttgtgttcttgatttggctgtcagcttgaacattgttgatgtatagaaatgctgctgattttatacattgattttgtaacctgaaattttactgaagttgtttatcagcttcaggagcctttttgtggagtctgcagggttttcttggtatagaatcatattgtcagagaagagagattgtttgacttcttcttttcctatttggatgccttttatttctttctcttgcctgattgttctggcaaggactttcagtactatgttgaatargagtggtaagagtgggtatccttgtcttcttccatttctctaggagaatgcttccagcttttgcctgttcagtatgatgttggctgtgggttggtcatagatgattcttattaagatacattccttcaatgcctagtttgttgagggttttgttttgtttgttttgtttttatcatgaagggatgttgggttttatgaaggcttttctcacatctgttgagatgatcatatagttttggtttttaattttctttacgtggtgaatcccaattattcatttgcatatatggaaccaaccttgtttctcaacaatgaagcctacttgatcatgatgcattaactttttgatgtgttgctggatttaatttgctaatattttgttgagaatttttgtatctatgttcgtcagcactattggcctgtacttttctttcttcattgtgtctttgccagatttttgtattagggtgatgctggctttgtagaacaagttagggaggagtctctcctccttgatttttgggaatggtttcagtagaattggtactggtttttctttgtatgtctggtagaattcggctgtgaattcatgtggtccaggacttttggttggtaggttttttttttttttattatggattcagttttggaacttgatattggtctatttcaatttctttctgattcagtcttgagagattgtgtgatttatccatttcctctagattttctcatttgcgtgcattgaggtgttcgtaatagtctcagaggatcttgtgtatttttgtagaatctattgtaatgtcaactttgttgtttcagattgtgcttatttggaccttcgctcttttttttatctagctagcagtctgtcaattttgtttatcctttcaaagaaccaacttttggtttcattgatcctttgtatggatttttgggtctcaatttcattcagttccactctgattttaattattttttttcttctaatagctttggggttagtttgttctgttttttcttattcctcgaagtgtgatattggatcattaatttgagatctttctttctgagctagatgtttagcattataaacttcttaacactttttgctgcattttaatatgttctgtgtctgtttttatttatttcaaagaattttttgatttctgccataattttattgtttacttaaaagttatccaagagcaagtttgtttgtttgtttgtttgattttgagacagagtctcactctatcgccaggctggagtgcagtggcaccatctaggctcacygcaacctccgcctcccaggttcaagcaattctcctgcctcagtctcctgagtagctgggactataggcacacaccactatgtctggctaatttttttttttttttttttttttgtagtttagtagagatggggtttcaccacatttccaggctggtctcgaactcttgagctcaggcaatctgcctgccttggcctcccaaaatgctaggattacaggcgtgaaccactgtgcccagccaagagcaagttaatttctatgtaattgtgtggttttggaagatcttcttggtattgatttctatttttattctactgtggtctgagagtatggttggtattaattcagtttatttatttatttatttatttatttatttatttatttatatttctggagacagggtcttgctctgtacccagactggagtgcagtggcatgatcttggctcactgcaacctccccctcctggttcaagcaattctcctgcctcagcctcctgagtacctgggattacaggcgcgcacccctgtggccagctaatttttttgtatttttagtagagatggggtttcatcgtgttggccaatttggtctcaaactcctgaccttcaagtgatctgcccatctcggcctcacaagtgaatcagttttttaaatttattgagatgtgctttttggccgagcatgtggtctgtcttggagtatgttatatgtgctgttgagaagaatatatattctgtggttgatgagtggagtgttctttagatgtgtattaggtccaattggtcaaatgttgaatttacacccagaatttgttttttaattttctgcctcagtgatctgtctaatgctgtcaatgggatttgacatctcccaacattattgctatctctatagatctctaagagcttgttttatgaaactggatgcttcaatgttgggtgtgtgtatatttaggatagttaagtcttctcattgaattgaaccctttatcattatgtaattaccttctttgtccttttgtactgttgttggtttttttatatataattttttcttgaatagaaatggggtctcactgtgttgctgtgaaccccaaatatctgagagagatctcagtcaatttaggaagtttattttgccaacattaagggcatgtgcctgtgacacagcctcaggaggtcctggcaacatatgcccaaagtggttggggcacaacttggttttatacgttttatacatgagacatcaatcaacatatataagatatacattggttctgtctggaaaagcgggacaactcaaagtggggagagtatgtccaggtcataggtaggtaggagacaaatggttgcctttttttttttttttgagtttctgattagcctttccaaaggaggcactcagatatgcacttatcccagtgagcagagggatgactttgagtttgagttctgtctgtccttcgtccacagggaaattccttgtgagggaggtacgtaactttttctaatcttagtagctattttttaggaatagaataggaggcagggttgcgctaagcagttcccagcttgacttttccctttggcttagtgattgtgggggtcccaagatttattttcctttcacattgccctggctggtcttgaactcctgagctcaagcgatcctccccccttgtaagagttaaagaaagaggaaagaaacacaaaagatgggttggcagttaaagacaggtttactttagataaaacctgagaagggtttctggctgatttcgatcaggagcactttctcttacaggctaagtacatgagtatatattggttttagggtgagggggcttatcacaagcttggagtgtttatgtgtgggggagaagtttatggtgaggttggaatgtctctgggtgaaggggggattatcttggggctgacgtctttctagaaggaagggagttatctcggggctggcatcttcccagccagagcagggcagctagcatgtctctggtcgcagaggagtttggcatgttcctggtcggagatgctttttttgtttatgatcatgctgatcttagccatttaggctgatgcgctttggatttaggaagtttttgattaaggtgaattggaaaataacagtgcttgtgcaagatggtgatactcctgctctgtcatacttcggcctctcaaagctctgggcttataggcgtgagccactgtgcctggctctgttgtctgatttaaagtctgttttatctgatataagaatattgacccctggttgggcgtggtggctcacgcctgtaatcccagcactttgggaggccgaggtgggtggatcacgaggtcaagagatcaagaccatcctggccaacatggtgaaaccccgtctctatctgctaaaaatacaaaaatcagctgggcgtggtagtgcatgcctgtagtcccagctactcgggaggctgaggcaggagaattgcttgaacccaggaggcagaggttgcagtaagccgagatcgcaccattgcactccagcctggcgacacggcgagactcagtctcaaaaataaaataaaataaaataaaaaactagtgacccctgaccttttttgttttccatttggttgataaatcttttttcaaccctttactttgagcctatgggtgttgttacatgtgagacgtgtctcttgaaggcagcagatggatgggtcttttttctttctttttttttttttaatccaaattgcagctgtgtgccttttaggcaggatgtttcgtaaaaggcgaaagatttgtatgatctgaagagaccctttacattcaaggttaatattgatatgtgaggttttgatcctattattaagttggtagatggttgctttgcagtttctattgtatgattgtattatggggtctttgggctatgtacttcagtgtgtttttgtggtatcagtgttgttctttcatttccatgtttaaaagtcccttaaggatctctgctaagactggtctagtggtaacaaattgtcttatcgcttgcttgtctgtaaaatattttatttctccttcgtttgtgaagcttagtttggtggaatatgaaattcttggttgtagtgtcctctctttaagaatgctgaaaatagacccccaatctctcttgccttgtaaggtttctgctgagaagtccactgttccttttgtatgtgatctgacgtttttctctagctgcctgtaagattttttctttagtgttaaccttcaacagtctggtgactgtatgccatggtgatattcacgttcacagagagttctctgtattgcttctatctggatgtcttcctctctggcaagattagggaaattttcttaaattatgtcctcaaatatgttttccaggtcatttactttttctccttctctctcaggaataccaataattcatagatttggttgctttacattatcaaatatttctcaaagcctttttcattaaaaattttttatttttatttttatctgactgggttagtttgaaagactgatcttcaagctccaaaattcttccttctgcttggcctagtctattaataaaacttgcagttatattttgaaattccttaagtgagtttttcaattccagaagctctgattgattcctttttaagatgtttatcttaagatgccttcatttcctgaattgctttagaagtttctttgtgtttattttcaaccttgtctggatcttgttgagcttccttgcaatccttgctttgaattctttatctgtcatttctgagtttccatttgggtcaggaaccattgygggaacacgactgtgatccttcagtggtgtcactatatttagatttttcacaaatccaaaattcttggggtagttccttttcatctggagatgttcacacttctaatttttgtaattattttcatgcaggtgggatttttttctttttctttctttcactataatattattgtttttccctttcacatttatgattttaaatatcaactcagaaacctgttgaaagagaccctttttctctgattgtaggcattatttatcatgcagtggttatgaagaaagagatgtaatagagagtatagtcaatattagttttaaggcgtggctcccatatatgtcatatctactgataatttttcataaatcttagcctgaatcaattagtkgcataatttggattttatctttttcagcagttatcagaaatattatccatgtttgatagtytgyatttttctttttaaatgtttwcttattgggccccagaatgcttgttggaggagggattggaatgaaatgtatccttcattgaataggatttttgttttagcttaaaaatgaattctaagatatgaatcacttgttttcttgctgacgtagaggcaagacctttttatttttgatagagacagggtctcactatgttgcccaggctggtctcaaacacgtggcctcaagcaatcctctggccacagcttcctaaattgctgggattccaggcatgagctaccctgtcagtttagcgaagacaatttaaatgattaccaagaagttagcaaagtaaatatgtttatataacaacatccaacattcagtgaagagggaaaagcttaccgtgctacgaaacccttttatggtagttcctttgaaatttgtgttgatttttttaagtattagggttatctgttaaatgttttattttgtacccttaggtgcaaatgtcaattgtcaagccttggacaaagctacacccttgttcattgctgctcaagagggacacacaaaatgtgtggagcttttgctctccagtggggcagatcctgatctttactgtaatgaggacagttggcagttacctattcatgcagctgcacaaatgggccatacaaagtaagtrttaaaaacagaaaataaacatggtctcttaatcaaaagctaataaagaataaatctgggctagacccttcacctctaggcaaagtctttgatattctcttccctaccaatctgctgggtgaacagatctacccctaatctgtccttcatgctgtcttttgctcctactattcctgcactttcatattgtgaggcagaattgctacagactgggtaggctcagggactttctcggggtgttgactcttcccattgatttctctagttatggctgtatccgccgcctcctcctccctagttttatcccaggcatctttaagcatcaatctgatgaggccatccatgttacctctctgaccccagaaagcttttgagtttgtgatgcctgttggagtgtgtgctaagtagtcctccctgtcttaaaccctttgactgaacttttcttgatctaacctcaaattggagagagagtaaatgggggttccaggaatcttagaagctagtaacttggttatacctgtgagaatatggctacctatcataaattggcagtcaatgatttttagaaatatatgtgagaatatggctacctatcataaattggcagtcaataatttttagaaatacatgtttagaatctttagagccataattctataatagcactttttatagctgctattagtattatttaatttaaaaagtaatagtaaaatattcattacttaatttagtttgtttacatagtaggaaaacagattctgcaatttggtcattatgccactaggtgacacagtactttactatttcattaatgatatttgtaagcatgtttatgtcttgtgggagagtataatttttcccacctacttaaaaaaattaaacacatttattaaagttaagagacattagactattttaacaaaatacttagatttaaaaatttgatattttccccaattcttgatcatttatttaaacataagtgttagatattgtactctgaactttaaatggtaccaaaactctcctgggcatttgttctcaattttgagaattctcattgtcactgatgattttctttatagcctacttcaaaggtaaccccttttgtgagtgtaagttctacttaaatgttatcttagacatacattacatgaggaaaagtcacaaagagaaatgtaatactatgaaaatacttcagagtagccctgtctgtcttttcccagaaagaaggaatttcctggctttaactatacagttttatttttaattttagaagggtagaatagtccttttttctttccagttgactgctagaggtaagtttacaaataacctaagaacttttgtttyaattattttcttagaactttctctacctaggagccagcttctttataaatctgcctccatatttaatgagctcacttttttttcagataatagaatattttagcacaaattataatttcttcctgatgaaaacattagtcttaatttcatgccagttatcatctttaaaaatttttactaattggaaaagaaaaactagttggtactttaagaaggaaaatagtgcattttcttgatgccagtttatacttagtagaatgatgttttaaataatttattaaaccctaaaatatctaacataaaatttgaattttgggggttaaggtggtgctagtaaggtaataaaattaaaagagcaccttttctgtttacatataggaacattaattttgtttcaaatgtatttaaagacctttttattaagcaataataagtgtaacattctggagtaaatatatagcatgtaatagtttaatgttgttggtagaaggtacaccctagacagaaatatttctttaaatgaatcagttggtaattctgaaaaaawttgtgctatagaaatgttgcctacatttatgcacrtatacaaacactaaattctcctgaatttgtgtatttatagaatcttggacttgttaataccacttactaaccggrcctgtgacactgggctaaacaaagtaagccctgtttactcagcagtgtttgggggacatgaagattgcctagaaatattactccggaatggctacagcccagacgcccaggcgtgccttgtttttggattcagttctcctgtgtgcatggctttccaaaaggagtatgtatatttgctatgtttttattttttattcttttttgctgtatggagatgtgttttgaagtgactttctttcacratgaaacttagtatctctgttagtgctaaattgctatcttggaacacaaataggaaaaaaactatgatgtttcagtcaagctgaagcagaaatgaggtgataatatcacattgttttccttccttctttggatctggattatatttttagtgtagcaatcttagggaatacgtacaatttaagtagacgcagaaatttgctgatatttttggtcttcaaaacaattcaagaattaaaaatggggctttatcaagtaaggcagtgactgcttcaggtcatttaccgtttcaaatttataagatataagcctaaaaattaaactttagttttatagatattattgtgtttttaatgtatttggtggatagcattaaaaaaaattttttttttttgagacagggtctcactctgtggcccgggctggagtgcagtggcaccatcttgactcattgcaacttctgcatcccaggctcaggtgatcctcccacctcagcctccagagtagctgggtctacaggtgtacaccaccactcccagctaatgtttttatttttagtagagatggggtttctccatgttgcccaggctggtcttgaactcctgggctcaagcagttcccttgcctcggcctcccaaaatgctgggatgtcaggcatgagccacgatgcctggctttatattatttttggatgtgagtctaaataattaagtttttaaacgcccccaaattaattatttttctaatctgtcataattctgtgaaatagactaagtgaagaattactgctgccttgttagtgtctggccagtaactttgtctataacactcttacagttttaaaacactaagaataaagctgtgtgtaagaacagccatattgagtaatatctggtcatccaataatggaataagttatgaagatagatgctattgtgtttaatgacacagaagaggttgcaggcatacctcaaattgtattggccttcttgaattcactattatgaatctctatttaatttgagtagttatcaagaaattatttactaagcttttcagcctttactatctcttaacatttgccatgtaaaattagtagttcactataatttgtttcaagtttaagcttacacgttttagtagagatagggtttcaccagcctggtctcgaactcctggcctcaagtgatctgtctgcctccagcctccaaaagtgatgggattataggtgtgagccaccccatccggcctcttaaacttatacattttagtttgaatatttgggttttggttaatctgagtatctggggcccactttatgtataactttcatgatttcataggattttcttgtgtaccccgttaagttttgtctttttaaacagaagagccctaattactttagttgaccttcagtgaggttgcactgataacttttagttgcctttctctatcccaaatcttaagtccgttacagaactgaacatttcttattagaccagaatataatgattttggattgcgcgygcgcgcgcgcctgtgtgtgtgtgtgtgtgtgtgttcaatatgatgatggtcttttttggccttcatcttatcttttggatgaacaatgtttttggtccttctggtcacagcagctaagctcacgcctcatcaccttataagtgtagtttgaattaagccatataatgtagtacccctgttaactctgaaacaccttaaaattaatgatattccttgggagctgggcagtatgtttcatgccttctgtagattcggataaatgaaattaggtgggaaagatcttaaataggtttctggattttccaagattagttgaaattttagggggcagacccttttttctcctttgatttctacaaaatcagtcartaacactaattgaccattttgttatgtagagagcactaaatagatcctgttaaacttactgaggaagctgaaacatacacacgatcctttaggaatttaaaacctaatgggaaaaacagtrtttagtggcatttacttcactatcttctgctgtctttggcaaagaagcgtttttaatgtatttttttttttttgtatttttttatagagactcatggaagggaaggttcctatttttttctgctgtgtctgggataactgcaaataggagctattatctcattcttgaatagtgatataaatgattttttttcttttcctttcacaagtactccaaagttgtatttttaaggaactccacagtttggtttgctttttatgtctcagttactctgtagaatttttttctgtgtaaacttcagtgatgctaagaagttcttaacatgcagtggagtaattccactacagcctctctctttctctctaatgactacaaaaaactrtggtcaaaattcaaaaagaaactacctgaggactctcaaaggaacaaaagcagatagattatgaaagagagtggtaacttggtgaagtgacccacatgaaaacgaattttcccatttctttttcctttttttttttgagactgtctcgctgtgttgcccagactggagtacagtggcgcgatctgggcttactgcaacctccatctcccgagttcaagtgattctcttgtctcagccacccaagtagctgggattgtaggcatgtgccaccatgctcagctactttttgtattttaaaagagatgggatttcaccatgttggccagggtggtctcaaacttctgacctcaagtgatctgcctgcctcggactcccaaagtgctggcatgagtcaccgcgcctggccttctttttcttctgctgtgttgccctgagggccaaccctgatctggagctgagtagcaccagtggcaccagcagctaatatcagtcagtaacattaattgaccagttgtttaatatagagagcactaaatagatcctgttaaacttactgaggaagctgaaacatagacacaatagaaagcctgtttttctggtcagaggaatcaggtaaatggaaccctgtgggccagagaatggtagggaatcttggagaagagagagcttggagaagcggataccctaattgtgcatatgaatttgcatattcctgacttaccccaagctttaaatgcacaagatagacccaaattgttttttattttgttttgtttttgagacaggatctcattctgttgcccacacagagtgcagtgatatgatcatgactcactgcagcctcgacttccctgggctcaggcaattatcctgcctcagcctcttgagtagctgggactacggttgtgcgccaccatgcctggaattttttttttttgtattttttgtagagacagggtttgccgtgttgcctaggctggtcttgaactccgagctcaggtgatctscctgccttggcctctcaaagtgctgggattacaggcgtgagccacagcacccagccaacccaaaatgttgaaagtaagatttgaactatcatcagagtctcaggctagaccctgagtggcacattcatgggtccaagcttaaagcaggaaagtcaaggcttttgagaactgagctgacgttggaaccactgtataaggtaaaacagaaattgcagtttgaacctaactaggttatatgcttgctgaaataaacaaaccaaaaagctagtgttcttcaaaggattataacaagacccaggactcagaatttatacagcataacattcacaatgtccaggagacaacctaaaattatttgacatatgaagaactgataaaacattactaaatctcatgggaaaaagcaattaatagatgccagtcctgagatggtccagatattagaaatatcagataattgaaagcagctcttataatggtgcttcatgaggctaacacactggaaaaaatgaaaaggtagaaattctcagctgagtagtagaaactataaaaaagacggaaaaatacaataatctgcaatgaaaaatttactacatggactccatagccaaatgaaagatataggaaagagtaaattaacttgaaagtaaaccattagaaattattaacaaaggggaagacatgctgtctggcagctggagcgtgcagactggcgtggcacagccatgcagcttctggagtttctgttggttagagattcaggagtagcttggtgggcagttcaggcttggaggtttctcttatagttgcattaaatatcagatgaagctacagtcattagcaagcttgacaggagccagrggatcaacttccacagaggctcactgacatggatcactcatatggctgggtgttggcaggaaacctcggtttctctctataaaagcctccccacaggacggctgcagtatcctcatggcatggtagctgattccctcagaggaagaggtctaagagagaacaagacggaagtcacagtgacctggttcattgaaattatggctgtcacctccgcagatcacatacacaagccctgattcaatatggaaagactgtacaaaagcacaaataggaggaggaaaggatgattgggggccatcttggaggctagctgtctcacacattatctctgaaattgctgttttttaattttgaaattttcaaacatatgtaaatgtaaagaaattggtacagtgaactcccatagacccatcattcatattcagtaatgatcaaggaaatgccatcattttattttgtacaaatatccctgagaaacatgstctttccacctccagccttcatctaaacatcttatactaactttctttagatttcagtgttccaggctctctccttccctcctctttctggtatgtttatggggtagaggcaagaccaatgcaaagaaagaaggccctttawgctgggcatctaggctttttcagacatcctctgaaacctaggcagagtctcccaaacctcaactcttaaattctgtgcacccacagggttaacaccatgaccatgtggaagccaccattgtgacttgtaccctctgaaacagtggcctgagctgtacctgggcccctttgagccatagcaggagtggctaggatgcagggactagtgtcccaaggctgtggaggacagtggggcactgggcctggcccatgaaaccattcagtcctcctaggcctctgggcctgtgatgggtaaggctgctgggaaggtctctgaaatgcctttgaggccttccaccaccccctggtggttttggctattagcacttgcctcctttttacttaatgcaaatttctgaagtctgcttgaattccttccctgaaaataggcttttcttttctaccatttgccaggctgcaaattttccaaacttttatactctgcttctcctttaaatgtaagttccaacattaggtcctgtctttgctcatgcatatgagcataggctcttacaagcagacaggctgctttgctgcttagaagtttcttccaccaggtaccctaaatcatcactctcaagttcaaagttctacaggtccccagagcaggggcacagtgcattcaggttctttgctaaggcataacaaaagtgacctttgctcacttcccagtaagttctgcttttccatctgagaccttgtcagcccagcctttacttttattcactatcagcactttggtgacaaccatttaaccagtcttcagggagttccaaactttccctcatctttctgtcttcttcagagccctccaaactcttccactctctgccattaccaagttcccaagttgcttccacatttttaggtatctttatagcaatgccccactcttcagtgccaattttctgtattagttcgttcttgcattgctataaagaaatacctgagactgggtaatttataaagaaaaaggtttaattggcccatagttccacaggttgtacaggaaccatgatgttggtgtctgctcagcttttggagacacttcaggaaacawwatcatggcagaaggcgaagtgagagcaggctgcttcttacatggcaggagcaggagcaagagagtgagtgtgggaggtgccacacacttttaaacaactagctctcacaagaactccctactgtgaggacactaccgagggggatggtgctaaaccatttatgagaaacccatccccatgatccagtcacctcccaccaagccccaccttcaacactggggattacaattcatcatgagatttgggtggggacacagatccaaaccacatcagtagatctagggtggggactgatattctgcatttctttctttttcttttcttttctttctttctttcttttttttttttttttgagacagagtctgactctatcacccaggctggagggcagtgacaccatctcggctcactgcaaccaccacctcccgagtttatgcaattctcgtgcgtcagcctcctgaatagctgggattacaggtatgtgacaccatacccggctaatttttgtatttttagtagagatggggtttcaccatgttggccaagctggtctataactcgtaagctcaagtgatctgccccccttcacctcccaaaagtgttgggattacaggcgtgagccactgtgcccggcatactctgcatttctttctttttttttttttttgagacggagtctcgctgtgtcgcccaggctggagtgcagtggtgcgatctcagctcactgcaagctctgcctcctgggttcatgccattctccacctcagcctcccgagtagctgggactacaggtgcccgccatcacgcgcagataattttgtttttgtatttttagtagagatggggtttcaccatgttagctaggatggtctccaactcctgagctccagtgatctgcccgcctcagcctcccaaaagtgctgggattacaggcgtgagccaccacacctggcccatactctgcatttctaacaagctaacaagatggtgccaatgctgctgatccacagaccacactaagtagcaagagtctagagctgtgctgcccaaattggtagccaccagccacatgtggctatttaaattaatgaaaattaagtagcgttataaattacttcttcagtttccctagccacccttcaaatgctcaagagtcatgtgtggctagctaccctaccgaatagcacatcatcacagaaaagtccgctgcatggcagtggtatagagaattgacccatagtaactctcctacagctgatttttagaccagaacaattatttattcacagcaaaagaagagctgggcagggtaaacagcaacaggttacttatagtatttatttcctctttctggaayggacaacccagtgttcctaaagacaatatggaaggttgttttgttagctcaacacttgagcaaaagaggktggatatgtttaccagattgtgagaatggatgaattgcttttcttcacactagaagtatatttctcttagtaactagtattgggcataagaatcagggctgagaatgctgggggaagacttcctattaagaaactgcgttttggctgggtgcagtggctcatgcctataatcccagcaccttgggagggcaaggtgggcggatcacgaggtcaggagattgagaccatcctggctaacatgctgaaaccccgtctctcctaaaaatacaaaaaattagtcaggcgtggcggcacgtgcctatagtcccaactactcaggaggctgaagcggtagaatggcgtgaaccggggaggcagagcttgcagtgagccaagatcacgccactgcactccactccatcctgggcaacatagcagattcaaaaaacaaaaaaaaaaagaagctgccttttgactcctttttaaagacataatattttgtctgtttacatacctgcttcttcattagaatgtaagctccttgagagcaaggatttgcccttgatctaactcctattaggcattaaaaatatatttgtgaattaatgaatcaataattatatcagattagcatatttattatatgttagtcttcctcaatgccttgtggagggataaggatggagcatgattcttgggcttggatgagtcacagatgtataatggctgtgtgactttgggtatttcacttcattctgctaaatctcattccattatctttaaaatagggatagtaataacacctaagcttgctttagaaaattattttgaggatcaaatgagctaacagttgtgaaaatgctttgtaatttgtaattattgtcttaaaaaaaccctagttttttgggtgagagagtctttggtctcaatgtcaatatatgtacagatcaccttgcccggatgtgtgccttgtacttgcattctaggatattgcctgtttggaacatctactcatattttcatactgtccctctctgggcaactagcttttgtaatttacaaatatttacaaatgtttaacaaatttaaaggttaaaaacaaatttaaagaaattatccacacagaagtacaaaagagaaaaaagatggaagaaaaaaacaagagcgtcagggaacgaagggacagtatcaacaggtctaacattcatgtcattaaaatccagaaggagaggagattgggcacagaaaaaatatgtaaattaataattgccaaaaacttcctattattggataaagatataaatttacagatttaagaggcctgttaaacccaaacaggataaactcacagaaaggcatggtcagaaaaatcaaamtgctataaaacaaatgtaagggagacctagtctctccccggatcaaagaagaaaaagaaaagtaaaggtgaagcagtatggtgtacagtagtccttggtcacagacatgagttaacaaacttagttttgttttttttgtgtgttttgtttttgcatctcttagaaattttgctctttgaagtggccatgtgagcataattacaatttgtttttgtgctatcgaaagggcatatgagcgattttctttcatgtgagacttgtaattgaaccaatatattcttaggtagattttcagtaagtagtcattggaaaatgctatatttttagcctttaaaaataaagtcaaaacctcaaaatatctgttttaggagggtgtattctcttagtctttttatttttcattctagaattgggcaacaccttattctataaaatagaacatagcaaactttaaggtcaaagagacgtagaatttgattgtgggaattttgtcaaaaatatcaaggttcaaaaaactttaccaaagtaggatcacaggtcaatgtgaaataatagtcacttatctcatctagagtgataattaaatggcttcaaaaggcaaatgcagaaagttatatagttgtagaaaaacctgagttctttattagagagttttcataagtgatcagatagaataaagacaacatgaagcacagggaatcatcttgataaaatgcagaatctttgtttttttagaccagttacctaataggtaaaggaaaacctttcattatttccaagaaaactaaataccacatttttattatctaatgtctggctggttgcttatacatttactgtatatgtaatatgagacttattcattttgagtttctgtatgaagcttttccaattaagcaagaaaatgatcattttcccagtaggttttgctttggtatgtcaagagggtcatataaccagtgtctgagggaaaaaaattgaagctgaaaaatatgtttttggttatttcttttgataagtaagcatcttaaaatttggattgcctacaatcacatgactaaaattaattaaattaattacagtcaccaattataaagcaaggacaattgaatataatcttaattttaaaatagctatcatatgttattttttccctttttttttttttttttgagacagtctctcgctctgtggcccaggctggagtgcagtggcgtgatcttgactcactgcaacctctgccttctgggttgtggcgtttctcatgcctcagcctcctgagtagctgggattacaggcatatgccaccacgcctggctaatttttgtatttttagtagagatgggttttcccatgttggtcaggctggtctcaaactcctggcctcaagtgatctgtccgccttggctttttggtgtgggattacaggtgtgagccaccacgcctagcccttcttacttttcttaatgagtgatacacgaatttcctatatcacttttaccagttataagaattcaaatttggtcacaatactggtaccaggtaacttagaagattcaattttccaaaattaattatttgatattctaatttttagggatttggtaatagatagtaagtttaatggtataagtttaaaaattttatttttatagcaacaatgtgttatgatagtgttaatttggtatgattgttgtaattaacacctatccracttcaggtgttaatggctaaaagacttcccttttctcatttgtatattttctagtatttctctgaaatctattaatttactatttgtggactttcttgcactattgacctgttgtattctaataaacttttatctacttttataaatagtacaattaacaccaaaaggtgatgaaaatgataaataacagctttggattttctttattcttgttgttttgagatagaatttcactctgttgcccaggctggagtgcagtagtgcaatcattgctcaccgcagcctcaaacttatgaggtcaagtgatcctcctgccttggcctcctaaggtgccccaggttttaagttttctcttccttattattttttcagctaattcaacttttaagctcagtatcagtgttctgaaacatttttggtaggtattctttgtgagaatgacacttagctcctttcaccactcccagggatgatggaaaggtgtctcctccactactgtatagatcctgcaacaaaagcagtttttgtcctttggagctaaaaagttagcagctatattgatatgaagccagtctttcaagagtaattgagtaatccatctcgaatgaggaaatataagaaaaagattcctccaaatggaatgggaaaggaagagggaagttgagaagttttaggactgtttgagcaaatatgaatgccttttatatatggccacagaagtagattgtggcttagctcacctggttttgtctgtttttctagttgatactaatcattgttattacattagtttcatagaattaattgtgtccattctagccaccatatcgtgtgggcacatctgacaaaactgaatgtcttcatcttgttttcagctaatggtcgaaagccattcagtaaaactcactatttggcctgttataattcacctaataagttggttggatattttgtttgctaattgaacataaaatgctgaagatatttgcccatttctatttgtttaaagtaaattttgttttcatgttgaattttctcttactgtgcttcttttatgtgtgagcactgtttttctgcatagttttgaacttcaaggagcrgagtggtagaaaatgtgcaaacccccaaaataaggtctagacattggattttaatttttaaatctctcctctcagtatctgatgttgttcacttcttatataatgtacagtccctctatgtcacaattaattcttgatatttatgttaaacaagatagacttttgtttaaatctcgggtacttgaagagttttctcaatttgatattagggctacagagagaatttgttgaagtgttaagagaaatacatactaatttatattttaaccagaggttatccatgctcaaggatttattgtgtgcttagtgacatgtaataatcaaggtcatatagagccctgaagttgaagttgcttgtgtttctgtagtgtgcacatgtatttgagaccttctttaataaccttcccagaagctcagggcatgctgacaaaactctatgcttctccagtttattttgtgtttattttattcttcaaacaaatggtagtttttttgggaaatggtctatattgtagcactgtgcagttttataagccttttgggatttactcttgccccttctaatacaaggcaatgtgaataattggaagaggtttagagctgattttctaaagtgtgttttggtagaatactaattctgtagattgttaatagatattatatgggattaaaggggttgtattgttaaataagtttgggaagtacaggattaaataatattgaatatgtttcttttgtagagggcttttgagaatttttcttattgtagtgtgctttgtgaattcctaaaagaggaatggatctacaaagatttgaaaagtccagaaacataggatagaacttatatttaagtatatataccattgttcttgtgtttacagaattttgggcattttatacttttgtttgcttttttcagattaatgattggacccattgttaattttaaaggtacctcttctgaaaagtatctgaaagttgaataaaaacattgagcatatatttggaaatgtaactaacacattgtttaaaaatacattcatcctatctttctcaggctcactgtatactgtataaggaggtttctcagtttttttcactggagagtatttttcatatggatcattttcaggaactaaagttctgtgtaacctactttggaaaacatagatctggctctaaaatattcttcaatttggctatatcatgaagtgttcagttttcataatagagaagagatattgcagaaatttgctatgtcatattcactgttagattttggtttgatatcattatcccagttctgccaattactagctctgtgactcagcttcagtttttgcatctacaatggagataataatagaagttaattaattttaagatgtagtattgtaaattaaatttgtgttaattaaaaaagtttttaaattttttttaataccattataaatgtaaggccagtcacggtggcataccttttgggagaccaaagcgggaggattcattgaggccaggagtttgagaccagcctgggcaacatagtgagactctgtctctacaaaaaaatttaaaaattagccaggcatggtggcatgtagctgtagtcccacctactcaggaggctgaagtgggcggatcactggagcccaggagttcagttacagtgagccttgattgtgccactgcacgtcagcctgggccacagagcaagaccctgtatctagaaaaataaataagtttaaagtgggagggaaattggctaaggttattgctaaggaaaatgatatcttagagattcctagaatcatttagttttaaggattgatcacgttgtttattgattttgttaagcaaagtattttgtagtaaagatactcatttgtacaaaatatcacaatttgagttttctgtcaatgataattttttttaaaatgacatttaagatgaatgttttaaattataataatacctgttcacagttgaaaattaaaaaccatgcaggagggtgtaaaaagcaaaagccccaccacattctctaatctcaatccactagatgtgtagaaaccatccactatttaatctgccatacttattccccagctgtaactactattaactgtttgtaagaagtatcttatgtcaaagtctaacttcttctttttttgtttttattttttatggtggagctgtgagttctttggaattgtgaacattcttttgaaatatggagcccagataaatgaacttcatttggcatactgcctgaagtacgagaagttttcgatatttcgctactttttgaggaaaggttgctcattgggaccatggaaccatatatatgaatttgtaaatcatgcaattaaagcacaagcaaaatataaggagtggttgccacatcttctggttgctggatttgacccactgattctactgtgcaattcttggtaagaaattctaccatagtcgggcttaccctttttgagtgaatatactacctttaatttccttcagttgagatcccagtgtttggagaagggtatctgtgttttgactgtgatggctgaattggggtgaaggagttggtggctgctaataatgagattgaatttaagcacagagtcctgggaaaagataagaggtgactggaaggaggtatgaggggatagatgccagtgagctcttctaagagggatatttcttcgacttctgggcattcctcatgcttctcttaaaatgcctgtaacagaagaaagaatgcttggagctgctttggagatttctgttgtctatccctcagccaaccagactgaatagtcctgccgtacagcatcctgtgtatttgaaacttgtcacccttaataaatactgatttctgaagtatctgagactatagtttgtttacttcaggtagttcctcagaagggcaaccctcagtgagagattatacaaacgccgagtcagaattttttggggggcaagaagaagactctttctattaacctccagcctttgcaaaaattgttagtgtcctaacacaagtaattgtagtagcgagaggactcttggcctaataattcaagtcaaatgagaaaataaaatggaagtcttcaggaaaatagaggacttgttattttatagaatttcaataaaatatctagaagtcttcactttcgtgtttcaattcttaccccgtgtgatgtctgtccctaaggcactaattgtcttcttagaaacactccttgtgtttttctaccaaagctattaactctgattcgatatgacttgcccagtactttcagccttcatgctcctttctggtttctaatttatttatttctgtaaccaaaacatagaaactgtctgatacctactgctgtggtttgaatgtgtctcaaatttcaggtgttggaaacagtcctcaaattcatttgttgatgatatttggaggtgagatatttgggaggtaattaggattagataagatcatcaagatggtgccccagtgatgggactggtgggtggctttataagaagagagactggagctgatatgcttttgttctctcaccgagtgatgacctctgccatgttatgacacagcaagaaggccctcatcagatgggccccttgactttggacttcccagtctccagaactgtaagaaataaatgtactttctttataaattacccagtctcaggtattgagttatagcaacagagaatggactaagacagaaatttggtactgagaagtggggctgttgctcataacgattacctaagaatatagaagtagctttcgaactaggtaatgggtagaggctggtaaagtttggaagaacagtctagaaaaagcctatatttccgtaaatggagtgttaagggtgattctggtgagtgctcataagatgagaagactaggaaagtctcaaccttcttagagattatttaagtggttgtgaccaaaatgttgatagaagtatggatagcaaaggccattatgacaaggtctcagatgacaattagcaataccctgttggaaagtggagtaaaggccatccttgttattaattagtgaagaactgggatgaactgtgtctatgcctaaggactttatggaaggctgaatttaagagtgatgaactaggctatctggtgggagaaataactaagtagcaaagcattcaggctgctgcatggctacttgtggccacttatagagagatgtgagggcaaaggaatgacttaggacataatataattagaagggaagaagagtagaaaattttggaaaattctcagcctggctgtgtggaaaagaatgaaagagaattttcaggagaggaacccaacgttgtgactagcaaccctttgctgagcagatttgtacaaatagaagatatcatcaagacaattagaaaaaaaccttgaaggcattccagagatctttgaggctgtccctcccatcacaggcccagggctctaggaggtcagattggttttcaggagggtttgtggggtggtactaattctgtaggcatgtagaatgcaagagctgtgggggcatggattcctccacctagattccagaggttgttgaaaacagtctgggggctcaggcaagagacctgtcccaggagaagagccactgcagagagcctttctagagcaatgcccagtagaaatatagggttagagctgccacaaagtttctaccagggcaatgcctagaggacccatgggagcagggctgccattgagacctcaggactgtagagctaccagcatgaagtgccatcttgggagagctgaagtctgagcaaagccataggggcgccataggggtgggactgagcctagcaaagtcataggggtggagcttcctgaggtagtggaggctcagcctccatcccagtttatccaggaagccctgaagtggagtcagggaagattatcttggagtctcaaggtaatcctcttgaattttggacttacttgggtcctattactctttgcttcttggatatgtctcccttttggaatgggaatgtttgtcttatgcctgtcccaccattgaattttggaagtagataacttgtttgatttcacaggctcacagctsgcaggaatttaaggtaaattatgccttgagkctcatccccctcagataccaaaatctatgtgttactggaaaggggtcccaatctagacccaagagagggttcttggatctcgtgcaagaaagaattcgggrcaagtccatagagtaaagtgaaatcatgtttattaacaaagtaagggaacaaaagaatggctatttcataggcagagcagcagcacaggctgctgagctgcttatacttattgttacttcttgattacatgctaaacaaggggtgaattattcatgaatgaattttccaggaraggggtgggcaagtcccaggactgagggtttccccctttttatactatagggtaacttcctgaagtttccatggcattggtaaactgtcatggggctggtgggagtgtcttctagcatrctaatgcgttataattagcatataatgaacaatgaggatgaccagaggtcactttcatcaccatcttcgttttgatggggtttggccagcttctttaccaagtgctgtttcatcagcaagttctttgtgacctgtatcttgtgcggacctcctgtctcatcctgtgactaagaatgccttaatttcctggggatgtagcccaataggtctcagccttattttacctagcccctattcaagatggagttgctctggttcatacacctctgacacatggatgctcaagtcccttatataaaatagcatagtatttgtgtctagtctatgcacttcctcccatatactttgtcatctctagattacttataatacctaatgccttataaatgctatgtaaatagttgttgtactgtattttaaatttgtgttattttttattgttgtattgttatttttcattattgttgttagtattctcaatctaccattggttgactcttaggatgtggagggctatctatagttctattactcaattttagtaatccttaatcccttgcctaacctgagggatttgtgccaatttttcttgcttcttcctgctcctaaattaggaaaaacctaagcagggggaaaaaatcaaacattgcctattttcctttcctccccagccaactaaatggactacttggaggcagaaggatttatttagctttattctcttagaaggctttgtaatttatcccccctttcccaattctgatactgctcccccattttccyccacttgtgaacagttgagaatttttgtcgcaataagccattgggtgtgtgctgtatttatcggatatgtgaaatagaaaagaattaagaactagtaaagtagaaactattttgaagtaagttgtgaaactttcggtattctgaatgcagaatgccaattacatgttttttactcctgaggagtaactttggttactttatattcattagaaaaaatacagtggaaaatttaactttagcaatgaaaatgcttaacatggtcaaatttttgttcactgatcttttttattgaatgggtaaagccartgtttacactgcatatgataaatgttttgctttctttgatcaaatttacattcaaagagctattataagaaacattctataaaaattccaatatgttgttaaagtagattttgattgttatttatatcacatgtaggtctgttgcttaatctttgtcacgtaaattataaacatattttctgggtattgcttgtcttaaacagtcttgaaaatgtatctggctgaataattgcctgtcacaatatttaaatgcaagactaagtattcctctscctgcgcaccccacccccatttaatgggataatagaacataaatgtcatttgtgcatttagttgattaaatgtcactcgtttatgattgtacaactggtctatacaatgtaatggtcwctgtagtaaagtaacaatacatttttagtggcattatcagtgttggtaaaataaactcaccgttatattaactaaactgtgcaaacagatttacttgtcatgtatatgttcagataactgcataaaaatgactttgtgtttggtcacagtaagacctaaagtgcattaaggcagaaaaatgaaatcgttaaaaaaaaaaataaagaaccagaaccaagtaacctttggtttgggacccctagaaagtcaaggaaattgtttgtctttgaatatattgtatcatttcatttatcctcagtatttctgataagttgtgatttcactgagatatgctgagaaataaaatgttttcccaagacatctgtgctrccctttaagttcttccttagatgtttgcttattggagaattaagaatttgggaaataattttcataatctttagtccatcatttcaaagatattttgactccaaattaccagaagtgtctttgagatggtgagcttagattgttattcagtttatcttctttccttgtatttcctttccttcttcagttgttgttgctcsgtaatacctccaaagaggtgaccttgagaagaatttctgttttggtagtaattactagaagccctagtgacttttttttctccaaccattgtgatggtagggggggtctaattgaatacaggataagtaatcttgttaggatttagagttcttttaaaggtttgactaaattttaaagcttctaaaaatataatactgaagttttcaaatcgtttctggtaataccaatttttcrtataatactttatagttttaaaagtatgtttactatgttatctcatattattttcacatatagttccctgaaatgggcagcttatgtattattctcattttaaaaagcaggagcgagagtttaaataattcaggcaacctgtttataagtagcagaagcagtattaaacatcaagacttttcttaagccagtgctctttccattaggtttcaagtgcttataaattttgggttagcctcttttgagtgggttggtagggaatctgacgttattttgaaagaacagaggaaggcctgtttggaaccccttctttcagtccttaaagacaagtcttattctgttacatcgtttagggctgaatttataatggggggaaggttcttagaggagaacagctgtgcatccctgggagttgggcagaaacaagccatacttgtacacttgtacactcagtttagggataacttggggtgtttgggctttatccttttaggattattaaattatatgtctgtaaggatggtcaatttacatttggcaagatagtccaaatgggaggaaataatggcaaatccactgatgtcattggtgctgtcacccatgagaaggaaagttcctactctctctgaggttcctcttgtcatctctwagacagctacatagaaagtcaattcagttaataggaacctgtagatgattsttaatatcctctgatcttgcctctagttacataaatacttaacatgccctrgttttctgtctgccctcctcattgagattttgtaagaataggtatgtggtgtttgtttcaagtacgaacccttggcatgttttgtttctaatattatattaacatcttgctaacatagkattgactcagtcagcattgacacccttatcttcactttggagtttactaattggaagacacttgcaccagctgttgaaaggatgctctctgctcgtgcctcaaacgcttggattctacagcaacatattggtaagaaagaataacttttaaacacacttcactacttttccttctcttgcttctctagctgtgttgtaattttaagtgataagattcatyggtgaacacaaattagacataatttgcattttcttatgtgaggaaaagatggggttgttaggggatggctagtaattcccttcagtaaaaatcatatttgattttataatcttagcctaaggaacatataaagaaaagcagatgtttactgatattttaattttatgatatccttttatttttaataaggattatatacacaaaagtaggtcctaaaaatctgcttattctgtactttgtggtcagaaaaatgctaaacttaatttttctctttggaatgtctgtggagttatgttctctgtgtaatattttatcatatctaaaaggaaatgtaaccattctttatacctatccttactgaatgtgtatcagtctgttggtatggtataactgtggagataagctgagtgcacattctgtgaactggttgatattttaaaagactattctagaacaaaatttcaacttacctcacttaaaaaaatttttaagctagttgaaaaaatgaaagaaaacacagtgggggaagattttgcacagggaacaagtttaaactgaacataacatatgcaaagtatccctatttactttttcagatttattttgctttgactatattttgttaaccatattatatgtcttaagttaggaaaattgtttcttcactgctatttttacatgaaatgtaactcttcataaaacattttgaataggtttttaacaagtgaacttattcatatgtagaaatgtgtcttctaatttttggaaaattacatttaagtaaattttctcaatcaaaaacagacattcaggaaaataggcttttgaactgaggtgtattcaaactgttaagagaggtttctgttaaagaaaaagaattgatttggagtctttcagccttctagtatagaatttctttaatgataatgttggaaaactcactctgtgtaactcttaatgttgaaaattgcatctgcttttactaattatgtatctgcagcagtagagaacaaatatctgttcagaacagatagactatggaacaatggatttgagaactaagagtcaaaagaggaagcatatgccaaatgggaaaattattgctacatatcgattagtaaggatatatgagagtttacccttaagaccttaacatatggcaagtttgtccagatgaaggtaaaaattgtgcttgagtactgcattaccctgcagtagactaaatccatcaagggcttcttgtttaattaagtactaggtagagtttgtgtagggtaataatcatcatctattgagagatttttattttggctgaagattcaagaaaacctttctcagaggctttttctgagctaatgtagctaatggttttctggtttgtttctctagccaagccctcttttcttgtttccagtctcatttatcccaactatcttttggacatctccatttgctatctcacatcttgacatatgcaaaattgaacttgttatttttcctacaaattcttctgttttgtctctgtttcctggttcaggagatgaggtggtttgggagtgctgtttaccaagagagcgagttaacactggaagctgtttgttatttcatccatagcataggggtgatttttgccccccctgtagacatttggcaatgtctgcagacatttttttggttgtcacaattgttagggatgctattgccatctaaggggtagaggccagggatgctgccaagcatcctacaatgcacaagacagcctcctacactaaagaattatctggctacaaatgtcagtagcgccgaggttgagaaatctggatccacagtgactcttgtgttgtcctatcgtggaaaggctttttatccctctccttgttacaacctgcttggggaaagcttgtattcttcctcctgcttacattggtctctcagggtattctttggtgcttcctcttctgcagacagtaggtaccattacaatgctggaattttagtaagactgggagaaaaacttagttgcctggctttcagatgggattgtgactctcttcctttctataattcaggtctctcttgggggcaccctttactcatcagtttttaggatactcaatttctgtatgttggtcatcgggactccctcctttaccgggattttgagctacaggatctctagtaagcagaagcatgatcagggttttaatactaatgggctcaaacccagcaggacaactctttgattaacctctttacaaaactgaccttcttgcttttacccctcttcctccaataacttatcataatgttaacaaccgctgccttatcaatatatttaaaaatttttttttgaaaagatacttcttgcacctctgccactgttagtaaactcttagataattcctagcttcctagctccactcagtattcagtatgtatctctagggaaatatttttctcccattttttatttgagcccttttcaagtcctggagatgccatgtacttggtcaaaattattctttcctcccctttttcctccctaagtaagtagcaacttgccatggtagtttataaacaaaagtaacaacgcatttcttgcttctcatcttttaatcattgagtcagatttgtcttcaaaaagtttctagcatcagaaaggaaatgtataccaggtaaaatttastgagtggttgcagtttcagtaacaatcttttaatcaagtgcctcttacatacctcttagaaacatcagcctaaccacatagcaatagatgtcttactcaaaaaatttgccaactcctggtcaggtctaagtaattaaattcttatagataaaagcacttggctttagttcgtcctgaacctttaatgattagatatatataattctatccagagtgttacaaatggatctggatcctagaagggatcctttaaaggaccccaggaaactctcttgatctttttatttctgtgtttccctgctttgttttgaaaaggatttaaaacagtttatataatacatatatattatcacaaaacagtaaaacagaaattaaaagtagaaggaaaagaaaaacgaaaaaaaaaaggtaggagatggataaaaaatggagtcagggaaagcgtagcaatgggaatttgatacttgtctgttgataggctgtacatttggctctgagctctgttgtcaatgacactaggtgactgggttcataagataaaataaacccattcctcagaatagattttcttggatgctrttacagcttcctagacaatgtcttggtagctgtggtttcttgggactttcttttacatggactgttgttatcataccaaagtacaattcagtaaaagcagttcctacgtagtcattacagtgtggttcaggtacctagacttctgttgctatgacttgaccaagagctagattttagaatatctgtaaatggatggcctgtgtgccttttgagcagttctctctaaatattgtatgtctcaactcagtttttaatttaattaattaattaattwatttatttatttatttggggggacagggtcttgttctgttgaccaggctggagtgcagtggcatgatcatggctcactgcagcctctacctcctgggctcaagcaatcttcccacctcagcctcccgagtagctgggatcatagccatgtggcaccatgcccagctaatttttgtattttttgttgagacagggtttcgccatgttacccgggctgctcttgaactcctcctgggctcaagtgatccttccacctcagcctcccaaagtgctggtattataggcatgagacactgtgcctagcttcagcttagtttttagtagtagtacatagcaatgagttcaaagttatactacctaagaagtatcagagtgcagatattttgtattgcaaattggattgagaacatatgtttaagtaacagttgatcttcaaagtagaagcaaaagaaaaatgaaaaatgaaggttgatctgtggtagggtaagtactccaggaacattatgaggattcctagctaaatatggtgggctaagcaagtatccagtttaagcaaaaatttcccttgaaactttgagcaatgccctagttttgagcaatgttcttttctcacatgcccttcaagataaatcatctgtggtaagtacaccaaggtaactacatatgataatttattttatgagattgttagatgcagaaacaaagcttagggttaggaatcattggtctgtaatcctttctgataataatgaactagcattccagttgtctgctaaagccatttctagtttaggataataaaacctattagtttttaaaagaatatttgtttttctgttttctttagcaagaacatgtatcttgctcagtttataacatatcattaagtcacttgttaaaagatgagagttggaacacaaccttattttatgccaaagaaaaattttaacttttctgctgacttcaaccttatggtaatgctctggtgcaggttctgcatgaacagcagacagaatataatggttaaaggttgaagctctagaattaaatagacatgcctccatcactttctcttttttttttcctttgactacccaaatttattcattttaaacttgacatgatttatcttttttaactcttaatatagcactagaccctctttaaaatttcatggaaataaaggatttatgacatatttaaaatttactggctaaaattttaaaaaaaatttagatcaatttattttaggccattgtaatctggtttatatggtcctagagggataattgtgtaccacaaatcctttttcttttttttttcttacactttaagttctgggatacatgtgcaggacgtgcaggtgtgttatgtaggtatacacgtgctctggtggtttgctgcacccatcaacgcatcttctacattaggtatttctcctaatgctatccctcccctagccccccacctcccaacaggccccagtgtgtgatgttcccctccctgtgtgcatgtgttctcattgttcaactcccacttatgagtgagaaaatgcagtgtttggttttctgttcctgtgttagtttgctgagagcctccatcactttctagctatggagaagttacttatatccctgagctttggtttcctcaattataagaagagatggtaatagtagctacctcatatcattttcacaatagatcttgtcattgtggcaaagacagacctcagttaactgagttccgtttcatttttatcttccctggaacaaagaaagactggatttttcagctttgattgttacatgattgaggcaagtggtcaaagcataaaccattgcatgtaagcactctttgctctccctttccttgctgaagcaatttgaaagctcatgtttgagatggtggttacacaggatggttgacacctgggacactcaagtgtcattttaggagaattgcctgacctgcagaggattttgcatgagcaagaagtaaacctgtgttgtattaagacactggtttttcgggtttatttgttagcatagcataacctagcctatagccaagttaacttacaaccagatcctatcccagagtcagtgaccaaggaaaggtcaataaaaacaacaaataggccaggcgtggtggcttacgcctgtaatcccactttgagaggccgaggtgggaggattgcttgaggccaggagttcaagaccagttgggcaacatggcaagaccccatctctacaaaataaaataagaaaattagccagacatggtggtgaatgactgtagtcccagctgcttgggggaggcataggcaggaggatcgcttgagcccaggagatcaaggctgcagtgagccgtgttcatgccattgtactccagcctggatgacagagcctgatcctgtctcttaaaagataaaaaaagagctacaaataatggagcagtatatacttggtaagagtatttatatgagtgatctatggtgcaataactcaccacttgctccttattttaaacattaatatgcaaagccctaacttacagtttttaaaggacatgttcaataaactaagtttggtgggaagtggggcagtagtgggccttttaaaatatatgggttaaactgtgcagtttgtctatcatgggggccatgatcatagagttaataaagctaaatatttagtgagaatcagagcccattcttcacagtagttcttaactctagattcatttcctctggatgtttttcacctgggtgaggcagtattactaagatctcaatcagtaattgcctgttatcttaaaaaactggacacatgacctttcatttgttgagctggaaactttcaacctcccagacaccagccatgtgtggaccttcacaagtttagcagattcgtgccttggttaacattgcctacattctaccttatttctagatttaagagccagactgggatttttgtttttgtttttgttttttttttagcgagaaatttatagttaaacttgacattttaacagggttccaactgcccacttacaattttaacttcacatagcctcttgttaatccaagttttttgggttttgtttttgtggggaaattcttattaaactagatactaatgggttgtactcacatttgctgggacattttgctgttaaaactattttaaagttatcagcatgtctgttggtacgttaagaaaggagcaattggccaggcgccatggctcatgcctgtaatcccagtactttgggaggccaaggcaggcggatcacctgaggttgggagttcgagaccagcctgacaaacatggagaaacctgtctctactgaaaatacaaaattagccgggtgtggtggcaagcgcctgtaatcccagctactcgggaggctgaggcaggagaatcgcttgattctcctgcaggaggtggaggttgcagtgagccgagattgtgccattgcactccagcccgggcaacaagaatgaaactctgtctctctcaaaaaataaataaataaataaataaggagaaattatggccttagagtaaacagaggtgtttttttttacatgttctaagtatgagatcaccagtattggtttgaaagcccgtcccactctttccacataactactttatttattcactgtaggatatttactaggttcctgtctaaaataagtattatgaaaaagctagtgttaaatatcatctagcttcttagggaactgaacaagattagaaggaaaggtttcttktagctgcttagatgacagctcccttgaacatgaaaaaattaaaggtgaccaatatataaaaggcacaaaaccgtggctctgaggagggtgttgggggcagtgggtgaaaaattgttaaggggttaatgcagagttcatggtccttggtttgaaaatgagatatacttttattttctctatgatttgtctttcatggttggcctgaattacagaatttagaaccttaaaaattaaaataaccatccagaagtagaactgacccaatcacgagagctctcattttgcccaagtttcctgttggttctcaagatgatcaaaggaagctatagagagtagcacttcaagaggcttcttccatgatacttcagaaagggaaggggagcagaatcatgtgataataacgcggctttaaaaaggctattgtaaaggtagcaccagaacctcacttctgcatccctcttgcctcttctatctgtcatgaccctttttaagggagttcccatgtgacagttccatacaggatcagcccaaggcactggatgaagcttctaagaacagatcatttgtatctattggagattgtggaattttaagacccaccatttcttacataaagaaggactagattgtgtgaaatgtcagccaatgccctttctccaggttaaatgtgtgatctgctctagagtgtgtgattttggggaaaattctttgtaacatggttcatgttttttggatagagattcatagttggtgcagaattcatctggaggagacaaagaattagcagatgcagatcgagaaagagtcacttgccataatcctcatctttttataaggtagtctttccataccacatatatttctttggacttgcttcttagtggctgttaagataatgggccacaaaactgtagcagggaaggttaggaggttagaatatgctaagttggaaataaaattgaaacataaaaagactgtcttctatgatgacattttttattttctctggtgggggaaaggtggacaagtagttccttagtttggtgatcctgcgcagctgctttaattgtagatgagaaagttcttccatttctggagaaacattagttacagttgataggttaccatatatggtcagttctactttgtaattatcctccaaatccattcttcttattccatctcttcttctactgcctttgttgattgcaatgatcatttctgacttacttgacttcagtatactcctgagtgctcagcctctattatkctgaaaatcactgttaaataaaatgtgtttgaatataccatgccccttaaaaaagagaatgtaaaagaactcgatttctcccagagtaaaggacaaactctagcaaggcatataagggctcttcatactctggccctttccatgcctccccgtgctgtcccaccatgagtactgcatattagtacttgttttcctaaatactacacttcacagatgtgccaacattttctccaagacattaagatcctctaacattcctcccctgctccttttaacgttattgattcatacttgtagtaattcatctctaaataatctcctcctcagcgttatgtttcctgacactcttctaaccatttcctctctcttttacatattggctacattaagggtctcattaggtttcctaacacctggtacttacctctcaaactgcattgcatttgcagatttttgagagtgcaccctttaaaaacagaagagcatttttcacattctcctcatctgatcagaaaaatatcttctcagcttaagtccatgagatgtttcctataaactggtgagaagacagtgggactaccgaggataaactggctaaatccaaaagtgtttgaagattggttgatgggaggtcagcttctgtctagttgcttccattgacaatacatttttaatgaaatgctctttctcataatcagtgagaaccatgagaatcattatggctgatcctaaaactgttcgtctaaatcraattmtggtaatctcctttattcatgaattaggaattatttactatcaggaatagtaaaagcaataataatgaacttggtttgaaatgattaggtagagtggcataattgaaggtggaaaggtggttaggacagaagctttagcttctcatagtctgtccatttgagaacttctaaccactctgtagtgttagttagtgccaaatgtggaccactggcagaagtcttcagtgaagagaggctttcatggaagtatatttattggtaggcatgtacgaatctagttattaattccttaattagtggattccttgattacatgtcagctgtgtatcagacactggtttaaaatttgtaaatgatatagctaaagcatctacattaaaaaagtagaagaactccaaataacctaatgatgcatcttaaagaactagaaaagccagagcaaaccaaacgcaaaattactagaagaaaagaaataataaagatcagagcagaaataaatgaaattgaagcaaagaaaacaataccaaagttcaatgaaacaaacagttggtttcttgaaaatatacacaaaactaacgaacatttagccagactaagaaaaaaagatccaaataaaatcagagaagaaaaagaagacattataaccgataccgtagaaattcaaaggatcattagaagctactatgccaagaaatgggaaaacctggaagaaacggataaattcctcgacacatacaatcttccaagattgaacaatgaagaagtccaaaacctgagcagaccaataacaagtaataagattgaagctgtaataaaaatttcccagcaaaaaaaaagttcaggacctgatggcttcactgctgaattttaccaaatatttaaagaagaactaataccaatcctcctgaaactattctgaaaaatagaggaggaaatatttccaaatgtactgtatgaggccagtattaccctgatacccaaaccagacaaagacacatcaaaaacaaaacaaaacaaaaccaaaaaaaaamcactacaggccagtatccctgatgaatattgatactcaacaaaatactagcaaaccgaattctacaacacatttaaaagatcattcgtcatgaccaagtggaatctatcccagggatgcaagcgtggttcaacatatgcagatcaatcagtgtggtacgttatatcaacaaagtgaaggacaaaacccatatgatcatttcaattgatgctgaaaaaatatcggataaaattcaacatctcttcatgacaaaaccctcaaaaaaccgggtatgcctcaattcagtaaacaccgtttatgacagacccacagctcatatcatagtgaaagggggaaatacttgaagcttttcctctaagatctggaacatgacaaagatgcccactttcaccactrtgattcaacacagtagtggaagtcctagttagagcagtcagacaagagaaagaaagaaagggcatccaagttggaatggaagaagtcaaaatgtccttgtttgcagatgatatgattttatatttggaaaaacctaaagactccaccaaaaacctattagaactgatgaacagattcaataagttttcaggatacaaaatcaacrtacaaaaattggcgcatttatttatgccagcartgaacaggctgggcgcagtggctcacacctgtaatcccagcactttgggaggccgaggtgggtggatcacctgaggtcaggagttcgagaccagcctggccaatatggtgaaaccccatctctactaaaaatacaaaaattagccgggcgtggtggtaggcacctgtaatcccagctactcaagaggttgaggcaggagaatcacttgaacccgagaggtggaggttgcagtgagccgagatcgcaccactgcactccagcctgggtgacagagcaagactccatctcaaaataaaagcaaaaagtgaacaatctgaaaaagaaataaaaaattaatctcatttacaatagcaacaaataaaataaaatacctaggaattagtgtgaccaaagaagtgagagatctctacaatgaaagctgtaaaacactgatgaaagaaattaaagaggatacatcaaaagaggaaatacattctgtgttcattgattgaaagaatcaatattgttaaaatggccatactacttaaagcaatctacagattcaatgcaattcctatcaaaataccaatgacattcttcacagaaatagaaaaagcaatcctaatttttttttttttttttttgagacggagtctcgttttgtcacccaggctgaagtgcagtggcatgatctcggctcactgcaacctctgcctcccggattcaagcaattctcctgcctcagcctcccaagtagctggggttacaggcatgtgccaccatgcctggctaatttttttgtacttttagtagagacgaggtttcaccatattggccaggctggtctcgaactcctgactttgtgatccacccacctcaccctcccaaagtgctgggattacaggcatgagccaccgcgcccagccagcaatcctaaaatttatatggacccacaaaagactcataatagccaaagctatcctgagcaaaaagaacaaaactggaggaatcagattaccttacttcaaattgtactacaaagccatagtaactaaaacagcctggtactggcataaacacagacacatagaccaatgaaacagaatagagaacccagaaacaaatacagaaacctacagtgaactcattttcaacaaaggtgccaagaacatacattggggaaaggacagtctctttattaaatggtgctgggaaaactggatatccatatgcagaagaataaaactagacccctatctctggccatatacaaaaatcaaataaaaatgcattaaagastttaagacctctaactactaaaagaaaacattggggaaactctctagtacattgaactgggcaaaggtttcttgagaaataccccacaagcacaggcaaccaaaacaaaaatggacataggggatcacatcaagtttaaaagtttctgatgcacagcaaaggaaacggtcaacaaagagaagagacggcccacagaaggggagaaagtatttggagtttcctcaaaaaactaaaaatagacctaccatatgatccagcagtcccactgctgggtatatacccaaaagagaggaaatcagtatattgaagagaaaatgtttattgcagcactattcacagtagctaagatttagaagcaactggtgtccattaaaagatcaatggataaagaaactgtgatacatatacacaacagagtactattcaaccataaaaaagaatgagagcctgtcatttgcaacaaaatggatagaactggaggtcattatagtaagtaaaataagctaggcacagaaagacaaacttagcatgttctcacttttttacggagctaaaaattaaagtggttgaattcatggagatacaaagtagaagtctgggaaaggtagtggggatggggggtgagaggtggggatggttggtgagaggtggggatggttaatggatacaaaaatatagttagaatgaataagatctatttgatatcacaatagagtgtctaaggtcaacaatttattgtacatttttcaacaagtgaaagagtataattggatagtttgtaacacaaagaaaggataaatgcttgaggcaatgaataccccatttaccctgatatgattattatgcattgcatgcctgtatcaaagtatctcatgtaccccataaatatatacacctactatgtgcccacacaatttaaaaataaaaaagttttaaaaataaaaataaattctgttttaaaaagaagacacacatccagccaacaatcatatgaaaaaaagttcgacatcactgatcattagagaaatccaaatcaaaaccacaatgagataccatctcatagcagtcagaatggttattactaaaaggtagaaaataatagatgctggcgaggttgcatagaaaaagaaacacttatacactgttgatggaagtgtaaactacttcaaccgttgggaagacagtgtggcaattcctcaaagacctaaaagcagacatactgttcgatccagcaatcccataactgggtatatacccttaggaatagaaatctttctgtcataaagacacatgtacacatatgttccttgcagtgctattcacagtaacaaagacatggaatcaacctaaatgcccatcagtggtagagtgcataaagaaaatgtggtacatacgcaccatggattagaatgcagccataaaaaaagaatgaaatcatgtcctttgcaggaacagaggtggagctggaggccattatccttagcaaactaatgcaggaacagaaaaccatgtactacatgttcccacttataagtgggagcaaaatgatgagaacctagggacacgtagaagggaacaacagacactgtggcctatgttgtgggtggaaggaaggagaggaccaggaaaaaataacgaatgagtactaggcttaatacctgggtgacaaaataatctgtacaacaagcccccatgaaacaagtttatctacgtaatgaacttacacatgtacccctgaacttaaaaattaaatttaaaaaaattatgtgaatgaaaaaataaagtgaacatagttctttgattagtacagtggctaaaagggaaggattcagggttgtggcagagttttctttttgagatgggaggagcttgatcatgttttatagatcaagagggtctcagtttataaaacgacatcaaagattcagagataaaagggataatttgtgtaatgaaatttcgtgtaggccagttggagacgggattagcctcaggtagacccatttctttgagatggagaagaaagatgaggatgggctggacagagataaatttgtagcttggggattggaagctcagaaaaaaaaagcccataagaccagtttttactgtgaagttgggagtaaagtcttgctgaggaggagattgaagtgagaattgggtaggggacttggtgttttggaatggttgctgtgggaaaccaattgagaaccattgaaagatttgcagagcaaaaccctgcaggtctggtagaggttggaagtggaaccagttcatgtagttgtattttccagcattgcttagttttctttgtattggggtgcagaagcaaaatggttagattgatcctgggtattgtcagaacagggataaaggaactgaggataaaataattgaagtgatgggcccatggaatccagtctagataggaaaagaaatgagaaaggatgggacctgaaggatgagataggggaggagttgggacctgaggtctccatgatgttaaagattgggtgtggcaataagggagagcaaactctggaagaatagaaactggtgtctgttggagtttaaagacagaagcgtggatctgaagtggtgcacaagaagtataagaatgctaacattgccccccagaccttgcaacaggtgtagcaaggcatggaaaatgagaagattgtattttcaaaattggccaaggaagtaatttccttgcaagaatcaggcttttgtgaggagaagagggggaggcagaatgttctatacagagttcatggtagaatggggattcccgaggacttatctctcttcccatcctccacttagcatacatggcccagtgccttgtacctacatatccgtaggggttacatcaggatttcccaaagtcgggtgcatggggttgactgtgccaccacatttgtggtgtgctatagtgaatttttgttcatatgtgattgcttagtgcacctataatgatattttgtagttttaatttaaccacttctcacaaattggtcaagtggcttaaaacgatttctgtaaagaagtagtattttctgtagataatattaaaagtgcaagcacaagtgaaccaacataatcatcgtagagctgcattctcttgttatttaccaggcatgttatgtgataaaaatgatgaccacctgggttaccgggttgaaggcgggatggttgtggggaaatgaaaagatgtaggtcaaagggtataaagctgcagttttgtaggatgaggaagttctagagatcatgagaactatagttaaaaatactgtgttgtgtactggtaatttaccaagatagtaaattktaggcacacacatgcacacacacacacacaccagcaaggtaactatatgagatgatgggtatattaatgtttgtttgactgtagtaatcacttcattatggtaggtatatcaacataagcatacaaaacatcacattgtacactttaaatatatacaataaaataataaaaattttaaaaagctaaaaagagctaaaataaaaatgactaccacctaattgcaactgacaaatataaaattatcaagaaaatatttaaaatatagtctcacctttactttaacagtgagccttgtccttaacatgtagtgtgccttgagataattagctaatggaagaaccatactcagcaagacactctaatctacacattcggaacatgagggcaaaccctgtgatttttttttctcaatgttttaagtcctaggatgcccagtgcattattttttacmaaatttactaaacataatgataaaggcttagaactctttttgagttttcttattcaatagcaaaagacaaaaagtcacagaccattggggaaactcatgttcctcctgccacagtaaaactggctgaaataatatgaggacaaaacaaaatgcattccttattagcaaatgttgttaaaggagcatagaaaacactgctaaagcattaaagcagagttttttttwaaaaaaaacctgcagatagaaagtttggtgtactaagttggaaggagatttgtggtatttataacatgttacaacttagggtatttgttaagattctctttcagtgagagaataggcaattttttaagagctgctaaaggaaaaatgcaccagaaaagagatacagtgaggtgtattaacaacggggatacagtctgagaagtgctttgttaggcgattttgtcattgtgcaaatattataaagtattcttatataaactagatggtagagcctactacacacctgaggctacatagtatagcctattgctcctaggccacaaacttgtacagcatgttactgtgctgaatactataggcagttgtaacacattggtaagtatttgtgtttctaaacataggaaaagtacagtaaaaatacagtataggccgggcgcggtggctcacacctgtaatcccagcactttgggaggctgaggcgggtggatcacctgaggtcaggagtttgagaccagcctggccaacatggcgaaatcctgtctctaccaaaaatacaaaaattaatcgggcatggtggcaggcgcctgtaatcccagcaactcgggaggctgaggcaggagaattgcttgaacctgggaggcaaagttgcagtgagctgagatcgtgccactgcactccagcctggtgacagagtgagactccgtctcaaaacaaaacaaaacgaacaaacaaaacagcacaaaagatgaaaaatggtagatctgtatagggcacttactaggaatggaacttgcaggactggaaattgctctgggtgatatcaatgagtgagtggagagtgaatgtgaaggcctcagacattactgtatgctactgtatactttaacgccatatacttaggccacactaaatttataaaaaaattagttgatgttatgacacctgtgacatcactagataataataatttttcagctccattataatcttgtggggccaccatcgtatatgtggtccgtcgtttactaaaatatccttacgcagtgtatgcctgtattggcaacagtaatggcttatttaacagaatgatgtgttttggaaaaggtgtgtaagaatgaccattgaaggagtggtggctgcttttctccaaatgtaaggtaatggagataacatgaaatgagtttactacatcattcataggctagtataggagaagagttgaatccagaattgcacgaagtagtatcactgtggatactttcctaaagcatgacctttaaaatatattagagtctttgcagtactttataatgaggtgggagtgaccatagttattgtttatacatccatagttttgctcattgtctgtgatacaatatataaaagaacccttaagctcaaaggtaaattatgtgcttttcttttacaaaaatacagcttttccaattttcttgagctttttctttcttggtgataaatagctatgcaacctaccatgtattttgtaaaaattctgttgatttagggaagagatgacattttaactgagtgagaagtaactgccttctgaaaggaactcccctccatgccctgcaatgcaggttaaagccaagcaatgaaagaaacttttgctatgtggagatgattttgaaaataggtactaggaaatatttttattgttacgttattttcttgtgaaaagtagtatatatcacctggaaaaactctttcattgacatacttaaaacacttggaaatagttcccctttgttttgaactccatttagtaaaaatgcaaaactttctgattagcttataaactgattgatatcaggaaaaaatagaaatttaccagatgaattttgacaataactttttcataattgctagataggctagatagaatcctgatttagttcagctaagccacagtgtacttctcccatttagaccttatttcagctacatccatgtatcagaataaactgggcttagaaccaactctttgaattgctagatcactaagaattacattaataaagcctagtcaatcaccttgttcttgttaaaatattaatatttaaaggagtcttatacctttaaaaatgaaattatttaaagtatatatcttattttatattggcttattttattttatagtacaaataatgtttggttaatagtatacatgtaatttatatgtaaaatatatattggattctgtggtcagagactttactaatttagtgtgtaatcaaaacatttggagatcactagattctgtggtgcctgggatttgtgtggtgtttcactttatgaaatgcttttgcaaatgtgttccaacttgaacatcatcaacagccttttgatgcagggaagtgtcattatgcccattttgtagatgargcattattctcattttatggaaaggtaactgaaagtcagaatatttagatgacttgcccarggtcacacagctagttaatagtggcacctcagcgccagcacaggtgttactactagatggtgcttttccatttaatccattcattgcctctactggtcattcctttatactggccattcctattgttttgacttcatgtcctaatctattacttrtttttcagagttctcaggtacttgctttttgtgttttytctagcggttttagttatagtcaatgagagagacaacacaagtaaattaagaaaaactgggaacaaaaggatggawaccaacgagaaagacaatatattaatgatgaaaataaaaatggtagtaggtgtctcagaagtcagataaatgcatttgatgtgcaaaacatttcaaaggaaccagagaaatgtagttcaggcagataggttgtttgaacattggcctgagggaaggctaaagatgaatgtagaaaatatagtgggtgtgtatgatatagatatagttttgtgctatagtaaagttggcatttataagcataatgaattaagaattgtgacgtttattttgatcattgtgtgtgcttttgattttaacaaaactttgtataacaacatgtagtcttctattttgattgttctgccagtacatataacaaaatgaacaaaatagaggaattctgtataggaattaaaagttaaatattactcatctgctaayagatctatggataaactaagtttaacatattgaataaaaatgattgggtcagaaaagtgacttagaagtgtagcatggtttcagacgtcattttctaggttacaatcactgccataatccaagaacatggagatgtatttaacaaaactaaaatatagttttaataggttttcatgaaagtatgttttacatacagcttctgtggcctttttcgtattataaattcaaggcatggcttgatcttctagcctagtggcaacacgtctggaaataactatgcatcactaaaactttcatagggattttgtgtgctttgaaatattgcatatatggttataaaattcccttagtatttactggcatattaaacaaaaatggcactgacaggcatattattgtctgtgttaataatctacacatgaarcactccctcagttcagctgaacatagttcttacctctaattgttcattaggccagtgatctgttgtgctcttagaaggaaaaccaaaatggtgcaattaaaatttgaaccaatacctgaagtagctatacttttccttttttattattaaatggaaagatattctgaaatttatgatagtttcagtggtttagaagatgttggagaattatattgagcttatcatagtttaaagaaccctggactgggagtcaaatcattgagatctagttaacaacagctatgttgttgatgtgccacatctcagtgggcaagtcagttacgcttctcctaacaaatgcgaactggtctagtgtggcttgatcactaatggttaagcttctacacataattagcataaacaaatgatttattaagctttaaagatagacctccagtgatgtagtcacataatctagaaaagctggtcagcactacattaasttttagggtatctggaggaatcttcccagtcagcccatagaattttaagccagtgtagtctgtccactctgagaagctggagcatcattaaggatcccttatctccatgtgagcagctctcctccgggttgcacagccatcctttatcttccttctggttgtgtagtaagtattcatgttcctaagaatgtgcagaatgaagagattcaatttaacagatgcctgttaaactctaactgaatataagtagaaattctctttaaaaacacacactggattaaacagtcttgtcattttctctttcatttccatctgactatgtccattggcatgctctgtgtttgcagctggccagctacactctagaatgccagtgttcctaccagcagaggtgtgtgcttaccaaacagcagttatgcttatttctgaaactttttattacgttgtgcatattattggagttaaataattccagattgcacaagctaatgaattatgagtgtgaaaagagaatcattgttgctgttaaggcaaagtagaatgcaaaagacttgataaagataagcacagaacagaaatagatattgaattagacgtggctacaacaactgaaagcaaaaaaacctgtaaaaatatggaaggattatgcactcaccttgtttcatacatgcctttaaatccatgctgtaactcaaagaaagtgaaactgtgtccttatttatatagyggtgagtaaaaaatacataaataaactgcaagccatagatgttgcattctagatgtgttcatgtatccattttaaatyagaatgtttaaagtatgtatggttgttgtggtcacctgctttaaggtgagtttctattaactgaccaattattgttcatgatcctactaagagggcttccttatacttgatagttgaacatagtcaatctacttaaacctttggaaaacggtggtgtttgcagcttgggcctgctttccatatgtattcctgcaacttcctccagtggcccctttacctgtgtcttcccatctttcatgtgagaaccatcatttctcctttaagtttacagaaaagtgtcaaatttaagtaagatatggatatgaaaaaagttagaaataaatgtgcgtgctatatactatagatactgtaatcttattatttataatagggaatctatgactcatgatttaagaaaatgcccagcttagacttaggttttatgtacaaaatcgataacttttgctttcttatttggcattttgaaacaccagtttgagtgatttctttaattctgaataaactaaactaaacctaaactagtaaactaaaaacgatgatgagttaacttctatggcttggaagatattgaagatgttagagaattaattggtctcaagccctatgggtattagagtttaaagaaccctatacctggaatcagactagctggtctggtatcagctgtgctcttgatagtacttgtctttgatgctctgatcytggtctgttcatcattgttaaatttcacagggatttataaaagatttcttgaattaacaaaaggctttggtccgattcacataaaagcagacattaacttctttatttaacacttttcatcttggaaaatgaaactgctatcatatgattcttttctttttttttttgagaaggagtttccctcttgttgcccaggctggagtgcagtggcatgatctcggctcactgcaacctccgcctcccaggttcaagcaattattttgcctcagcctccctagtaggtgggattacaggcatgtgccaccacgccaagctaattttgtatttttagtagagacgttgtttcaccatgttggtcaggctggttttgaactcctgacgtcaggtgatctgcccgcctcagcctcccaaagtactgggattacaggcatgagccaccgcgcctggcctatcatacagttcttaattatgtgcatttgaattgtcctttaattggtagttagcttttggctgcactgccttgccagatacacacacacacacacacacacacacacacacacacacacacacacgctttgggttcagatagatctgagtttgaatcctggctctgctgcttactagctctgtgactttggaaagttgtttttttaaatttctacaacagcctgataatatatacttcatgaagttaatgaagataaaaagagaatttgagtgaagtacatgggcttatggcatagaaggcactcagtaaatactccctttctctcagagtcaattaaaaattttcattttatgttatggataaaaaggaaaacttgcaagctgtacatctattcacttgatgtgataggtctggaaaccatttgtaatgaaatagattaagaggaaggtagcatttgctattgtgagcttccaccatttctaaagttggttcatccatttcttaagtgcaggtattaacagatctttagaatttgagcatttagtgtttgcggccctggatactgactttgaatgtgtggccracaaactgaagggagaggagccagttgaaggctgtagaaaagaataaataaggtttattgtggtcatactgactcaaagtagtcttctttcaagcaatatatcacttttattactaagagttgggggaaaaaaaaatttacctttatgtgctattacatctttctgtttaaaaaagtttcaccttgctttttttgtttctccagccactgttccatccctgacccatctttgtcgtttggaaattcggtccagtctaaaatcagaacgtctacggtctgacagttatattagtcagctgccacttcccagaagcctacataattatttgctctatgaagacgttctgaggatgtatgaagttccagaactggcagctattcaagatggataaatcagtgaaactacttaacacagctaatttttttctctgaaaaatcatcgagacaaaagagccacagagtacaagtttttatgattttatagtcaaaagatgattattgattgtsagataggttaggttttggggggccagtagttcagtgagaatgtttatgtttacaactagccttcccagtaaaaaaaaaaaaaaaaaaaaaaaaaattgtaaacatcacttatattactttattgcagcttcatcaccagtacattatatgttgtaatatttatttacctgatcattttgatcattttctgctttattttgctaataaactgtgatgttacttctagtgctaaacatggcatatttccacctatgattcgtgtttacctggtattaggagctcagaatggaatgcataaagcttcactggaagtgtatacaactgtggtgtagaatctgttattattatcattattattttatttagacttgactatctcttatgtttattaaagaacatgttttcctattcagttgctttttttttttttttttttttggagacagaatcttgcattgtcaccgaggctggagtgcagtggtgcaatctcggctcactgcaacctctgccccagggtaattcagtcacttttatgaagaattgatactcattgccgtttcacatgtaaactcacaggaaaaaattactttgaaagaacatagaaaatcaatcatattgctgggttttcccttccagtttcttttcattctttggcaaaacaaacaaacaaacaaaaccaaccaacccaattctaatctgcaaaggcaagaacagccctaaactcaaagatgtgctcagctgggaaaaaaaatggtttsagttttgagataaatgggcatgttagcacaattaggattttaatcaggagactgagaggggcatgtctgtggcaccatctttaaagaaagaaaggggccgggcgtggtgactcacgcccttaatcccagcactttgggaggccaaggcaggcggatcacgaggtcaggagattgagaccatcctggctaacatggtgaaaccccatctgtactaaaaatacaaaaaaattatctgtgcatggtgatgggtgcctgtagtcccaactaccctggaggctgaggcagtagaatggcgtgaacctgggagacggagcttgcagtgagccgagatggcgccactgcactccagcctgggagacagagtgagactccgtctcgaaagaaagaaaggtaggtattaccgagttacttagtattatatataaaattcaggttccattcagctctagaatcattgagcagctttgttcctatgaagcagtaatagccagttctactaatattatggtgtttttccttcttattatctagataagctgtcaaacagtccatgaaataaagacctcagaatcctagattaatgaggcgccacctcatgggtttttacaattgcttgatctaaatctagagtcaggaagaactaaacgctggatcaagtgagccatgataagaggctatagagagtgaccttgagaaaaaggttatgagagcattactgtcacagtagactaccaggaggcaatgtcttctgtcctgttgggatcctgtggcttaaaatagatgagagcgggccagctgtgcctgtttctgatagacgtttggtgtttggcaaaagcagtgatgaaggtggaccaaacaaggatgacatcactaagacccaaagggatgactgagctgttacctcagactagaactgcctgtgggttggagataagagtttgaatgtgggtgtacaggcagaaataaggttgcatatagaaaaccaggtggacattctgataatttcatatggaaattccaaaactgtgtatattgtatagtattttttaaatgtcataatctttattttctaaaccctaagtctctgatttgtaagatagcacccagctttttcttgggggaaaatgtatgtagaatgtttaatttttttttttaatttttatctatttctataggttgctggggaacaggtagcatttggttacatgagtaagttctttagtggtgatgtgtgagattttggtgcacccatcacccaagcagtgtacactgtacccaatatgtagtcttttttttttttttttaataagtagacagtttatttgggtcaagtttaaggattataacctgggagcaaagactcaagttgcctggaatctacactttgattagcagcagttgccaatgtgtagtcttttatccctcaccctcctctcaccctttccctgagtccccaaaatcccctgtattattcttacgcctttgcatcctcatggcttagctcccactcatgaccgagaacatacgatgtttgattttccatttctcagttacttcacttagaataatggtctccaattccatccaggttgccgcagatgtaattatttcacttttttttttttttttttttttgagatggcgtttcggtcattgcccaggctggagtgcaatggcgcgctctcggctcaccgcagcttccacctcccgtgttataaagcaattttcctgagtagccaggattacaggcatgcgccaccacgcccgcctaattttgtatttttagtagagaagaggtttctccatgttgatcaggctggtctcaaactcctgacctcaggtgatcggcccgcctcggcctcccaaagtgctgggattacaggtgtgagccaccacgcccggcctgctcttttttttttttttttttttttttaaacgatctttctattctttttttttttttttagtactttaaattccagggtacatgtgcagaacatgccggtttgttatgtaggtatacatgtgccatggtgttttgctgtgcccatcaacccatcatctatattaggtatttctcctaatgctatccctcccctagcccccaaccccctgacaggccccggtgtgtgatgttcccctcctggtgtccatgtgttctcattgttcaactcccacttatgagtgaggacatgtggtgtttggttttctgttcttttgttagtttgccgagaatgatagtttccagcttcatccatgtccctacaaaggacatgaactcatccttttttatggctgcatagtattccatggtgtatatgtgtcacactttctttttccagtctatcattgatgggcatttgggttggttccaagtctttgctattatgaacagtgccgcaataaacatacgtgtgcatgtgtctatgtggtagcatgatttataatcctttgggtatatacccagtaatgggatggctgggtcaaacggtatttctagttctagatccttgaggaatcgccacgctgtcttccacagtagttaagctaatttacactctcaccaacagtgtaaaagtgtttctatttctccacatcctctccagcatctgttgtttcctgactttttaatgatagctgttctaactggcatgagatggcatctcattgtggttttgattcgcatttctctgatgaccagtgatgatgagcattttttcatatgttttttggctgtataaatgtcttctttttcaaagtgtctgttcatatccttcacccactttttgatggggtttttttcttgtaaatctgtttaaattctttgtagattcttgatattagccctttgtcagatggatagattgcaaaaattttctcccattctgtaggttgcctattcactctgacgatagtttattttgctgtgcagaagcttcttagtttcattagatgccatttgtcaattttggcttttgttgccattgcttttggtgttttagtcatgaagtgtttgcccatgcctgcgtcctgaataatattgcctaggttttcttctagggtttttatggttttaggtcttatttttaagtcgttaatccatcttgagttaatttttgtataaggtgtaaggaaggatccaatttcagctttttgcatatggctagccagttttcccaacaccatttattaaataaggaatcctttccccatttcttgcttttgtcaggtttgtcagagatcagatggttgtacatgtgtggtggtgttatatctgaggcctctgttctgttccattggtctatatatctctgttgggtaccagtaccatgctgttttggttactgtagcttgtagtatagtttgaagtcaagtagagtgaagcctccaactttgttctttttgcttagggttgtcttggctatgcgagtcttttttggttccatatgaaatttaaagtagttttttccaattctgtgaagaaagtcaatagtagcttgatggggatagcattgaatctataaattactttgggcagtatggccattttcacgatactgattctccctatccataagcatggaatgttcttccatttgtttgtgtcttcttttatttccttgagcagtggtttgtagttctctttgaagagttccttcacatcccttgtaagttgtattcctaggtattttattctctttgtagcaatagtgaatgggagttcactcatgatttggctctgtctgtctgttattggtatataggaatgcttgtgatttttgcacattgattttgtatcctgagactttgctgaagttgcttatcaacttaaggagatttagggctgagacgatggggttttctaaatgtacaagcatgccatctgcaaacagagacaatttgacttcctcttttcctaattgaataccctttatttctttctcttgcctgattgccctgaccagaacttccaacactatgttgaataggagtggtgagagagggcatccgtgtcttgtgccggttttcaaagggaatgcttccagtttttgccaattcagtatgatattggctgtgggtttgtcataaatagctcttattattttgagaatacattccatcaatacctagtttattgagagtttttagcattaagtgctgttgaattttgtcaaaggccttttctgcatctattgagataatcgtggtttttgccattagttttgtttatgtcttggattatgtttattgatttgcatatgttgaatcagccttgcatcccagggatgaagccgacttgatcgtggtggataagctttttgatgtgctgctggatttattttgctagtattttattgaggattttcgcatcgatgttcatcagggttattggcttaaaattttctttttttgttgtgtctctgccaggttttggtatcaggatgctggcctcataaaatgaattaggggggattccctctctttctattgtttggaatagtttcagaaggaatggtaccagctcctctttgtacctctggtagaattggctgtgaatctgtctggtcctggagtttttttggttggtaagctattaaatactgcctcaatttcagaacttgtgattgatctattcagggatttgacttcttcctggtttagccttaggagggtgtatgtgtccaggaatttatctatttcttctagattttctagtttatttgcatataggtgtttatagtattctctgatggtagtttgtatttctttgggatgggaggtgaaatcccctttatcattttttattgtgtctatttgattcgtctgtcttttcttctttattggtctggctagcagtctgtctattttgttgatcttttcagaaaaccatctcctggattcactgattttttttgaaggcttttcggtctctagctccttcatttttgctctgatcttggttattatttgtcttctgctagtttttgaatttgtttgctcttgcttctctagttcttctaattgtggtggtagggtgtcaattttagatctctcctgctttctcttgtgggcatttagtgctatacatttccctctacaccctgctttaaatgtgtcccagagattctggtacattgtgtctttgttctcattggtttcaaagaacatctttatttctgcgttcatttcattatttacccactagtcattcaggagcaggttgttcagtttccatgtagttgtgtggttttgagtgagtttcttagtcctgagttctaatttgattgcactgtgatcagacagactgtctgttatgatttctgttcttttgcatttgctgaggagtgttttacttccaatgatgtggtcaattttagaataagggcaatgtggtgctgagaagaatgtatatcctgttgatttggggtggagagttctatagatgtctattaggtccacttggtccagagttgagttcaagtcctggatatccttgttaattttctgtcttgttgatctgtctagtgttgacagtgaagtgttaaagtctcccrttattattgtgtgggagtctaagtctctttataggtctctaagaacttgctttacaatctgggtgctcctttattgggtgcatatatatttaggatagt

SEQ ID NO: 12254 - DNA, 30872 bp, Homo sapiens
cttgcaaaatgtattcattccatcccaatagtcccaaaagtcttaactcaatccagcatcaactcaaaagcccgaagtccaaagtctcatctaaatcagatataggtgagactcaaggcatgattcatcccaaggcaaattcctccagctgtgagcctgtgaaatcaaaacaagttatctttttccaaactacaatggtggtacaggcataggatagacattcccattccaaaagtgagaactaggcaagaaaagaagggtaactggtcccaagtaagtccaaaacccaacagggaaaacaacattaagtcttaaagctagagaataatctctgattcatgtcccactcctggacatgctgggaggctgggtccccaaagctttgggcagtcccacctctacagcctttctaggctcggtccatgcagcagctctgatggattgagtctcctgcctacagttcccaggctggagttgcatactggtaggactacagttttgtggtcttggagatggctccattcccgctgcttcactaggcactgccctactgcagactatgtggtggctccaatcccacatttccgcttggcgttgccctagtggggactctctgcagtaccagctttaaataaatggcattaggaactggaggggcaaagaaagctacataggccaatacaaacaggttctgaagagtcatggtatttgaataacaatgttgttccccttttctcatgtagccagaaactagtgagaaatagcacatttgacaataacataaagagatagttcctggacccagacagaaagcgatggtgcctgaacactgtaaagaatattcacatgcacttattagacaataaacaaatatctaagtacttttctctactaattattctaaatctttgttgttaaatcactattcttcacgagtccatgaattttataacacagttttgtttgtttgtttgttttttgatacggaatctcgctctgtcgcccaggctagagtgcagcggcgcgatctcagctcaccgcaacctccgcctcccgggttcaagcaattctcctgcctcagcctcccgagtagctgggactacaggcacgtgccaccatgcccagctagtttttgtatttttagtagagaagaggtttcaccatgttggccaggaaggtcttgatctcttgacctcgtgatccgcccaccttggcctcactaagtgctgggattacaggcgtgaaccgccgcccccggcctataacacagtttttaatcaaattgcatatacagactgggcccacaaaaacatttgcttggggctccacaaaacctagatacagtcctgtcaacgtgatagataaataggtaggtatgtaggtattaggttggtgcaaaagtaattatggtttgccattaaaagtaattgcaaaaccacaattatttttgcaccaacctgatagagatatagcaggcagacacacacacacacacacacacacacacacacacacacacatacaatttcccagagcactactcaccaatgaagtactaatgaaatagctccccctgaaccacaagggtcattggactgcagctccctccctcctacagaatgaagtccaagctccttagactgacttggccacaagctacctttctggccttgtcctttgtctttttgtgcattatgttctagtaacttcaaactgcttgtagtttcccctgcacatcatatatctttgcttttgtgtacgctgtttcctcttcctgggatgttttccccactggccttatcttccaagattcagtttaggtatcatctcctctttgaatctctcttgagtcaccaaactgggctaagtgttccctccttgtcatcccacagttcccaattactgtaccccacactcaccacataggattctaattatctgtatagatgtttacctcccagtatattaaagagcttctatggtaaggtggtgtcttactcatctttgtatatcagcccttgcattgtgcttgacacacagttatcagctcaatgaatctataatgtaggatgatttatggaaggagaccaatggactaagtcaagtggactctggtgagcctagaaaacgttctagtaaaatgaaggagaggctggagggtaagtcatgccaagagaatatcagcagtatatatcaattatccaagtggtttagccatacaagaaaaagaaaaaatgggatataagttaaaaatgcagtaagctggagagtggcattttcttctatttagaggaaggcctaaatacgtataaagacttaagagactgagaggcagaagggagatcttctggacttcaatttccttatctgccttatccacctcccagggatgccatgagacccaaaggaaaacaagacataggcatgaaaattatttgagaaattttttacattactatcctctgatagatttttctgatagcttccaactacccgcagaataaaaatctataaagaaaaacccaatctgacatttaagatttcctggccaggcgcagtggctcacgcctgtaaccccagcactttggaggccaaagcgggtggatcatctgaggtcgggagttcgagaccagcctgaccaacatggtgaaaccctgtctctactaaaaatacaaaaattagctgggcgtggtggtgggtgcctgtaatcctagctactcgggaggctgaggcaggagaattgcttgaacccaggaggcggaggttgcagtgaaccaagattgcaccattgcattccagcctgagcaacagagcgagactccatctcaaaaaaaagaaagaaagaaagaaaaaaaaattcctatgatctcgttctaacctttcttcgactactattattgccccaaacaccctgaatccagccagaggagattcatgttctttccttctgtttgcctttgctcaagctattccctcagcctcaaatgccctcctcttcatctctaccaggcagacacaataaacattttcagagtggttagtatatacaagacactgttaaaattctattgattcttgaaggtcttattcatatgctattttgtccatgaaccgttcttgcccttcccacggaaatggtactttgtatcaattgtagcatgtattctacttaataatgtagcttgagggtatgattagttctcccaacagaccatgagagatatgggaggttttagggctgtgtcttgcttgtgttcctatctccagtatctgygcatggtacattgtagatgctcaattatagaaaaagtgaaaaaaataattttaggaaaagaatgtacatgggtggacagtctcttgggacacaaaactgggtrggatccaggatccagsaaaagagaagtatcaacttgtccaagaaaagaatgtctcctgccttgggaggaatagtagataagcttggaggatggaaacgggatagcctatgtggagacagagaagtgtccaaacccagtcccagctcaaatgccaccccttcattaagtctctcctaaatctcctcctagagacgacccccagctcagctcaatctctttggattttctaccttctagaatgtttgtcttgataaataaaattcatagaaagccattggtttggactgagctcctgcactaggcgcaacaggccaaaccaaaatagagtcactcatgctaaagttccaagccacaaagccaaaattaagctgctcatctgaccttaggagaaatcagaagagagggaaaatagccatatccccatgataaaggaagtcccttctgccttaaccaatacaagtaaaataactttgaaacttgttctttgtttctgcttttttttttcagcccttttctgtctataaagataatctcctctgctcagctcatcagaatactcattctattttatagaataaggtgttgcctggtgctagaatcgcaaatagccagttaagatctgtaactgtgttgtattaaaggagagaaggttagcactccctttgacaaggatggaagaggcccttgggcctgacaacacgcatacggttaaggcattaccacctacttcgtgggatctaaccatcgtttttgaaatggtgctgggaaaactagctagccatatgtagaaagctgaaactggatcccttccttacaccttatacaaaaatcaattcaagatggattaaagacttacatgttagacctaaaaccataaaaaccctagaagaaaacctaggcaataccattcaggacataggcatgggcaaggacttcatgtctaaaacaccaaaagcaatgacaacgaaagccaaaattgacaaatgggatctaattaaactaaagagcttctgcacagcaaaagaaactaccatcagagtgaacaggcaacctacagaatgggagaaaatttttgcaatctactcatctgacaaagagctaatatccagaatctacaatgaactcaaacaaatttacaagaaaaaaacaaacaaccccatcaacaagtgggcgaaggatatgaacagacacttctcaaaagaagacatttatgcagccaacagacacatgaaaaaatgctcatcatcactggccatcagagaaatgcaaatcaaaaccacaatgagataccatctcacaccagttagaatggcgaccattaaaaagtcaggaaacaacagctgctggagaggatgtggagaaataagaacacttttacactgttggtgggactgttaactggttcaaccattgtggaagacagtgtggagatttctcagggatctagaactagaaataccatttgacccagccatcccattactgggtatatacccaaaggattataaatcatgctgctataaagacacatttacatgtatgtttattgcagcactattcacaatagcaaagacctggaaccaacccaaatgtccaacaatgacagactggattaagaaaatgtggcatatatacaccatggaatactatgcagccataaaaaatgatgagttcatgtcctttgtagggacacggatgaagctggaaaccaacattctcagcaaactatcgcaaggacaaaaaaacaaacattacatgttctcactcataggtgggaactgaacgatgagaacacttggacacaggaagggggacatcacacttcggggcctgttgtggggtggggagagggggaagggatagcattaggagatatacctaatgtaaatgacgagttaatgggtgcagcacaccaacatggcacatgtatacatatgtaacaaccctgcacgttgtgcacatgtaccctagaacttaaagtataataataaaaaataataaaataaagaaaaaaaatctataactacatttcttgtaattttgtcttttgagagtatacatatcttatttcctttcccagaccagaacctctttgagggcaggaggaacccggttttccctactttacacatgacacataataaccactcattcaatgtaggtttactggatggataaataggaatggggggtagataggcgggagagtgagtagacaaatgcgaaacaggaaaagcttgcgccaggaaaaacagtgaagagcgaaatctccagacccccgattaaatggtttaaagtgaagccaagcaagaacctccagtcctctctgcggcagagaacagcagatgatagcggctcgccttcaactttgctctgaggacctctcgttagtatcccgcgattgtccttcctaacgcctgactgaatcctgaggctagccttcagcgaacatgtacaccgccttgcccttcacgtgaagccgagcctgtgactacacttatccttccgtcgccggcctcatttctccttccccttctccgatctcgcaaccactgctagtaaggcgcgcgtgcgggcagccctggccggcaggggagggagggtcctgcgaccggaagccggaaaccggaaggggggctgtgaggacgtgttccgaggaagccagasccggagccgtggcctgcsgggccggcgacatggatmccctgttccagcaaacgcacaagtgagggccggtcggggagcgggcaggggctagacgaggcgaggccaggtgagcctggcttctggggctgaggcctcggacgtcagccagggtagaggccgagtttttccgccagggcactgctggggatgcctccgaagtgcttaatccttggcgggactcccaggtcagccacagacagtgggttcaggctggggcctggagacgtggggcagatgactcctggggtctgcaagttcgtgactacctgctgggtagactgggtgacgggaaactggcacctgcaggttataaaactttgtccagcacttgtcaactcggtgctcctggttggtagacctcgagaggagacacggagtaggagacacggcccctggccgtaggagtgtactgtttaattggagagtcarggcacgtacgggaaagtatttgtattcttattcgatttatactaaagaccacatttttatggtacaaagaaattgctgtccacgtagcattcactattattacttgttaatcgtatctggttacaggttatcgctaagaaaatcaaattgtaatttagtttctcataacttaaattccttggtagtgtcctttattcgcatcgtcctgcactttcggaattgctgagatacgtagttgagtattaatggggccatacttaccctatttttgggggcggggggcagaattatgatttttaccctgttttggagggacggaattttatgatttttattttttattgtaaaatatacacaacataagatttactgttttaacaatttttaagtgtacaattcagtgacattgagtacattcacaacttacatcactacgatccatttccagaactttttcatcatcccagtgtgcctgttaatcagtagcacttcatttcttccttccagaacacctagtaacctctgttttacttctctctatgartttacctattctagatacttaatataagtggagtcatacagaatttgtccttttgtatctggcttatttcacttaatgttttcagggttcatctatattgtagcctgttaccagaatttcattctgttttatgacggaataatattccgttttatgtgtctaccacattttgttatccattcatctgttgatggacacttgagttgtttccaccattgggctgttgagaataatactgctatgaactctggtgtagaagtatctgttttagtttctcttctcaattttttgaggtatatacctatcctattgagaactttcaaacttatgctgtagttttgttgattaaaacacttaaaatcacactcccaaggcctggaaatgaaatgccctgaagcatgaggaataagagggtgatgatcctctttctctttcattttctaagtttatgggtttcttttattttggcgatgaggtgtttcatttggacaggcgaaaatacagaacctactttgtaatgacagaattttcttttacactggggagccctattctcacataaacgttataggaagggacttaaaactagtctgtgagtaatttagagaaagaatgaaacgaaattatgttcatgttactaagaaagggcctatctttcacaatagcagggcacaatgggcatagtagtgccttgaagttaatctgttatgtatggtcttatctagttaatttagttaaaggatgttgccaagaaggccatgacccattttatattcaagaataactttatttagagagtcttagactacctgttttcagtgcagctaatcacagagaaaactgcatggctcagaagaggaattctaaatggtaccccaaacaaggtgtgtggagtgtagatgctctgtaggcctccaacaatgcacccttggactctagcagcttgccagttttttctattaagggccagatagtaaatattttaggctctgtgggctatacggtctctgtagttactactctgctgttatattgggaaaacagccatagacaatatgtaaactaattgatgtacctgtgttccagtacaattttatttatcaaaacaagcagtgggccagctttgccccacaactattaggccctctgctaccccgacactcattaattcattgaatatttattgagcacctactatgtgctgtgcaccattctcagtgctggcagcacagccctgccctcgaggagtttaccttcttttatgctgcagtatcttgtctatctttcctctccagtgctgaaccaggagtgggagttctggttctagacctccttactttatttttcctcatctgtagaatgatattataatttgggctggttaaactgtaaggctcctttcagttccatgataacagaactgatgactgaatgactttcacaagaaacacgtggagtccagtgagcaccagcaatgaactttcgcaactgcagaaattagtgattgtagctgagttgacacaacagtagctgaacttrttaattttactggaactttgaacccagtttgtgattatctcttgccgtgtcactgaatacattgagtacattggaattagattgacatattaaagttacttgaaaactcctgaacctacctgaacaatgaatgaatgaaaataatgaatgaatgaaaacaataaacattttacacttaaatgtttaatttagatgaactttatagaggagctaatagccaggcttctatttttgagatcccaatggttgtaaaggtgaccacatttgtcccctatgtagtccaagatcagtctcctgtcctggaccttatcgtatgtccaggacacaagaagcactacatttaacaagctccctaggtggttttgatgagcaggtaggcttaagaactgttaccttatctcaagaccattttttttcctgaacagcggagcttaagaactattaccttatctcaagaccatgtttttcctttatagattttgccctttaatgagcgaaatgtaaaggcaaagtgagtgaaatgaaaatgaccagattgttgccactacttttaagtaaagttaacaacaaacttacatgatgctgtgtaggttayacagcgttttcatgttcatcatggtcagaggcagcctggatgcaaagtggatgttatggggtggtggggggcggtgagtagtttcatgaacttttaaaaagcacttccattaaaaaattcttcctagatcttctgtaaaccttttttaaagacrgctacaatgaccctggcttatttgctactatttctctgctttgttatattatcacccaagcccaccatggaccccatgctagagagggctaagacttctttttcctcatgtccacgctcccaagtcatgcttgtgtatcacctgtttcttatggacttccagtgtgttatgttgtgttagaattcccagttcagtttgagacagattttgcacttggcatattagtagttcccaccttgccattcatacttgctttgttgtttcatatttatgttttcttagcatgaaatgtagccgctggaattgtattattggccacattgtctctgattggttcaaagcaaatagagatttgatgggaaaagtcagtggattatgggcctgtacaaaagtgctttgatgaacgtcctgccatgtacatctcctcagggtatgccagaacctctctaggacacattcctcaaactgctgggtcatagcatggacacatgctttattctactagttattgtcagaaagcatttaaagtgttttaccaatttataatcctaccagctgggtatgagagttctagtttccctgtttccttattaatgcatatgtccccaaactttaaaatatttgtcagtttgatgggctgaagaaatgtgatctcattgcttttcatttgtgttttcctagttgagtgtcattttgtatattgattgaccatttgggttttcttttctgtcatttgcccttttttcatttaaaaaaaatgccttgtttgactttttgtattgatttgtaacaattctttatatattttctgcacgtcaatcctttgttatctgctgcagataccctccagtctgtgccattcatttgtttattttgtggctttggtgtacagaagttttttgttttcatgttgtcagatgtatccatctttttctttgtggtttgtgggttttgtgggrgtgggtagtttttggattttgtcttatttaagaaatcttctgtaacccgaggtcatttatgcacacctgtattttcttcagaaagtttgaaagctgctctgctttttccatttgggttttaagtgagcttgagtttatttttatgtgttacctgaggtggcctttttctgtacgggtaacaaaccggagctgttggcatttattgtagtcccttctttcaaaagctcccaaataacgtggggctgtgtctaggctgtttctttcctcttgggccagctgtagggtttgcctttccttgtctgtctgyacctgcactgccgccatattgtttccattgttactgctttgtaagtcataatggcaggtgggacaagtcattcctccccctccttcttcagagtggtcttggctattctttacctcccccctttttattatgtcactgttcgtgttgatcatattaccaactttcagatttttctgttaaatcagcattgaaaatttacctcacagcctgcgtcaggacttccttagagtcctaattctcctttctgtccccgttaccctccggtcccctgtacctgttcccttggttgccctgcttcaggtgtcggctacctcaggctgcattcctacatcagcccccatacctccacacccccgcatcatcccacaatatcccagacttactttccggaagcaacggcctggtctcggactctagcagtgatttctagttgcttctcagggccacaggtcttgcctaggagcaccctggggagtcatttgacagctcacccagcttcttttggtgcccgagggcatatctggaggccatagggaagccctggaaaagactgggcacaagctgaagccaaagttgggtgcctggctggcattggtagatttggggtyctggtttgcattgctcacgatgcagaatggttgctgacctttcctccagcgttggggatgatgtgagagtccagcaggcccccttcatgtgggccctaacttggggaaatctccaccgtgagcaccrggaagtggatggtggggccagcataagcagtatcccgaggactgatcatggaggaccattaggaagggggtyttaaggatgaccttggccagwccgtgggaagcctccagagagtgttacccagatccagggtacagtgttgcatttccaaatgagatggcagttccttcgttccttgatattgtcggagaaggatgtttaccaaacagraggtccctgtctcagggtcttcctctgaatggtttcctccagtgagtcacttcagcatcctctcccccracscgattccctttcaagcagcccaccctacttgtaatccacatgtcttgaatgaatttttgcatatcattttcttctatcttccttcaccaaatgatgtctcccttcttcacagcgatgctcagaactctttccatccacataacttacctggtttctctttctcagccccacccctctgtctgcttgcctgtgacaccactgtgcagagctgcccctctttctgtttgtttatacttatgtgtattgcttttctcgtgaatcttcccagggcttgttcatgtctgtttagcctgtcattcctcattatgttgtttctcaaggacaaggattatatctccctcgccctttgactcttcctggtacaggccagtgcttagcacattaggtcgtagaacagaaagtaggattggccgggttcagtttgaggtttatcacttgctgtgtgatcttgaacaagttacataacctttctgggcttcagtttttataaaatgaggatgataatggtactttcctcatagggttattgatttggcagagtatcttggatatggtaagcacccataatctgcctatcagtgttattgttagtagttaagatattagaaaccatgccaaaacgtgggacctaaagtgccacatacaaattttacagttcagtgatgctgtcgatttaaatcagttacrtgttggcatcagaaaaattgtctttcctgactgaagcgctgttgattactcctgtctcactcatttcctccctcttcctttgataggcaggtccacgagatccagtcttgcatgggacgcctggagacggcagacaagcagtctgtgcacagtgagtaattaactgtggagaccagagtcctttctctgatgacagggtgctaatgggctgggcttcctgactgcactctgccttgggggcttaatgattcagcgtggaatgagttttgttgttagggtggacagaaaaaccctatggcaaagtcactgatttccctgagtgtgccctttggaatcccacaagtcttatcccccattacccctccactcaacctgacatggccctatgggaatggaagcgcttgcctccatctrtcttaatctaattacctagtccttagaggaatgtactccataaaaattcagagatgtttaactggaattggccatttcttctgagctgagaactgtggctttttaggaggattattcagaaacgaacagcaatattaattagtttagttcccacagcatggtttcttttgagaagcatgctggttttttgttttttttcattttttttttttttttctattctgaggaaaggtcctttttctgagttggtcatatggacaccacctgcgggggctgcctacccaccccactgctgggctccctcaggacccattcctcctgttctctcatgtctcctttcgcagcttcaaaagcagctctgttcttggttctgtgccccaccttgttctaatctcaactgtctttgttcactgtgggcrcaaagggctaggaaggggcagtgtcactgctgtcacttctttatggggcaagaagcagtctggatgctttcttttgtgcacagtttagcttctttgttcatcggactttgtttgccttctcagcaatctcattgttacatgattagaaatggaaagaggtcattttgactgtcttatcgaaagggatagggaaaatgaccgtatttatcgtatctctttacctctgtggattctttcctgggcctttcctattgatatttggtttattttggggacgtcaacattgctcagcccacccattcttacagaaagctttaagggaagaaagccttaagggaactcttctctgtatgtttcacatactaatcttccccttcctttatgcttttttttttttaaataaaaaaaaaaaactcattactatagggaattcaattggcagcctttttctaggtatttataatccacgtctgagaatcccaaaggaaaagagacctatatcagaaaatttagcttaaagtatttatttggacaacctttgcatgtttattttctaaaggtaggaaatttatttctacagatttaccttcagcttttttaaaaaattggcattgttatgtcattaacagctatatacatgtacttttttcaaaacaacatttacggcctaacttgaattttttctgttattcattagtgtatacatttttctccttttgaaatatgtagttctagtttattggatattgaaaaaaaaatctgtgatttatcattgtaatttaagttcactatctcttttccagcaattattcttttttcttttttgtacagtagtagaaaacgaaatccaagcaagcatagaccagatattcagccgtctagaacgtctggagattttgtccagcaaggagccccctaacaaaaggcaaaatgccaractgtaagtgctgacctctgacatggctctgatactccaggcccatcaagacaggcttttctccctgggggaggtgatagaatattctgaaaaccaacgtacatgttgaaaaactatgactatgcaaagaaaaagccccctcaaagggcacaattctatctgagtgatgccsctcaaaataaatagcctgtgaggtttgtgactcagaaaccttgtgaccccttacctctttggtgtcattttgaaattttgcctccagttctgttttttgactagatccatagccacctgaagcctaatgttgccatggagttttgttctgctctttggttcctgctgggttcttcttgggttgaaatgaaaartcacttcaatcagtccacccataatgaaatgctgatctaatgtttgatactccagcatgaaattaaaatgaaaccacccttgccacctccacccccagcgcctgtttccaaaagttttatgaaactttgtggatgctttacctcaaagatgcccttgggcttcttccaggagagccatataatccatagaaggtcaagaagaggtcagtgagcctgcttcctgtcccctgttctctgtcatgcatccagaatcagagcaacagattctgaagtcaagctgctggaatcttgtgtgctaccatctcactttaaccacaagtttcttcttgactttcaacatcgttgatcaaaattagatcttgtggtgagggggtatagtgtggggtggtgtagggagaagtaaggaaacgccgtctttcctcagtacaaagcctggccccctcagattctgctgccctgagttcctggaatttaatctctctctccatcaattccagtcgggttgaccagttaaagtatgatgtccagcacctgcagactgcgctcagaaacttccagcatcggcgccatgcaagggagcagcaggagagacagcgagaagagcttctgtctcgaaccttcaccactaacgtaagccaggcccgtggtgagggtcggcctgcacttgacagatcgtgggggctggagttcagatctctgagcgccatctgttttgggggtgtctgaagaagactgatgatgaggaaaccaactggaaatgacaggaactttgtgcattgccacagagactagacctagacagagaatccctttttctaagacaaaaacctgaagaggaagcagttaaattgaaggggaataggcagaggtgaaaattacctggttgggctggtctgagacagaaaggtggaagttcacatggtggaaacgtttttctgatcagatagagacagatgattagaacttaggccatttgtagagaaggcagcatttcaaagctgcctgcgggcagttgccattgtgccgagtatgtgtgtggctccagtgtcaggtgcattaagatgtttttgcccctagtctgagcagcaatttggaggaatttgttaacagatgtttagggttagatggactgcttgcctgagtctgtctgaaagtgtgttggtttgcatgtttgatttttcagaacccattgtccctgccctttagtcttaaccagatcatttcctgcacatggctgtagaacatactggccttttctgtgtcctgcataatatattccactaaatgaagtgtgctttggctttttgtattttgtttttttacagaggattattttctaaagagatgttagctttctaagccagttgttaaaattcacatcatttcctgctttgtagatgtttaaccctcaatgctgcatccttgctttgcaataaattttcccaagtgtttcaggctgtgccaacatagtttttgcttccccagactaagcagtcaagtracagtgtttaacagttcaaaaatttaatgaactataagacacactaaaagatgtttggattttagatcgttataatgtagtattcaggccttttttaggccaaggatgatcgcttgggattattttgttttttgccagcctggcgtgatgctgtgcacaccgtcagttcttaataaacattgacttgccagatgaaacttcttcctggtcattctaccatatggagctataatacatttttctgagagataatggcccatcagccatactgttttagatgggagrgtaagaaagatttgtatgtgaatggcatttcataagtgctagtcaaattactgaagagaagtctctgagtctttcaaacgccagcatcttctgacacactgggcattagctgcatgcagaaaactagttaattcaggcactaggagtaaagcacatgatgaaattaaaagacctgacgcctatctgtgaggagctcccctgttagcaggggcagttgaaaacacgtatgtgcaaaatgattccaaatctgagcagcaaagaaacagtggcataacctttttttttttttttggacaattgaaactggaatttaggtggtaaaaacagcactagtggagcagggcacaatgacacacgcctgtgatcccagcactttgggagaccaaggcagtggattgttcaggagttcaccatcctgggtgacatggtgagacatygtctctacaaaaaaatataaaaattagccgggcgtggtggcgtgagcctgtggtcccaactactctctggagcctgaggtgagaagatcacttaagcctggtaggtcaaggctgctctctatcctgggtgacagagtgagagcctgtctcaaaaaaaaaaaaacacgaaacaaaccccagcactacttggcaggagagcttgtgattggcagaaaagagaagggaacgctctcacagctggcgaggacttggctcctgcctatagtccactttcagagcaaaagtagagccaccaggatgggcgttggtgtttccctctacagtgtgggtaacagggcaggccctgcgctcagtacccacattcccagctccactggacttccagctctgtgatcactggacacacttccagctgtgtgatcttggacaagttattctacctctctgggcattttttcatctataaaatggggaggcctgtggacagattccttgagcacaggagttggagaccagcctgagcaacatggtgaaaccctgtctctaccaaaaatacaaaaaagagaaagaaagaaagaaaaaagctgggcatggtagcatgcacctatggtcccagctactcagaaggctgaggtgggagaattgtttgagtccaggaggctaaggttgcagtgagctgagatcgcgccactgcactccaccctgggtgacagagggaaaccctgtctcaaaaaaaaagaaaatgcagaagcacagcctcctctatccttagttaactctcagtctacttggagaggtaaactatagataaaatagctaaaggacacgagcaaacatttaacactgcattaaggggaagccatggaaaggaacatttggaaccagctaggttagtgagtagtcagagaaagcctttaggagacacccartgaggtcttgaaggaatagcttttcctaagaggagatcatgatacagagacaagtatcgttggaatgaacgatacttgtggagtggaactcatttggagagtgacagatctgaggaagttcctcttctgtgtggacagaggccaccccaggcctttgcttkgctttttcttatccattagggtccgctgattctttcaccagcccctccggctgttctggcttggccttggccaaaagacagagcagtgagaccccaggaactgactgataagcaaagttaatcaagtgcctgtgtttctttcacaggactctgacaccaccataccaatggacgaatcactgcagtttaactcctccctccagaaagttcacaacggcatggatgacctcattttagatgggcacaatattttagatggactgaggacccagagactgaccttgaaggtggggtccctgctgggggacagagagaaggcctcttgttttagcctcatccaacagtttagtaactgtgtttatattttgattacgtgtcctcaaattgtgatattttgatgacaagacagagcccttgagtttgggatcctttctgttggagttgagttattgtgagcctgaaagtacccagttcctttgccagtgcttgaaacaaaccatgaagtggcctctcttaggatccaggtcttttcccatttactgaacttatcatgaaagtgagtgctactacgaggggtccaatcacaggctgagaaattgtgttacagaatctactcttggaagaatgaagacgtggctgtcctttggtacctcgctttaaggtggctttcccttaggacccctactgtggactgccttataactaaaaccttttgtattttagtaactgaatccccactgtgcagtgttagggctgcctggttgtttgcagtagattagagctttagaagcttctagagcttctaaagcccgtgctggtgatcccagcgactcttcactccctagccttaggtattcctagaagccctgaccagttggcactgctgagactccagcccctgggagtggtttacagaaacattacacagactctgatgtcagtcatgatgtttcagcctctgcccttttcctgtatcaaccctgatggataatagggcgtgggttctgtctgttatcagggtgtggtcccctgtgaatgaagcactcccagccactgagctgtgagaaacagtcactcggaagtgtgagctttatcttagtttttgttggatcatgttgagtctgtcagctccacaggacttcagtacgtttctgaacagtccctgccatctctacgggggagagggtcaggcaagctgcaagtgacactcacctcctgctgacagttgcagtgtctcagatggcctggaagggtggtctccagcagcctgctgggcgctcccctttcatgagagccacctgcagtgacctgaactgatacatgttgattagtctgccctttctttagaaaactgctactctccttttcatatctcagaaaaacagtagaggccttttaggaccaaactccatgtcacactgatgaagagccagtgggggttagagcgtcctgttaaggcacatgctagcttcccactcaagtctggcagcgctggggcatcagcacacctcttgccacccacactgataccagaggggaaggctgtgaggtggctgggggttgagacttgaggtttctaactttcctctgcacacctgtggctacctggtgtttgtctcttgattccctccacctgcctcacaccctgcctccgtcgggattttccacctacaccattcaaaaggaacataggagagggcatgaaggggctaggctgaagcactctgatgactggggccaatttgtggctgaaaatgaatacattttttgaaatttatggtcattttcaagtgatttagaaggttgatccttagcctcatacagtgatgaaataatctgtgtgttcagagccaagcaggactttagcaagagtctgattgtattgtcactatctcggggaaaaaaaaatacaaatacatttctctgatctctgatggcaatgaagtttgacttgtaatttctctggctgaggcttcttaattgctttctgggcagaatgtagattttggattcctgtccatgatgcctaatgttgatctcactttccttgtttctctcagttgctcattaatgtgtatttattwaaaaaaaaaaaaaaggatatggggcatgaggttagatgccatgcatataagttgcagtgggtgatatgtgctgagtgacttggggtctgccccggcattcacttatacttgtttcttactaagaaattgaatgtgctttaagctgaaaattagaaagcagtagggaaggacaggctggatggtttgggttgttggtttaggaataaaatgcccttttgttttggtggtgggtgatgccatctatagaagggttttaggtcattgtgttggtgtctttccgtctttcccacttgagaccctcttgtaaatatggacttgacccacccattgtactcagaagaaacctcaaagattgtactctacaaagtaaataggttggtatcaatgattattggaactagagagccgaggacaagttttttgatgttgccttctttttatagtataaaatattctaattttaagtatttttgttgagatataatttacagacagtaaggtatacagatcatatttttacaattcagtgaatttgggcaattgtatcagcctttgtaactcacactcccatcaaggcccggaccatttcacctctgaaagatccctcgtaccccttcccagtcagttgacccctctgccccaggcagccactgttgtgatttatttcaccatagatgaggttttcttgttattgaacttcatataaaggtattcatgctactcttttctatgtggcttcttcctcccagtatgtttccaaggttcattcatattgttacctatttaattccatgttggtagtcaggtactttttattgcaaagcagtattccattggtacaggtttaccatagtttgttcattcatcttgtgattagtgacaccattgttttcagtatgtatttatttatgtattttttgagacagggcctccttctgccacccaggctggagtgcagtggtgtgatcttggcttactgcagcctcgaactcctgggctcaagtggttctgtcaccttagcctcgcaagtagctagaaccacaggtgcacaccaccacacctggctaatttttttttgtagagaaggggtcttcactacgtgcccaggctgatctcgaaatcctggcctcaagtaatcctcccacccacccctcccagagtgctgggattacagggatgagtccctgcgcctggcctgtttgcagtttttagatattctcctgtgtttttttctagaagctttaattgtggctttagcttttatgtttaattctatgaaccatctcaaattaatttttaygtataatgtgaattgaggttcaatttttacacacatatctgtaagagagatacatatatataaaatacatacctgtgatattatatagtcagtcgttccagcaccatttgtggaaaagacttttctttccacttagcgttgctctggtaccttgatcaaaaatcagtcgacgacatgagagtggctctatttctggctgataytgctttctgtgtattctgggcatgaccaagagaatgtctgttggcaaagctccatctcctgatgccattcacccactcttggtaaagcgacttgatgtttgtttttttttctgttctcttctgccccaggggactcagaagaagatccttgacattgccaasatgctgggcttgtccaacacagtgatgcggctcatcgagaagcgggctttccaggacaagtactttatgataggtgggatgctgctgacctgtgtggtcatgttcctcgtggtgcagtacctgacatgagccagccacgctcagtggctgaacagcattcccacagcctgcaagtgtgtgtgtgtgtgaaagagagaggggggcccagaggccgccttttgaaatgtttgcctgtctgaactgtgaagacacttgggagtgattgtggtctaatttccaacctgctctgttttctgtgacatcttggagggggagctagtgccaccaccatgcgcggtgcttaggaaatgaaagaagtcccgggtctgtctctctcactctcgctctcactgggggagggaaagaatggctttggtggctttgttcacayagctgatgcgtgccctgggaaggtgtycacagtgagccctgtgtgcaggactgtccacacggttcacaccttgtcaccatcaggcctttctggstcctgatagggtggagcaaaagtggaaaggaaaggaaagaggccttttctcacagccattatattaaatagtaggtcgattcacatcctcgtgctcctggccaccctcccctgtgcctcagtgacatgtagatgactgactgccaatacttgtcaccattccctggaagcagctacctaggggaaacaagatgtagtgctattgccgataacaagtaagattttccacactacagctgggtgtttctcttttctaaagtgaggccagtgttatttcccgggagtgttcagtcttgaccctagtcactgattttttctagttgttaatagagtggttggcttttaaggttcagagactgtggcttggcacctgcgcccaggctttgtgggcctttgccccttagaaagtagctgtaggcaaagatttgtgattttccaattacagtctcagctctagttttagtatctctaattctttggttcccttctcttccctgaaatatattagcacctgccagccaggccctcattttgcccagccagtgtgggcagatcccaccgtggagacatctgtagtgtgtatgtccttgtaacactctgttttcagggactacaacctttttccttctgtgaccagccccggattcaggctgtactaataccaggtatattrtggaatttagtataaaggccaatctgtcctgaagtccatctaatgtgrtgaatcactgaaagtctcagaaagacctggttagtgtatgttctcatttaccacaggcctaccagccctgggcacagcagcttcatggcaagacataaaatgacactcaaaatccttcagatctggaaaccggctcagtattaaccctacctttggttgtcctgccctacctgctctgttagtttcttgttgcttgaactgtcttctgtcttatttcccttcctttctgtgttcctcttcacctctcttgttcccctccccgctgctctgtagtcatgttggtcctttcaggcacctctgtggcatagctcccctttggtaagttttcttaattgtcatagattaactgagtttcctggatgctaatttcacactttcggttggaggagatctccattgttccyacccctccgggccaaatgggccccaggtttccaaggaaggagcaatctgtgactcctaaaatgggttggggccctgccagagttaaagcagtgactggagggtggactggggggttgcagcatctttagacctagatctgtctaactctggggaggcacattgacatttccattacacacagcactgctgcrgtgccagggacctagcgcaggrcttttggtaatccataaaatggattctgagactgcgacggcaaggctgtcctgtcccccaggcacccaaggatcctgccagacagcacactttggaggaaggtctgcagggagcagctgagccatttgttcttgaactctgggaggcagaagtccccgcacccatcatgcgtggactgataggacatcttttcgtggtgtgcaccagtgctttccacacttgacagtggttggctttgatgaaccctcatgctgcaccttcagagccagtcctctagtttggaataaaaattgcagaggtggtttttgggtctttaccacctgcggctggtggacagcagccagtgtgtctggacacccaggggcattgagactgcatgttgtcacatgaccacttctcttcacacatctgctttcagtgcctggtgaaaaatagaccttggcctaacagtgtgactctctccaccgcctcagtgtagggaagggtccaggccagggaaggagcaccctctagtggaggcgggggtgaattcttaggtcgagctgatgcaagaaactcyrgtagccagcctctgtgaccttgtacatgagtttggtgtgcctaytgtgrtttaaaacaggtgggttatcaagaggaacttgagatctctttattacatggacatttacttcagggggaccactgtaagaaaagccaaactccaagaccaagtaagttagaggagtcttgattttttagacttcactgcggagttctgtacaccctttgccctgatgaatttgaatgggtttgatttgcaaatttggatttacacccattgttttggaagcacatcagctgaataaagttgaggtttattttatttagaaaatcacattttgtaaaagaattcgatattcatttttataactaatggccccctttttttatgtttctaggccagagattctcaaacactgctccatggccaggggctgggctggctgcttcagaagcagtggggaagctttttaaaattacatattcctggggcctaccccagatctgaattagaaccttttttaaatctctaaggtgattttattttattttttatttttgagacagtctcgctctgtcacccaggctggagtgcagtggcgcaatcttggctcaytgcatcctctgcctcctgggttcaggtgatcctcatacctcakcctcctgagtagctggaactacaagtgtgtgccaccatgtctggctaattttttttttttttttgtattttttagtagagacagggttttactatgttgaccagattggtcttaaactcctggcctcaagtgatctgcctgcttcggcctcccaaagttctagggttacaggtgttagccactgkacctggcctctaaggtgattctgatgtgtgtattttggaaccactgtctcctagacagaaagcttctgtctcaaagatgatcacattggtgtaaagagcaaaacttgttaagtccaaaataaattcttactgtttatatcctaccttagtccaaaaaagatttgaggagactttgaggaaataactgaaacagatacaaagaagtgaggcacaagaacaaatcaagtcagtgtagaatgtcgacatcaggacaaggaactcaaacgttgtaacaccctaagaaatgtttggggaaccctaatttgactttcagctccagtagccaaagcaaagaaagaaacgtcatctgttactgtctcaaccggggggtgacattttctcaagggaaagcctaggcccttcataaacagcttgcctgtaggcctcacggaggtcagacagggattttcctggctccatccctgccaatctgaaaccctctcacttaygttctccatcatttatcctcattatgcagacaaggggctgagctgtggtgactgtgaaggcctcacaggagtccgagaggagctggcccctcatccagcttggaaccatgggcccacttaatctcccacacttctcgtggggtgctctgctggggtctggggggattgagaggtgtgcaggggactgagatggtgcagcctgctggcatggactatagagctataaggtgtttgctgcagacccttcagatagtatagggcaagttccctgttgggaaataatttcctaactggaaggggagggaatctgaagtgaaagctgtcctcaggccttgcccctagggggcggcatagccctatctgtggctagtgggccctgaacacactgccttaggcctgctgtacttagaagctgagaaaggaaagtgtcattccttccccattttctgtgtccttttcatttcatatggaaggcacatgggagaggagtgttcaggggtgctgggcccccaagtgctgttggtaagttccccaccatggagcctctgtgagccatccctccccgcctcatccccatgtccctctagtacagggttcccaaccttggctctgcattggaattccctcgggagctttaaaaacccatgtgtgggtcttccattcaccctcttattaattggcctggagtgcagccggggcattgggagttgcccaaggcgattgtaatgcccaggggtagggagccgatggctctaatacaagaacatcaacccaaggctagcccgtcccccatgcacttcccctggccgcaccgtgggaaccacttgcagagaccaactaggggcagggatggaagcctgattctccctctggatcagaaggagccagatcccttgtggccattgggtgcccctcattaactgacacctctctgctgagtaaagcaccttgatgtgacaggccagctcttcgctgcccctgcagtgcagcccccagccctccccaccacccctgcctggtgttccgtcctccctggactgcttggtcttctcagaacatgccacacactcagtacagctgcacctttgcacaagatgtttcctctcagatgtgccacaaacacccccacaatcccatgaaacctccaagaagcctgcccctcccctccaaacaacctcatactgcacgcttcctgcggaatgggagttgctcctcaccgcaggggcctttgtgcatcccgggcacgtagtaggcgcaggcgccatcgggtaagcggctgcaggagagcacttgagcccatcccccatgcagggccagcaaagctgttgcagccaggccaggaggaagccagaaggttcaaggccactgatgctacgagccatgtgctcacagggcctcaacaacagcaatgactgcagtaaaagaggagaggcatggggccccgtgagggaaactgtcactcaggactggggagagagaagtagagtgaccaacttgtctgggttttaaagctgaaagtcctgaatcctggcgatccctcggtctgatggtcaccctagataagctaaaggctaggacaggcgtgactaatgcagggtatctaggaagagggggctctcggaggctgactcctggcttagcaattccattagtgtggttccactggcccttccttccaggcatctgtgacatggtggctcctggagagctggcagaggctgggccaggcccaggagggaagtattccaacctcctcagaagacagtggctgacagtacaagaggggacattcatctttattccgtcttccagagccctggcatgtgtccagtgccagtgttagctgtttcagggcagagggaaggagttggagacaagcagccctccgcagtttgcactggttacagcggccggaggctgtggtaagagcgctgagcccaggatgcagagcctggcttcaagtcccagccctgctggcagcaaccacgggccacacacctctcagcctcagctttctaagaatgggggtaacacctgtcccacgtccctttctggggtggacatgaggcccgagtcacgtagtgcttttggcagattccagaggtctgaggcagtgaccctcagcctgggctgcttcctggagtcccccagagagtttggaagtcccgattctgggcctcgctccccagagatgccgagctacctggtctacagtggggcctgggcttcagaatttttaattttcttttttttttttttcctctcattctgttgcccaggctggggtgcaatggtgcaatctcggctcactgcagcctctgcctcctgggttcaagcgattctcctgtttcagcctccggagtggctaggattacaggcacccactaccacgcccggctaatttttgtatttttagtagaaacggggtttctccatgttgggcaggctggtctcgaactcctgacttcaggtgatccacccacctcggcctcccaaagtgctgggattactggcataagccaccgcagccggccttaatttttaactttctaaggagtctcctgtgaggtcgagattgagaaccacggctgtcagtgcatcccaggtgcaatggagtatcattcctgttcagctggaaagacaggatctactcgtgaaacaaccgaggttgagaggtgatagtttagtgcggccattgtggtgggggcattaaccaggaagagctttctgtgagagggcgaggtgatgggtgtgtgaaggacaggagatgatgtgggagcagtcgaggggcaggagtggcctgggggagggaggaagctctaaccagccctggctgctgtgggctctgaggcctgatgtgctgtcttctgcacgacatcctccacgcactgtcctccgtgttccagctgggaaacttgctgctcagaggcctgagttcatgctgctgagatgctactgagagctggagaagctgtcaggctggtgtgggtgtggacaagccctactgtcctaggaagacctgcccatgatcttttgaggtgcaacgtagtgtgatgggggtggtgggatagtgtttgagatggggttggcagacatggcgtagaatcctgactttgctgtttattagcagcctaaccttgggcttaatcactccagcctcagtttcctgtctgtattcagctcaaaacagaattgcatctttgctgggtggtaactcatcagagaggaacaggcgtgggctatgcagaagggaagcagttctcccttctttccagcccgagcaacaggatccacattctttcaaccaagaccacttggccctgctcacctcctggcaacttctggcctcctctaagagtttcttgtgccccaggcatgtgcagggactgaggcagaagctcagggagtggggacctctataggaggggagaataatcactgctgcccccaggacctcaccaggtggttgtgaatgtcaaaaggtaaaaccctggagataaacccctgatcgctgccgggtgctgtccaaattattgttgctatgtgcatggagtgggtataaattccgtgtccatggtgatttcttccaggaaaccatttcttttttccccctgtggcaaagggcagcctctcttacctcaatccaggggccctgggagacccttggaaggcggggcctccagggctgaattccagaacagcagctgtggccacctccttaggccacctgggaatcaattctctgtcgtcactcacttggaggaaaccacatttaaattaaaaatgtaggctgggcgcggtgtctcatgcctgtaatcccagcactttgggaggccgaggtgggcagatctcctgaggtcaggagttcgagaccagcctgaccaacatggagaaaccctgtctctactaaaaataccaaaaaaaaaaaaaaaaaaaagaaaagaaaaatgccaggagtggtggcgcatgcctgtaatcccagctgctcgggaggctgaggcaggagaattgcttgaacctgggaggcggaggttgcagtgagccgagatcacgccattgcactccagcctaggcaagaagagcaaaactccgtctcaaaaaaaaaaaaaaaaaagtaggtggcctgggatattccctttgtggaaaaaaaaaaaagaaatagctcaagctcagtattgcagcccttaaacagaaaagtaattaataattatgagaggccaggcatggtggctcccacctttaatcccagcactttgggaggccaaagcaggtggattatctgaggccaggagttcgagaccagcctggccaacatggtgaaaccccgtctctactaaatatacaaaaactagccaggcaagttggtgtgcgcctgtagtcccagctacttgggaggctgagacatgagaattgtttgaacccaggaggcagaggttgcagtgagccgacattgtgccactgcactctagcctgggtgacgaaatgagactctgtttcaattttaaaaaaacaaaaattatgagatgtcgcggggcagcagtcaagtgccaagcaagtggggtagatatcagagggtggagagcccacccagcagtgagaggaggctgcaactgactgctgcccctggggaaggtgggacgggggccagattcacaggggagccatgtgagcttggttctcagcaggctgggtttggagtggattgtggaaagagtagggacgtattagggtgaagctggaggtgggtgtggaggaaggccaggggaccctgacatgaatgtggatgcaggaaccctcagctgtctctgaaaccaggagggctggggaaggaccctgtgcatgtcctagattctgtggccccaggagttactgctcaggaagcagggcagcctcctctttggtgtatgtgtgcaagagagaggtcgtggtgggctgtgggttgttagtctctctcccaggagcacctggcaacctgaactacccctgctccctccccaccctgccccagatctggtgaaaccaccaaccaggcggaggcagggcagaggctgtcactgccacacaccttcagagctccctacaacttacgttcatgctgctgagatactgatgagagctggagaagctgtcaggctggtgtgggtgtggacaagccccactgtcctaggaagacctggacatgatctttttaggtgcagtgtaatgtgatgggggtggtgggatgatgtttgagatggggatggcagacatggcttagaatcctgactttgctgtttattagcagcctgaccttgggctaatcacccaaacctcagcgtcctgtctgtatagtgagaataataataactacctcaagtggtagcaaaagtgcctgtatttgagagcttgtccgtcactagaaatagtttttttttctttttgagatggagtttcactcttgttgcccaggctggagtgcaatggcacaatctcggctcaccgtaacctccgcctcccgggttcaagcgactctcctgcctcagcctcctgagtagctgggattacaggcatgtgccaccacgcctggctaatttttcgtgtttttactagagacagagtttcaccatgttggccaggctggtctcgat

SEQ ID NO: 12255 - DNA, 27418 bp, Homo sapiens
  misc_feature (1)...(27418): n = A,T,C or G, or insertion/deletion polymorphism (see Tables 1-2)
gaggacacggacagcgtcggggaggatggcggcgggaaattgagcagctccagcaccgccacacccacactgctgcgccgggtgaacatgcaggatgcggccacccacttgttggtcctcgggttgtacttctcgatggagttgaggctggagctaccgtcgttaccccccacggcgtacaaccatccgtccatggccaccaggtcatgcgtgctcctggggggaaggcggggtgagcccctggctgcaggaagggatgcggggggaggggccacaccacaaaaaggggtggtggcgggacatgctcgctgaggttgggagaactccnnnnnnnnnnnnnnnnnnnnnnnnnnnnnnnnnnnnnnnnnnnnnnngaacaggaacgaaacgacgaaccagactcgacggcagctgggcgcacgtctcacatagcgagggggaagaagagaagaacacggcaagacgggaaaggcgcgtgaggcacgcaagagcagggcggagcgctgagaagcggatgtggcgccaaggataccacagatagcacgactgggaatgaggccgggcaggcagcacatccgcagcgggacccggccccggtaaccaaaaacatacccactgaggacgcgcgaggcctccaacaggcccactcggacccggcccccctccaccagccccactgcggacctgcggatattcatgggcgccacgctttcaccagctccagcctttggactgtatctctctaccgagttgaggcagctggtgccgtcgttgccccctgccacgtacagggcaccctccagcacggccacgcacctgagctgcgtcggctcagtcatggcgacacgggcgaccacacgttcacctgggggcgagggcgtgggctggacgcagacccgccactggcatccctcctctgccgcagccccgactccagggtggggtgtcaggaatgggggggatgtgggtaaacagagggaggagggccccgcggcgcacgggagggggtggccaggaggggtgcactatgcacctggggctcatacttctccacagtggccaggtgtgaggagctgtcgtagccgcccacagcatacaggttcccatctgccggaagtcaacacacccgtggcactcctgctgggagtggggtctccacggtgggggaaggtggggatgccccccaggcaggccccatcacccaccaagcgtggccactcgcacatagcgcctccgggtgctcatggcagcgacggacgtccacgttccggtcagggggtcgtagcgttcagcactgtgggcaccaggaccgcagccacagctcagcagagacagaaaggcgtcccggccccaggacctgccctccccagcggaatggctgaaatcttaccctaggagtcaaactcagaccgcaaagtcctaccaggcagggcccgctggtgggcacaggaccctggctgcctgaacaaccctgggtgcacacccacctgggcccagcctctggactgggggtaaggacccgagagaggaaagggcactggggcagcaaagccaagagttcaggcccagtgtggcagtggcctggggtgaaacggcctcgcggatcacctcctttaacaccccatcagatacgacccctgtgatggtgacacaaacttgcctcttgcagatggactgtacaaagccactggggccccaaccccaactacctgttcaggcaggaggccccgtcatarccgccggccgagtacaggagtccatgcaaggcggccacacccaggcagcttcgccttgtgcccatggacacctccggctgccacgtgttagtcacggggtcgtaggactccacggtagccaggtctgaggtcccatcatagctagcggaattaagccactgcaggtcaagactggcctggcgggcacgtgccagacccgacccaagtccagcctccaggcttacccgcccacagcatagagccgrttccccaccgcagccactcccacccgggcccggcgcgtggacatggaggccaccacgtgccagcggtcggtgcgcgtgtcgtaggcctcacagtctccgtggatggcaaacaggctcccgccgcctggggagggcaggtggagacgggactcgtgagtggatcccactgctgggccacaccccaggctcctggagaggcccctgaatggaggggcggaggggcaggtcaggacctgaccggcacaggtggggtgggcttgtgctggtggggagtagaaggcacagggcaggagggaaacgggcggggggccatacccacagcaaaaagcacaggcccggccccctcgcagcgccggggacgtgtgcggctggtgcctaggacgcccctctgctcaggcagcaggtggaacttcagggcctcgatgaggaggtccttgcagtcagggtggtgcctcaccaggctctcggcatccacgtggcccagcaggaagtcgcggctcagcaagggcagccgcacacacttcatgagctggggtgcagggaacgccaaggtcaggcgggaccctcgggcacactgggcgtcagggctgagacaaccccccagatgcccgtaccacctgtgtgatggattcttcttcagacaggtgggggcaccacccccacggagtccctgaactcggggaaggtcagggtgcaccaggccctcagccacctgcatgccctcctggatgctgtgggagccccccgcggccgcgcctcacccgtgggacatgctgcctgcgggcgtccacgtcgtgtttcacccagctcaggacggctcggtagacctcctcctctgaaggcacgttcaggctgtcgctagagaccagttccaraacctggragtgggggtcctcagacctgagatctggggagggtcctgtggacccagggagccctgaagatgcctaggagggagggttagcaggtgggggctgagtgttcatactgggaggggccgagcagagtcaggagccacagacgaggctcctggggggcccagatccaggaaggtctcggggacacacagcaggcactaaggattgtgggcagggctgtgtcaggaacaaaacggggtcgggagtcaaagacaaagactggggtggggtggggtggggggcgagggctgggcccgccagctgttacctgtttcaggggcagcagcataaactcctcggtcttggccacgtccacgaagtgctgcagcacgtacctgtgggcggccttgagcaggtcgctgcaggagtgsgcatcggcaaagccccggatacccaggcagttggaggggtcgagctgactcagtagaaacttgcagcaagcgtctcggacgccattcagctgcaggagactggcggctgggagcagagtctacggggcaccgagaggcaggtgagggaggcacagggtcgggggacaccgggatccgggtgagggagccctcacctgcacattgscctcgcccaccacaatctcagccgtgtaggcaaactgcaccagctggtccaaggcctgagggtcgatgtcgtgcagcgtcacgtgggtctggcggctctcgctcatctcatctgcggggacagcgggttacacgagctgacccgagggacccacggagcccccagcgccgcccaggcgggtacttgcttgtgaacatggcgtggaagtaggggctgcaggaggccagcaccactttgtgcgcacggatctccttggcagccacgtgcaggacgatgtcgcacaggaggccgcgctggcgcatgcggctcatggccacgaaggcatcgtggtagtgccgcttggagttgtgggccacgctgtggccctcgcggctcagcagctgcacggctccctccatgggggctgcgggccgagcctgccggggccgcgtgcgctctgcctcggggctgcaggaggcgggcgggtcaggcttcgccccgctggtagccgcccgcccgccctggagccgctggggggcccgggcagcccgcggggacccagcccctggtgcgacgggggcgccggcagccctcgcctgacctccgccaaggacccccgccccggagcgcgccgtgtccaggcctccgctgcgcccctgctcccccggggcgtagtcagagccgcgaacagagccccgcgtccggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctccgggaagccccccaccaggcctcgccctcctcctcctccgagaagccccccctaggcctcgccatcttccttctccgagaagccccccaggccccgccatcttcctcctctgggaagcccccggcctagccctcctcctcctcctcctccgggaagcccccctaggtctcgccttccttcttccccgggaagccccccacaggcctcgccctcctgtttctccgaagagccctcctaagcctcgccctcctcctcctccaaggagcccccctaagcctcgccctcttcctcctccgaggagccccccaggcctcgccctcctcctcccccggaagccatccccgctcccccgaccccctaacttgctctcctccggggagccccggggccccgcggcaccaagaagtcgaatgggaccccgaggccaatccgcccgtgttcgcctcacgcgccccctcagcgccagggctgggggagccgtgcctgcgccccgcggcgcccttgtcgcggggtctggctgtccaggcccgggggcccgggtgtcaggctggtagcgggaaggaaggcgccggcctccccaccgtcttcgtcccgtgcggcgtccccgggaagagccgcggtcggcacccagagggccatggacggggagcgccctgcgtggtgttcgtggcgctggcccggtctccgcggatcggaggcgaagccagcctggccctcgggtcgcccgtcttttgtcgagctggcgacatcagtgcggttcccactgcccctcgcgttttccactggactccctgctttttattgttgatttgtgggagctctttgcataggagccccgccgttgcagtctggcgtcctcgcaggcgcgtgccttcggagcgccgggtgggctgcgggcgcggcgggactcccggtctgtcttccccggggcggacaccggcgtcaccgcgtcctacggagccgggcgccgagcgggaggcgcatctgggccccaccggggctgcccgcaccgagcacgcgaacgcgccctcccgccctgaggccgccggcgttgcggtcggagaaccatagagccactcggctgggcgtggcrcggcggggcggggaaaggggcggggcctgggcggcggaagtgcgcagccgcgcggcattctggggccggaagtggggtgcacgcttcgggttggtgtcatggcagctgcggggagccgcaagaggtaagccgcgggtccgagggcygatttggcctcccggtgggtgtctgtatccaagggggcttttcttgctcctctyagcggggctggggcgagctgggcgtgcgggcagctgtgactcctgcgtgacccgcaggcgcctggcggagctgacggtggacgagttcctagcttcgggctttgactccgagtccgaatccgagtccgaaaattctccacaagcggagacacgggaagcacgcgaggctgcccggagtccggataagccgggcgggagcccctcggccaggttagtggggacatgcgtgagcagaacctcttgctcgtcctgtcccaccccggttgggttgctgacctcgcctggggtctcagggccaaggcctaaggatcgccgacctctgccccccagtcctttcagcttaacttactctttcatccgatgtttactgagctcctgttccgtgccaaactctgtcctaggcagggagcgtatgttggtgagttgtgcaaaaatctcttcccgatctaggagaactctcacgttcttgggtgaaatcaccgcctgcagttcggtagaagagagataagtgctggggagggaaaggaaggacagaggggctgaagagagagttgcaggggagccgagttgctctgttagaaggagcggaggctgtgctcggtggctcacgcctgtaatgccagcactttgggaggccgaggcgggcagattacctgaggtcaggaattcgagaccagcctgaccaacacggaaaaatcatgtctctactaaaaatataaaaattagccgggcgtggtgggcacctgtaatcccaactactcgggaggctgaggcaggagaatcgcttgaacttgggaggtggaggttgcagtgagccgagatggcaccattgcattccagcctgggtgagagagtgagactccatctcaaaaagaaaaagaaagaaaccmaaagatacaaaaattagcctggcgtggtgacacacacctgtcgtcccagctactcgggaggctgaggcaggagaatcgcttgaacccgggaggcggaggttgcggtgagtggagattgcgccactgcactccagcctgggcgacagagtgagattccgcctcaggaaaaaaaaaaaaaaaaaaaaaagcggaggtggttgtttgagaagatgacgtctgaataaagacctcgaacaaggaggccacacagacagtaggggaaacgtgtcttaggatttcaggcagcagaaaacagcaaaagccttgcagtgggagcatttggggagagtacagaggtaaacgtggctatggcaggagtgagggggtgaataggggtagatgagcccagaagggtgatgaagagccaggtgccgtagaccgtcataagattgcctcgtaaaacagggagttacttctgggtttgagcggtggagtgccttgtaggtgacaagggtggaaacagagagacctttaggttaactgagaattgaactatgtggtggtttgagaggaggcacgaacggttttgaaggtgttgctgatgagatctgatgacaagttgcgtgctgggtattagagacagagatttgcctttagtctgagcctctggaagggtgaagccaccatcaggcaaaagtagcgcagggcacaggcacagcaagtccagggaagaccgcggctgggggcctgtgtagcgcagggcgcaggcacagcaaktccagggaagaccgcggctggggggcctgtgtagtgtgtttgagggtatgttgtagaggttgttgggtaggagacgtgagtctgccaaaaacgtacctcctggcaatcctgtcttgctagttggtaayccttgtgaagggagtagrctgaccctgtaggccactccccgccccctctacttccacttcccactggggtcgctgacttctgcctcctcagccggcgtaaaggccgtgcctctgagcacaaagaccagctctctcggctgaaggacagagaccccgagttctacaagttcctgcargagaatgaccagagcctrctaaacttcagcgactcggacagctctgaggaggaagaggggccgttccactccctgccagatgtgctggaggtgagggygtgggccaaascagaaggggggcacttgtctctacactctccttcagctcagcctttctgtgcaggaagccagtgaggaggaggatggagcggaggaaggagaagatggggacagagtccccagagggctgaaggggaagaagaattctgttcctgtgaccgtcgccatggttgagagatggaagcaggcagcaaaggtgagcagcagccaggggcgggcagctgggtgcccaggcagaaatctggccttgcctcacctgaggtgagcagcagcgaggggcgggcagctgggtgcccaggcagagatctggccttgcctcacctgaggcgcctgaggctgtgctggtgggaggggctgttctccacgcaggggacgcttggagccttcttcagcgcaagtgacaacacgttgctcctcctgcttgcttggttgccccaggactgtgtgttcacttttgggtagattccaggggctctgttggcgccccactccccaaagtcagtcccgctgtgggtgggacggaccgtgcctttgttggttggtggagctggggtccttctgagcctctcacagtgtttttttccagggacaaggatacggagagctccagataccacctggaggtggccatagtccaggatctggaactcccagtccttttcctggggctcctgagccagactccctcctcttcccagagaattctagactttgtttccatttttgttatcagtatggggctctgtgcctccccccaacctctgccctatgtctgagggtgagggtgagggtgcctttctctggggctgccgtttccactctgccaagtgcagtctcagctcccctgacgcccctggtactcttgctccttcagcaacgcctcactccaaagctgttccatgaagtggtacaggcgttccgagcagctgtggccaccacccgaggggaccaggaaagtgctgaggccaacaaattccaggtcacggacagtgctggtgagcttggggggagcctggcatccaggctgtctgttgcgttctctgtcccgtgagtacatccaggccttttcgttgcagcattcaatgctctggttaccttctgcatcagagacctcattggctgtctccagaagctgctgtttggaaaggtggcaaaggatagcagcaggtaagaggggagggggtgaaggggggtagggtggaaggtgggtcgggaccacacacaggagaagccagaggccttgtggctaggacagagacatggcaacagagccagcgtcttcttggggaccctgagaaggcagcggggcacgagggaccgttgggagaggctgggcacttggggccagttggagcggccccaccttctttccttcctgaaaagggaagttgtctgctcagagtctcagaaggtgtggcgtgtgcagctgcctttgctctcagattttcccaggttagggttcttgctctatttccctttgtaagaacttgtaagtcctgtccatactccttgatctctgcactatgactggcctgtttcctggagctgtgtgtgtctgtagacaggggcctcatcaatgctgagaacctgagggcctcaacttcccctttagagaaagattgggcagagaaggccgtggaaggttttcagagaagagagacgcacggccaagcatttggtagagcatggagcacgttggggttccggggctgtgcagccatgtgaccttgaggcagtggaggcctagagttggaactgccccaggacaccttcaaaggaagaaaggagacccacaggagaggtctcgccgacagcggctcaggagacaggggcactgttgctggtggtagtggtcggggctggacggatagaacagagccatgtccacatggaggcagtgctgtccgaaggggacaaggaagctggcagatgggggtggagggacaggcagcgattgggaggcagcacgcactgcagcctgagccaccaggtcagggacccctgtcgaggcagcagctgtaccggagggagtcaggccgtggggagcagagctgcctcctgggtctgggtgggcagctgcaggtgcccagcagccagtgtcagcacaggtgtgaggagggtcgaggacggggggcctttctggggccctgccctttgtccttcccatgcttcagcagattttagtgagcgcctactgcgtgggctctggtaaatgttttgttttgttttgttttgtttgtttggtttttggtttttttttttccttacgagataggatcttgctctgtcgcccaggctggaatgcagtgatcatagctcactgygacacgtaccttctggattcaagtgattctctcaccttagcytcccaagtaactgggactccgccaccaggcctggataatattttgtatatttttgtagagacggggtctcactgtgttgttcaggctggtctcaaactcctgggcttggagtttgatcctcctgccttggcctcccaaagtgcagtgagtactggcatgagtctccacacctgccctctgattttcttttctttgtgcagcaaatgtgggccaaaggaaaccagtctgcggcagttggtggtgcctgggcgaccccagaggtgctgagtaccagctgctgggcttagggacctcgtgtggtctcacggtggggatgtgatcaaggggacctagaaaaggtttatgtctgagagggagttggaggctgggacttccggggactcttagggctgtggccaaccctgggcagggcagacaggagttcaaggccactgaaggaggagctaatgcacttgagagggtcctgctaagcccctgtgtctgtccagctgtaaggggccctgagcttttttgagtggagagacggggggtctctgcagagtcgtagaggctatgctggccagggcacgcgccaacatgctgagcagcctcgcgtccgagccgtggggcctcccagccaggggtgggtggtctctctgcaggatgctgcagccgtccagcagcccgctctgggggaagcttcrtgtggacatcaaggcttwcctgggctcggccatacaggtgctattctggtggggagggcacggggscctggctgtatctggtggtcggtccttttttgtatcccagaatacatgggtttggggcttcactgtcccctcctgcccccagctggtgtcctgtctgtcggagacgacggtgttggyggccgtgctgcggcacatcagcgtgctggtgccctgcttcctgaccttccccaagcagtgccgcatgctgctcaaggtkcgtggcccagtcccctccctgtgtctgycatggggtcggggggccacacggctacccccaccacatcccactcctggccagggcacaggtggtgcccacactccactggctccgcttggctagagaggccacagaagcacctggcccccacccccacctggggtttctgtctcaggcagtccctgcctgcccgggcagcgcggctcagtccgtgagcaaagccacggtgaggtatcttcttcccggtgtgatctcacatacgtcggcgtgtctgacgtggtaaacttttgtggtcctcttctcacaaggagcaacacacctgttctgttcacttctgtaactgagcacctaactcacggctcccccgaggtgctttgggaagagctggtggccatgggagcctttgcctggctggggagggctgtgctggccctggggcatccctgctgaggaggctggggggccaccagtgacgtctgaccttctgcagagaatggtgrtcgtatggagcactggggargagtctctgcgggtgctggctttcctggtcctcagcagagtctgccggcacaagaaggacactttccttggccccgtcctcaaggtagtggtgggccctgcgtctgtgtccctcagcatctgcattggaaatctcggcctaagggcagggcgggctgcctttgtggttggtgcccctcactggaccctcactgcagstctgagcagacctgggcccttggatcacgaatgtctcacagagcacctgggggtggtgggcagggaagagagccctcggccttctcagggccccacctggaccctgcttcacacagcttccccaggggagggcctctctggctggaggaggacactgggtgttgggacctgaggccatggccagggtacagtcctactgcccgtccccaagccatgggtggyctgcatgtggggaccctcagcccccagaggggcccagtgtgcagcaggagcttctgccccagcttctcccaggcctgaggctggtgggcacttgggggtgggggctgtgcaaggggctacggctcttcctcgaggcccagctctgagggaaaggcccaggtgttcacaggggccctggagtgggcrgtggaggtgcatggccctgatcccaggtggctctgacccgggtcyctccgcagcaaatgtacatcacgtatgtgaggaactgcaagttcacctcgcctggtgccctccccttcatcagtttcatgcagtggaccttgacggagctgctggccctggagccgggtgtggcctaccagcacgccttcctctacatccgccagctcgccatacacctgcgcaacgccatgaccacycgcaagaaggtgtgtggtggggcccttccaggctcatgctgggcatggggtggggcagcccaggtgccygacccaaggcagggcctggggcctccccgaagcccctgtctggagacagcccagcaccctggtgcagtcggtccttgcaggtgggggaagggtggatgggttgagaccccgtgtgcaagatgaggaaatgattcctgtgccggcccaggaggaacgtgcatcagcctgactkgtcagcctggccagtagctgacrtggttctctctgaccaggaaacataccagtctgtgtacaactggcagtatgtgcactgcctcttcctgtggtgccgggtcctgagcactgcgggycccagcgaagccctccagcccttggtctacccccttgcccaagtcatcattggctgtatcaagtgagttgtggggtgggcagggttgtgcgggagggtcaggagaagcaaatttgctgggactgtgtgggcggtgcctctggcgttcagggccttggggsctgagtctgtgtcctggccgtccctgaggaagggctggggtccctgtacctgctacggggagatgctctggattctggagagctagggctggtgggcacctgtgacatgagctcctccaacagcggtttagccgcctcgggtgccacccagcgtgtgttctgggggcttgtgtgcagtttgcagtgagtttggttcattacgtggggttcttgggtggagcacatctgatgcagtgaactgcattttgggtgtgagcgcttaggagggtccaggcacggtaggggctgcagcaggaaaaggtgggagcagtactgtggcctctttggccaggagggggcatctgtctggctgagccttagaaactcaaggctgggaagggaggtgggaagtccaagggaagaagtaggaaaggcgggaacagggaggagagcaggcaggaacagatgacccctgccaccgtgttraaataaagctgaaagctgggtaaggtacytgcagccccatagctgggcaaggggtgcaggtccctggggttcagacgtgccttgtcctgctttaggggtctgatgtcggtgagtgggggaggaggtccaagacagcagggggaggggcaggggctgccagagccggggcctctgctcactcggccttcccacccccaggctcatccccactgcccgcttctacccgctgcgaatgcactgcatccgtgccctgacgctgctctcggggagctcgggggccttcatcccggtgctgcctttcatcctggaggtgagtgaggctgtggtgggcgtgtggcacctctgcctgctcctgtagggagcatctgctgctccgggcgtctgtgctgagttgtccggcgacttcccggagccctggccgcctccttgtcaygggtgtcacgaggacagtgctcctccgtgtgctgggggcagtgttggggaacgtgggaccactggggatgaaggcggctgctgctagggctgtgcttgaggatgccgggacctgaccctgtaggtgcttgcccaagactggagtaggcaggaggcgagatgggccaaaacccaagtctgattgctgaactgtacactctgaaaggccctgccctgacagttgtgtgcatgtgtatgcatttgtatgggggatgtgtgtacatctgggtgggtgcgtttgtctgtgcatgcatgcgtgtgtgtgcaccatctgggtgcatgggtctgtaaatbgtgtgtgtgcatatcagttcatgtgtgcatctgtatgtgtgtgtgcacgtgtatccatgaatgcctgtgtgcctgcaggtgtgtgcatctgtgcgtgtgtacasctgtgtgtatgcatgtgtgtacctttgcgtgtacctttgcgtgtgtgcacctgtgcatgtgtctttgtataccagtgtgtacctgtgtgtacctgtatgcatgcacatgcgtgtgtacctgtgtgcacctgtctgcatgtgtgtacctgtgcgtgtgtgcacctgtgtgcatgcatttgcgtctgcatgtgtctacctgtgcatgcatgaacctttgcatgtgtgcatctgtgtgcatgcatgtgcgtctgcgtgtatctatgtacctttgtgcacctatgtgcatacacacgtgtctgtgtgcacttgtgtgcatgcatttgcatctgcatgtgtgtactgtgcgtgtgtacctgtgcgtgtacctgtacacttgggtgcatgcatgcacgtctgcttgtgtgtgcctgtgcgtgtgtgcacctgtgtgcatgtacgtgcgtctacgtgtgtgcctgtgcatgtgtgcgcctgtgtgtacctgtgtgtatgcatctttgcacgtgcacatgccactcaggtagggaaagattggagtccgaagtttcaactttcagtgggtgggttaggccccaccccgctgtaaatttaggaattcacgatctccaccctgtttatctaatgagttctcagcctcatgaaggcccagagtcgtgtcacagctgtccttggggctgggtccccaggttgctgggtccagaaggtatggaagccccaggcacgttctgattccccttccactgaggcagggatgctgaacatctttaggaagccatgttcactcccatggcagccagcagtggtctctgattgcccagcccttggcctggcccctgtgtctgtgggcctccagctctgctgcccagctccaggcatgctttgtgtctgtttcccttgtccaatctccttggctacgtgctttcttactctcttgcagtgtctgtttcttcacttgtgcactgccctggttcactgcagccgcaccctgtaggcccctctcacgcagggatgcaggcctctcctctccggaaaaagcaaaccctaaaagctaaaacaaagccctcagctgtaggccgtgcctgcccttccccggtgcctggacaggaagccagtcgcctgcccatactttyggcccaggctagagaagggcagtgtcctcccagaggttcatcagtacyagggcgttttcccatctggacctgagctcagctgtctggcagccacccctgctgagtggggtgtcttgctggggcctccacccttgggccccccataatctgcttctgtcctctggtgccccagcatgtaccctggatctctctggttcacagcctgagggctcctagtggttggggaggggtcacaagactgagaggccaggctgactctttctctgctcctcctggcatgtcctacggaggtgcatggcctgtggcttctgtggagggtgtgggaggggccccccaggcctcccgtgacctccatctgtcccrtcctgtgtctggcactcttctttgctgttgctgctgcgtcttctggttgctcgggacggarccccatgtggcattgctgtgctgagggccaggatgggcctcagtgccatgttgtcaggaatgggggctgtcctggtactctgtgtggcagggacctctaggtctccagacgtgggtccttagtgcttcccaggattttgggagagggcccgtgttcctgatccttccctgctgatcagagccccactcggggacacgccaggctgtgtggggccatggggctgggaccgtgcctagctgcttatctcttgtttcgggttgggtctcctcgtgctgaagcctgaggaccagggkgaccagggtscagccaggtgcagggccaaagggaccagggggaccagggtgcagccagggtgaagccagggtgaccaggcatggggccgagagagcctgacacggcccttggggcagatgttccagcaggtcgacttcaacaggaagccagggcgcatgagctccaagcccatcaacttctccgtgatcctgaagctgtccaatgtcaacctgcaggagaaggcgtaccgggtgaggctggcctcctggggaggggcctgggcagttcccagggtggggttgggggtgctgaggtggatgggagggggctggcatcctccaagttcaagcatggaccttcatggtctcccagggctggggcccaggagccccttccttgcagtccgtgccctggagatggcgctgccctgacagcctgaggggaaggggcctgagtgcccagccccagcctctccctgatgcactcggccctctcycctgctcttcaggacggcctggtggagcagctgtacgacctcaccctggagtacctgcacagccaggcacactgcatcggcttcccggagctggtgctgcctgtggtcctgcaggtgtgtgtcctgcccacaccggctcgtggccgactcagactgtcttawaacgggcttggctgccccaggctggtaggaggtgcccttgtcccgggtacctgggactggggtggaacctgactgctggcaacgcgccccgtgaggcccccttggaggggctgatgaggggttctaagccattcaggaggtttgggggcaggcctgggcagtgggctgaggaccctgggagcacaacagcctcctccccaggtgggaaccacaaggctgatctttgcttcggggttgggactgagcatgccgaccctggctcaggctggtacgctgatcgcacacttccccaggccatcccgggtgtggggagtgggtggagtggcttctcaggtggcaggaaggcctggcctgccccgccaaataccccacatcagcctcataggaaggcccagcctgccccgctaaataccccacgtcagcctcatcttaggcaggagtggggtggaggagggggttctccttatcctcagaaggtccttctgggcccccacgggaggtctgtttgctctcagccgtgatgtttccagcctcagggaggsctgtgcctagtggaaggggtgggggccctgctgtctggccctggtggctggaatcagatgtgccgactataggtctgtgcagtgtggggaggagggatctgctcacatgagccacaaytggtcagaggcttatccagatagaggtgtgtgcatgtgtgtgtactcacacacggccacacatgtcacatgcacagagccgggaccccctttctggggggcactcacagcaggggccacagcctctgttcctcccatgtcctcttgggtggtgatacctggcattggggcatctctgcttctggactcaagggcccagggtcggggtctggggtaggggtcagaaaatgtttttggtgaggggccaaatggtaaacgtggcttcctacggatgttcagctgcacaggcaactgcagaaccatgcaatgcacacgtgtggctgcacgtcagcgagactgtattttattagtagtagtagtattgtttgagatggagtctcgctgtgttgcccaggctggagtgcaatggtgcgatctcggctcactgcaatctccatctcctgggctcaagcgattctccagcctcagcctcccaaggagctgggtttacaggcgcccaccaccacacccagctaattttggtattttagtagagacggggttttgccacgttggccaggctggtcttgaactcctgacctcaggtgatccacccgcctcagcctcccaaagtgctgggattacaggcgagagccaccacgcctggcataaaactttatttccagaggtgagtagtgggcagggttggcccagagggtgggctgattctgcctctgccatcccagctgcaacagctatgcacttgagccctgagatgggatccatgtcccytcctggggtatccccgtggccaccacgcgtggttttgcacaggacctgggccagctgtgcacatggagcggtcctgggcttcagtggctgacccctcccttccgcagctgaagtygttcctccgggagtgcaaggtggccaactactgccggcaggtgcagcagctgcttgggaaggttcaggagaactcggcatacatctgcagccgccgccagagggtttccttcggcgtctctgagcagcaggcagtggttagtgggccctgggggtagtgccacctgagggcacctgccagggtrtagccccagctacatgtgggggtttgcccagggtgaggcatgaccctgaactcccccaaccccccaggaagcctgggagaagctgacccgggaagaggggacacccytgaccttgtactacagccactggcgcaagctgcgtgaccgggagatccagctggagatcagtggcaaagagcgggtgcggctcggcgaggggacctgggggtgtgttgtgacttcctgggtttcagatctagcgcactatgacttgagaccagggcgagggtttggaaacagtgccaggcggccagggccgtgcccggatgattcgacttggagagggggtaggtgttggagaactggccagaaccaggygtttccagggaggggaagccccaggctgcactaggttggggaggccatgccccctcaggcctgatgggctggaggctccgggcaggtggagtggctggactgacctcgtcacccaggccagtatgtgggcaccaggggcccgtgaggagaagcaggaagggctctgcctttgaccttggacatgggatggacaacttggaggatggctttgtgatttgggaacagrggggactagaaattggccacatggggccctggtggtgggtctggcgatgcctggccctgctgtggccgccagcccctgccytctctcacctgagcccctggttctttggccttccagctggaagacctgaacttccctgagatcaaacgaaggaagatggctgacaggaaggatgaggacaggaagcaatttaaagacctctttgacctgaacagctctgaagaggacgacaccgagggattctcggagagaggtggggcctgcgtggtgctcccaggggaagggtgggcctggagggctctgctggacttcccagagccacgagggccacctgtacccatcctgcagggggctcaccagtctctggcccagctggggccaacctcagtgttgccaggcttctggtgccagcgccttccctccttgaagtgaaggcctactgggattggtaactctgtccccaggcctgtgacctcccagttcctccccagggctcctctccacctgctggaagtcagcggagggaagggtgttgggagcctggccaccctcctgcccccactgtgactttgctggtggaccctgtgggtgggagtcatatggactctgcttcttgttcctcagggatactgaggcccctgagcactcggcatggggtggaagacgatgaagaggacgaggaggagggcgaggaggacagcagcaactcggagggtgaatggtcttggggtgagagggtgtggccctgtgagcccatctgkcgggagggcagagccacgtgggcggggggcgtggggctctgggccaggcttttccctccctgggaaggccaggccaaatgctctgttctctggcagccagcaacagggataaattaattagtgccgtgattaattagtgatgagtaacctcyaaggctggcttcttcctgataaagcaaaatttatgtagcctccatctctccccgcagatggagacccagacgcagaggcggggctggcccctggggagctgcagcagctggcccaggggccggaggacgagctggaggatctgcagctctcagaggacgactgaggcagcccatctggggggcctgtaggggctgccgggctggtggccagtgtttccacctccctggcagtcaggcctagaggctggcgtctgtgcagttgggggaggcagtagacacgggacaggctttattatttatttttcagcatgaaagaccaaacgtatcgagagctgggctgggctgggctggtgtggctgctgaagccccacagctgtgggctgctgaagtcagctccgcgggggagctgaccctgacgtcagcagaccgagaccagtcccagttccagggggaggcctgcaggcccctggccccttccaccacctytgccctccgtctgcagacctcgtccatytgcaccaggctctgccttcactcccccaagtctttgraaatttgttcytttcctttgaagtcacattttcttttaaaattttttgttttgcatccgaaaccgaaaraaataaagcggtgggaggcagggccattgtgttgagtgrtgrctcctggagatttgtgtggccccacccctacccccggcaacctcaacacagaggctgggaagggtcgggggcccctggaagtagagccaaggtcccattctcctgcttgggtgaagtttgaccggcaagggcgtggccccctccatagggggacgtggccgtygtgggggacaagggctgctctcctgtgccgagttctcgctccggggcccgcagggttggtggctgcagtggcagagccacggggaagctggccacgtagaaaactcggcccaggcgcctggccacctgcagagagatggcctggtgggggctgtcgcacacccacccagagctttctgcccagctgtggtctggagaccctgacctcactccccagcgtctcacctgggcccggatcttgagggcgggccccagcttcagccccatgttggtcagcaggtgctcctccgtcagcagtggcagggtctccccgtcgatcccctgctccctgaagacctggaagggggagggagggagggtcaggacccgggtgctgctccatcctccagcccagcagagccaagaggagctgtttgtgcagctcacggaaattttttaaaaacagtgatctgttgggtttgagtgtcaggcagaaaacacctggcaaaaaaaaaaaaaaaaaaaggtggggtgcacagtccagtccctgctgcgcactgcttttggggagggagagggcgttggggaatggccctaccccaccatcctttccagggaggtagtgactgccagccagctccagccccgccccaggaactggggcccccccttacccgagtgtactctccacagccagacaggccccccacgaagctgcagacgtcatccacggtccacttggtgacgtcctcaggggctggggcctcctccccatccatggagagtccccctaccgcgcctgagttgtggggcgtgttactagggctctggctggctttcccatacccgcccgtctcctgaccgtcgtgtgccccaattgctgaggtgggggatgggtgcctaaggggaatttttcctccccccaagacccttccacaggcggcctgccagtcctgtgccctctggaaggatctagagtgtgggggtgcccacctgtgtggaagtaggggctgacggcataagggaagcccaggggcagtgtggaccctgggaaaagccccttcccctcggcgccggcccctccagctggagcttggcccggagtgggccccctgcacccaacagctgccgtctcggggtcctctccgtccgagtctttggggggctcgtcttccgagccatcttgtgcccagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgaggaatcctgcctcctttcccggcgcccccacccacctctagcccgaaagccaatctcccctgccaggcgggcggctggggcctgggaggctgagtgcagcgggcagggggtccgagtgcatcccggagggacccctggagaacgtcctgaggtggggtggacagggtcagggccgacccgggggaaggggcagcccctccagctggcgtctcttcagcacctggggagtcctggtggccaagtgcccactgcacccagcccggcctttctgctcactgcccctccccaggctcctggggcaggcgtctggctgcatagacgactcacagaccacagggtccaggagcttgctctcctcggggggtgctgctgacatgcccactgcccaccctcacctgggtccaccccagactccatttctctctatataaaatgtgagctagtcatgaccctggggacctaggggacatggaggtgtggcccgccccagggggcatggggcaggacgtgtggcagagggacctgcatccagcctggccttggtgtcagcagggcctcagcaacaggaatggccgagtacatgtggctggggaggtgatgaggggagatcatgccagggtgggtcctcaccgtggctggggaggtgatgagggggatcatgccagggtgggtcctcaccgtggctggggaggcccaggtggtagaggcgctgagggtcctcaaaggtgctggcctcgctcagtgctgacacaagccggcggtaatggtcctccggggccatgctgggccccagctcccgcggcagcagcagcgcctctgctggggaggacccggggtgagaggtttctccaggcactgccgaggaccacgcccctctagagtgcctgctcgaggtccaggggaccctcagggactgccccctcccctggtgacctgtctctcgtcccagccacgctcttaccttgaggcgattcgcttcgtgccctcttctctgaaaagcagtcgctgctgatacggggggagcggcccagcctcttgcccaacaggtcacctgcgggagggtagtgagtgcccacctgcatctcaaggaatggaaggggaacccagcccctgctccagctcagcctggaccgcacccaccatctctcagggggcccttggtcctggtgagtacaggccttgcccagccctggcagccccagccttcagcgcagaggacatcacgcctggctgtggcgggacaggggcacaggggagctctgacactggccctggtgcgtgtgtgcagaagagatccacagcaggcacccagctgccccacccgccatctagcctcttgtgcaagttaacgagcccccctctcatccccctagaggagaataaaaagcttttggtttgaccaggcaccaccttcccctcctggacaggagtgagggcgggctgtgcagggtcacatgccagcgtggggtgagacaagccgggaaggacctcacacctgacctcttgctgctctgtgagtcactgggctgtgggccccccaggccgcctcgaggcgcctccactcccaggcctcctacttggtcatacccatccctgcccccagaaggcccacgtcctcctctctggcccagtcctgcctgagctagcaccctggcgtggctgtcatgcccttgtccaccagcccagccaggctctgggcttctggggtgcacctcccagtagcttcacccacctcctcagccacgaggccagcccagccctagccccaaacacagcccagcaggtggcagaggggaggcccaggccaggtccagcttcagccccaaacacagcccagcaggtggcagaggggaggcccaggccaggcccagctcactctcctgaggtcctcccttgggtcctgccgaccgcaaccattccagaccacaccatccatgtacccatctccgacccaccccgagctcctccgaagcccctgactccacgccctgggggtctcccaggccagccagtgcctccgactctggcccttcctcatcctcatgagggctctagctgggtggagtgaggggccactcccctgtgacccaagacctccatgaggcctaggcagtggggctcccaagcccgtccccccacaagccctgccgtcagctccaggcctaattcctttttcttattcccttaatctgtcatttttatcaggctggggaagtgcggcggccacaccgatcaatcccacattacagctgacagagtggtgctaataacttattgatcctggcccggctgctgtcaggcccggccccagagagagggtcagtcccacggtctggtccagggtccccacctcggtgacagatcgggtggctgggcccggcgggcggcggggggcacctggccacacacggatccaggcaccactgctcaggcccctgagaagccatcgtctcccccacagcctcccgtgccagagctcggtgggctgggagggggtgggccaaggctgggggaacctggctcttttccacacctgccacctggcccaccatgcacatgccctcagggttagcaaggcctctcacctcctggcaatcacttttccattgtacacagtggaaactaccctctccgttctgtggggggctaaggcctcctcctagcctgggggaggtgactgggtgggggggggcaggtggaagggggcctgcaatgagaccgcaggaaggccgatgaggccatgctcactcctcactcatggaccccagcgggtctcacagaggcagatgcaggacctgctctgagtccctcacagcccagggcccagggaggtgc

SEQ ID NO: 12256 - DNA, 48013 bp, Homo sapiens
agaaaatagggggagatagggaatattccacccctcatatgcagttacaattggctcttgttaccttaaattttttgaacatcttccgcaatcaggttactatagcagctgaagagcatttaacaggacagaaggtaaatgttcatgaaggaaaacctgtgtggtggaaggactttaaaacaaagacctgggaaaaagagagatataacatggggaagagggtttgtttgtatttccccagaagaaaaccagcttccagtttgggtacctacaagacatcttaaattctaccatgagcaaatttccaaagaagagaaaaggattttggaaccaagatctccactcccagcacgcctgatggctcgaatgaacatttcagccaaccagatgaagaccaacaaaacccatcaagcgagcccaccaacttggggacagatcaagaggctgacccaccttgcagaagaaaacctgaaaacacaacaaaaaccactaacctcgagtaacctgatggtagctatgattgcggtaattaccatggtggtaagtctccctgtggctacagcagaccaaaattatacctattgggcatacgtcccatttccacctttaattaggcctgtcacatggttggaacccccggttgaggcttatgttaataatagtgtttggatgcctgagcctacagatactcaagggccctctcacccagaggaggaaggaatgttaataaatatgtccatgggttatcagttcccctcctctttgcatagggccagctgtcggttgcctaaaaggctacggacaacattggctagttaaaatttcaggtcataatcaaagaccagtatcctatcatttattttctggatggagcccggatcatccacagagttcagttcaactgtaacagtttaagcccagaaaagagaggtgtcaacaacctcaacaacagtcaaatgatttagaaatattgatttgaaaggattgtatctctttttttttctttctttttttttgagagggagttttgctcttgttgcacaggctggagtgcaatggcgcaatctcagctcactgcaacctccgccccccaagttcaagggattctcctgcctcagcctcccaagtagctgcgattacaggcatgtgccaccacaccctgctaattttgtatttttagtagagagggggtttctccatgttggccagactggtctcgaactcccgacctcaggtgatctgccggcctcggcctcccaaagtgctgggattacaggcgtgagccaccactcccggccaggattgcatctctgatcacgctgtggtacttcaaaataattcctatggaattgtcactgattggtcccctaaggggacctttgcagttaattgtaccaatcagaatgatagatacaagacaggactaaaacaggaactatactgtcaaagagatgacactatttacactgaaaaacatgcccagtttcccataatttcaaccaattttggtatagccggcccacatccaaaaatgattaatccaataataggccctgaacatcccaaattatggaaggtaatgatggcccaatctcatattcaggtttgagaagaaaaatattaccttgagggaaaaggtgagagacttcaatttgtgtatcagttttcttccaaccgaatggcgcccattcagagctgtgtcaagcctccttttatgttgatggtcggaaatattgatattcgacctaattctcaaactattacttgtcaaaactgtcaccttttcacctgtattgattccacgtttgatgtgaaaacatctgtgttgctggtgagggctagaggagtttagataccggtttccctcaatagaccttggaaagcctcttcttccattcatatcctcacagaaatgttaaagggagtgtttaccagaacaaaaagatttatttttacccttatagcagtcattatgggccttattgcagtcacagctactgttgtggctgctggaattgctttacactcctctgttcaaactgcagaatatgtaaataattggcaaaagaattcctcaaaattgtggaattatcagacccggatagaccaacaattggcaaatcaaataaatgatcttagacagactgttatttggatgagagatcgtataataagcttagagcatcgattgcaaatgcaatgtgattggaatacttctgatttctgcataactccccattcatacaatgctactgaacatcactgggaaaaagttagacatcatctggaagaaagggatggaaattttacactgaatatagccaaattaaaggaacaggtttttaaagcatctcaggctcatttaactctcctgcctgggactgacattctcactggagctgctgatggactttcaaacataaatcctcttaagtggattaagaccgttagagaatcaactatcgcaaattttgctttaatgtgtacctgtttatgctgtttgcttttagtctgcagatgcggaagatgcctctggagagagaccagacaccaggaacaagtcttaatagcaatggcagttttaaaaaagaaaaaaggggggcatgttgggaaaaaggcttacagggtgcctgcataaactggccataaaaacatgggacagtaagttgtggaaagccacaagaggactctgaggaggaaagccttcttatcgccattatgttcccatgctctgagcacaacctgctctcttatctataaacactgtgctcaagaagaaagacgctcctctgaagcactggaatgtggctagatatgcaggctcctagttaagcccactcccaccagctaactaaagatacgttgtttaagcacaaaggagattcacttaaaccgccactgctacagattatgtgtatgacgtactgcttccctttgactgtttcgccctgaacatctgcttcttagatctaagtgactgtactcaataaacagtgtggagatcagaactctgggccttttgcagcctccattttgcaactggccccctggctcccacctttatgaacacttaacctgtctcttctcattcctttgtcgccaccggacttcggataccctacgggtggtgctgagactggtcccccaaaattaagaaaatgcaaataaaaaccacaatgagatacacttcacacccactagaatgatgaaattcaaaagaactgataataacatgtgttggatagaatctggaaaaactaggattcttatatgttgctgttaggattttttaagcggtgaggccactttggaaaagtttggcagttcctcaaaaggtaaaacatggagttaccatatgaacctgcaattccactctcaggtataaaagagaaataaaaacaagtgtatgcaaaagttgtacacaaatgttcgtagcagtattatgcataagagccaaaaagtggaaatacctcacatgtccatcaattgatgaataaacataacgtggtatagccatataatggaatattatttggcaatacgaaacaaagttctgatgcattacacaactggatgaaccttcaaaacaaagtaaaagaagacagttgcatatagtatgatttcaattacatgaaatgtccataatttgcttattaattacataaactgatttagtggttgcgagaggcaatgggagggaggaatggaaagcaacttactgataagattcttttgggggtgataaaaaatgttctaaagttcgatagtggaggctgggcatggtggctcacgcctgtaatcccagcactttgggaggctgaggcaggtggatcatgaggtcaggagatcgagaccagcctggctaacacggtgaaaccccgtctctactaaaaatacaaaaaattagctggacgtggtggcgggtgcctgtagtcccagctactcaggaggctgaggtaggagaatggcgcgaacccgggaggcggagcttgcagtgagccgagatcgcgccactgcactccagcctgggtgacagagcgagactccgtctcaaaaaaaaaataaaataaattagctggatgtggtggcatgtgcctgtagtcctagttgctcagatggctgaggtgggaggatcccttgagccaaggagcttgaggttgcagtgagccaggactgcactactgccttccagccttggcgacatagatcctatctcaaagcaaacaaacaaaaaaaagtgtaaatttacagaagagttgcaaaggtagtacaaagtgctttcttacaattttcattagagtttccttaatgttacatacatatgaccatggtacaattttcaaaattaagaaattaaagctggtacaatactatttaaaaattgcagactttatttgcatttcctcagcttttctgctaatgtcttctttctttttttgagacagggtctcgctctgtcacctaggctgcagtgtgatggcgtgatctcggctaactttgcaacctcttcctcaatcctcctgcttcagcctcccaagtagctcagactacaagcgtgtgccacacctgtctaatttttgtgtctttttgtagagatggggtttcaccgtgttgcctaagctggtctcgaactcctaggctcaagcaatgcgccctcctccgcctcccaaagtgctgagattacaggtgtgagccactgcgcccagcctaatgtcttctttctgttacaggatccagtagaagattccacatctggagatcttttcctttctttatatctatcaccgacattacctactctttaaaaattttgtaaaaggcataaatttgaaaaatatatcctcattaatctaaatcaagtcattgatacaactatttaacaagacgcccggcctgctttgttttattaacgacttggagggacagaacactacccattacacccacaaacgttatcgacatcaacagaactgtaaatgacaacacggcaatactctgcaccttccctatgcctaggagctaattccactttacatatattattatttcgtgtgtgtgtgtgtgtgtgacggagtctcgctttgtcgccaggctggagtgcagtggcgcgatctcggctcactgcaacttccgccgcccgggttcaagcaattctcctgcctcagcctcccgagtagctggggctacaggcgcccgccaccacggccggctaatatttgtatttttagtagagacggggtttcaccatgttggccaggattgtctcgatctcttcaccttgtcatccacctgcctcggcctcccaaagtgctgggattacaggcgtgagccaccgcgcccagccctatcttattatttcacacaccaaccctggaggcatgtttggagttgcctaatttttatgtacactttttgataaggaactaacaaaaataacttgctgaagacaagggaaactgagtccagaactgaatgagaagcacatggtttcttcatcctccatcaccaggctgtctaacgaggctgaagtaccatccatgagtaagtgcgtcaagggcaaacaaacatcatcgcatatggacagtggtgtgaaattcgagaaatccgaggagggttaacaacaacaaaaagcacaccaccacgccgaacttcctcgggtcccaggttggcaactcaacgcccgggaggaatcccccccggaggcgcgccggtctaccggcctcactccctacctcctggaggtccggagtcccgctcctttccctcagcggtacaatacccgtgtcggtccattccctcaccgtgagtcgaggactagttctccagactaggcgaccgacacacgctgcctggggccggctccaaagcgcccgtcctgagactgcaaaaaagggtcgggtcatccggcaggaaacgactcaacgcgcagccgccgcggcctccaaccaccggccggcagaggggcgctaggccgccctcgatcccctcgccgcggtcccatggaggaggaggcgagccgcagcgccgcggcgacgaacccagggaggtaggttgtcatgggactcggccggccaccctggcaattccagtcaaayggcaagccagactcgctttgccggtcccttcctctcctgcccctgcagccgccaggaatggaacagtcccgcggtggggactgtgggaggcgcacgcgcgaggagtgtagggtgggggtgctggcggcggctgctttggcggcggttggtggccgtgcgggcggggagggagggggaggagagaagaggaggtggagaaggcttgggctcgcgccgctgaaggtacgcgtgagggcctgcgctggagccggcttgacagggtctgagggggagtggagaactgggcgaggaggttcccgtgggtgagcgcgtacgggatggctggctcgcrggacggccgaaggtggtggttggtgggagcagccagcgacgagcccgtagacactcgtacgcgtgcgggctgacgtgcgcgctacatggccggagtcgggcgaagcgggggrccgtggggaagaacgcgaggagggaggagtgggaggttgggggtgtcgctaggcgcccttagctccctccctctggaggagctgccgcggccactctgctgccgccgctgccgccgccattttgggttcgctttgcgaggggaracgatcccagtgtcggttgcgggatccgcctcctctcagtttgcccctttagccctccacctttcccttctcctctctcgcatttccgccagtcggcttacccgctggccgcctcctgacaagcgggagggatccgcggtggacccagggaagcggaggagcctggcggccaccccctcttcctcacttccctgyactctcatcgctctcggcctccgacacggtgagtagaacgatttgggccggcattcgggcctaagcactctctcagcgattgaatcctgggctttctgggagccactgtcatctcccggacctggayctctgrgagagcagtggtgaagatgggggaggggagagcagggagggggatcctgagcctaccgggaagtccctccaggcggggtgaaggggtgtccctgacaggcagactcccggagggggctgggaagtaagcgagtggaggcggagtcggctgtgcccctgacaggttagtttgtgtttgtaggcatgatcggagcctcccccatagtccagtttgtgtgtgtttaattaagggataagagtggtcgaggacacgatcttgagaggggattttacctgtgtgacaaggtctgtggtgtccctgccgcgttgaacggtatgtgggaacgacaggatgatctcagtgttgtacgtttaataaatgtcactggttagtttgtacatggaaagagatgtttttggtctagmagacagatggtctgttggtgtgtagcggctgtgttggtgtgtgtatgtgaggatggcaagtgtttccgtaagagtttgcctttatttgtgtaagtgtaatggagttccccttataagttagcttatttcttgaataaatgttgggaggttccttgcaggttgatatgtgtgtgtattttagggattgggagcccctagttacttgttgggaaagagcggcaatggtagtgttctgtacagcatgtgtctgtgaggtcagggaggggagaaacttggcatagccagttgtggtcttaagaatagtttgtgcctttggttagagtgagttgtgtaaatgtgaagggccaaaatatctttaacagaatcattgctacaaagctgtaaagaatgggtggccttatttgttgtcgcgggtttatagtaatagtttacaatacaataagaaagctctttcagtttctttgtgatactgaatctctgtgaaaatggtaggatgctttcttccattttacaaaataggaaatttaggcataaggagagaacttctccaaggccgcatgttaaattggtgacaaagttggaactgtaactcccatattttcactactactgcagcagtatattcagcataccatggtgcctcaggaagtctttgtcggcaaatctgagtatgctggaaagataggagcacataagactggttggcttgtatttgggggagaccgattgtgtcagatatgtatgtggaacgtagctgtccttgccgagtctgacctgtatgaaatgcatatccatgrctatattattttggatttatggaggaagcagagcatttctgacacttaaggttgtatgygtgagggagaaggctttcacagcttaacttgtaccagagcagctgcatgggtgctgacagcttaacttgaaatctgtgggaggaaggatcctttttcaytcattcaacaaatataaccattcaatgaatggtccatgccttgaggtgaggatcatcaaggtgtctctgtaaatagcctggatgcaatctgaggggagttgttttgacggtggtaggtattaagttgagggaggcagtgtggaattaaaaccagagaactgtttttgggtactggtaattgttaatatatgtgcctgtggatgttggaacttcttggctgggctgaaggaatcctttgaaagactgatttcggcagggcgcggtggctcacacctgtaatcccagcactttgggaggccgaggtgggcggatcacgaggtcaggagatcgaatcacgaggtcaggagatcgagactatcctggctaacaggatgaaaccccgtctctactaaaaatacaaaaaattagccgggcgtggtggcgggcgcctgtagtcccagctactcggggaggctgaggcaggagaatggcgtgaacccgggaggcagagcttgcagtgagctgagattgcgccactgcactccagcctgggccacagaggagactccatctccaaaaaaaaaaaaaaaaaaaaaaaaaagactgatttcatgtagtaaggatcccgtctatgaactctatgaatatgaggtaagaatgcatgaactaagccaacttagctgtattcttctggaaaatgggatgtttcttgataggctagattagtggttcttaaaagttttttggggtcacttatccttcagagaatcggatgaaagacactgggccctcaagttagaagatgagcataagcgcaatcacatgatttatatatatgattttaggaacttaaactgtaatgaaatagagccaatttatatttagatctcatttgaaaacctttcattttcattgttcgggtgtgtggatgttagtatgagtttaaggtgaaggagtctatgttagtatttgaacatgttgacaggatccatatttttaatttattctttttatcgtctgcaaacatttctgcagtattagtaaatgactctgtatttggtaaaaagggaagctaatgtcgcacaagtatctatggctttgttctttgtcagtatctttttgttctcaaactctgagaagcgtctttttttcagttttggattgggcctgaggtgatttgaagctcctgtcttggagtttaacttagttataacaaacactgagttaatcctatgcaggagacacaaagataattaatatatggtctctgtgcttgaagagacgctaattttctgtggttgaagagatgctgtgaattgtgtgatagtggcagctctcaaaaggacaaggaagagggaaacatattcctagaagctgaaattttattacccaattgcaaagactttttgtcactacttattcttaggaataaccataaagtgtttattttattctgtatggaactttgtactttaaaaaaatatgttttgtatcatctggtgtttttgtataaaggaactgttggtttgaaaagaaggtaaacatcatttatattccttaccttgttttgggatgtatctctacagtgagtttatgtaaaaaggtcttaatgtcatttttgggtatacatacatgtagaaagccctcctgatataaaatccagtagctatttgacagactacccattaatttattactggaacttaaaaataattactgtacttttaaaagaacaagaaattggtcaggtggggtggctcacgcctgtaatcctagcactttgggaggacgaggcggatggattgtcagagctcagaagatcgagaccagcctgggcaacacggtgaaaccccgtctctactaaaatacaaaaaattagctgcatgtgttggagtgcacctgtagtcccagctactcgggaagctgaggcacgagaattgcttgaaccaagaattgcttgaactgggagggggaagttgcagtgagctgaaatcatgccactgcactctagcctcggcatcagagcaacactctgtctcacaaaaaaaaaaaaaaaagcaagaaatgtaaaaaggtgttttaataggacagattataggattcagtgagataatggagaagttttaggaaaaattgtctgatagtcctttctttctattgacatggcccctgtataagaatgctatgtaaatttgtgaaaagtttaatattttctctaatttttaacgggtagtaggttcatggtgttatttttctcaaaacgtacatgtgatatgtgtgtgtagtgtgcatatatgtgcatgtatgtgtatacaatttctttatttttttaattgagattaggtctcgctatggttttttgtttttgtttttgtttttgagagagagtttcgctctcctcgcccaggctggagtacaatggcacaatcttgcctcactgcaacctctgcctcccaggttcaagtgattcyctttcctcagcttcccaaatagctgggattacaggcgcgtgccaacacgccctgctgatttttgtatttttagttgagacagggtttccccacgttggccaggctggtcacgaactcctaacctcaagttctccagccgtctcggccttccaaagtgctgggattataggagtgagccactgcacctggcccaggtcttgctatgtagatcaatctggtcttgaactcctggcctcaagccatcctcctgtcttggcctcccagtttgctgggattacagatgtgagccagcatgcccagctctttttacctgcttaccaaatccaagattttctccaaaatgaactggaatagccttcttactgtgttaattttgccttggtggggaagcctaagtcttggaactaaattggggtggttatgacagttctctttttaaagctgatcagtatttcagtatttcacttgttgttgttttttttgttttgttttgttttttttgagatggagtcttgctctgtagcccagtttggaatgcagtggcaggattttgactcactgtagcctctgccacccggattcaagtgattctcctgcctcaatgtcctgagcagctgggtttacaggcacgcaccactacacctggctaatttttgwattgttagtagagacagggtttcaccatgttagccagtagccargctgttctcatactcctgacctcaagtgatccacctgcctcagcctcccaaagtgctgggattacaggtgtgagccaccacgcctagccaaacccatctctttcattaaaccacctcattttggttcagaaacaagactgccatgtatgtatttaatgcttattatgtgccaagcactattccaggtactaagatacagtgatggacaaaacaagatcccttctcctctatctcaggacttattaatttgggcattttcattttccaatataggatcttttagtactggtataggattcctgaaggaattcctgaaatataattatttttctgctagagcaaatcaattttgttttttgttttttttttgagatggagtttcgctcttgtcgcccaggctggagtgcaatggcgcaatctcggctcactgcaacctccgactcccgggttcaagcgattctcctgcctcagcctcccaagtagctgggattacaggcattagccaccacgctaggctaatttttgtatttttagtagagacagggtttcaccaggttggccaggctggtctcgaactcctgacctcaggtgatcctccaggctcagcctcccaaagtgctaggattacaggcaggagccaccacgcccagaagagcaaaattcttctgttgacaaaaatttctttcctctgaggaagagacactgtgtgcctgtgttttatccaggaattccattggatagtttgtcctttgggatgtcagtggattaaatcctccattaagaatcaaagtacttggctgggtgcagtggctcatgcctgtaatccctgcactttgggaggctgaggcaggtggatcacctgaggtcaggagttggagaccaacctggccaacatgatgaaaccccatctctactaaaaatacaaaaaattatccaggtgttgtggcaggtgcctgtaatcccagctactctcgaaaaaacagaaacaaaaactctgacatgtagagtatgtagatgtagagaaaaaagtaaaatgattgttgaaaaaaatgtctattttttatcttctaaatagctttgtgtgtcagagatcagaacgctcattttacatgatatcaagaaccagaatgctagatagctagaatggttgttaacttcctagatawccattgtagaggaacacataaggtaaaacaaatgaataaaaattaaaaaaaaatgagatagccaaagatttgaagctctttacccattaacatgataatcatttcgactttgaatatttgtagaacaagagtcagaactcagaacaaagatctctgaggaaataaaaaaaaatcaagctgcctcctaatttctcatttagtctgtcattgggcattgtcaaactgtcaaactatatttagagattctggttttcatctggagacttagtgagttgtgtaatatcttgaatacacatataagatcttgccaggtggggtggctcatgtctgtaatcccagcactttgggaggatgaggtgggaggatcgctggagcccaggagttcaagaccagcctgggcaacatagcaagtccctggctctatttaaaaaaaaaaaaaaaaaaaatcctcaatgtagaactttaaatttatccttacgtgttacatccagttgatttgagaaaatatgattctgaattttccatcaattggattggcagtccctttcagctttacagctttacatcatctacagatttgttaagtatgttctcttggtcttctaattcactgatggagtttttgaataggtcgggtccaaagatagagtcctatgaaacactgttggaaacttgtctctgtctgtctcttttttttttggagacagtgtcttgctctgtcgttcaggctggaatgcagtgggacggtctcagctcactacagcctctgcttcttggactcaaagagattctctcacctcagcctctcaagtatatgggactatatgcatgtgcgaccaagcccagataaatttttttttagagatatgttgacattttgcccaggttgggagacttgtctcttgattccattcagtattgtgtgggtttggataggccatctaattataaaatcattgggctggtcatggtggctcatgcctgtaatcccagcactttgggaggctgaggtgggcggatcacctgaggtcaggagtttgagaccagcctgaccaatatggagaaaccccatctctactaaaaacacaaaattagctgggcgtggtggtgcatgcctgtaatcccagctacttgggaggctgaggcaggagaatagcttgaacctgggaggcggaggttgcagtgagccaaaatcgtgtcatcgcactccagcctgggcaacaagagcgaaactccgtctcaaaaaaaaaaaaaaatcatctagctcacattttctccttgtcttcttcctattagaatttaagttcaatgagattagaactctctctctctctcattctctcatatatcccaagcatctaaaacagggattgaaacatagtaagtactcaataaatgtttttgaataaatgaatgaaggatagctgggcgtggtggctcatgcctgtaaccccagcactttgggaagccaaggtgggtggatcactggagctcaggagttcaagaccagcttgggcaacatggggaaaacccatctctacaaaatatggaagaattagccgggcatgacagcacactcctgttgccccagctacttggagggctgaagtgggaggatcgcttgagcctgggaagcagagattgcagtgagccgagatcaagccactgccctccagcccgggtgacagagtgagaccctgtctcaggaataaggatagatatgaagaattcgtcagatgccttgttgaaaacatcatacattgtctacatggaattcctccatattgtaaaatgaatctaatttataccaacaacgtttggcttttttgcagaaaaggaagcaaatgagctgatggaagatctgtttgaaactgtgagtaatgatcctcaagtgagaacatgggattgtaagttggttctccaacaaaatgtgtcctttgatctctgtgatgctccttctagaagagggactgaaccaattctccttttagtctacctgggaaagaatataatgacaaaagaaatttgctaactgctagactcttgattatccacatgtaggttattcttactaaaattttccttgaagctttttttttttttttttgaggcaaagtcttgctctgtcacccaggctctggagaatacagtggtgaaatctcagctcacagcagcctcgacctccagggctcaaaacaattctctcatctaagcctcctgagtagctgggactacaggcacacacctacaggcccggctaattattttatttttttgtagagacagggtcttgccatgttctggaactcataggctcaagtaatcttcctgcctcaacctcccaaagtgctggaattacaggtgtgagccagcacatcttgccccttgaaaacttttgatggcttcccctactgtcatttggtgtgtccttaaagattgccaactagttttaaagtattttgcacacaaataattaccttttccataaatttgtctaaaaagatatttctgtttaagaaattgatcattttgagttatcctagctctgtgcttactgatacaagttgactggttgagcaacttctttcctggcataatagtcattccatatgtgggtttgtaggagtcctgaagtgagaaaggttctgatgtaggctctttctgggtgccagcattattaaagtattgtttatagttttcacttttccttcccaacactggagcaacattcaaaagcccattccccaggaaaaccctccctttcctttgcccacagttccaagatgagatgggattctccaacatggaagatgatggcccagaagaggaggagcgtgtggctgagcctcaagctaactttaacacccctcaagctctacggtaggctagttgaagaccttgagatttggaatagaggaagagtttatttctgaaaaggttttcagaagttgcagttaacaatttttcatccccagccagcttctgttactgatgtaaggatgcagagtcctgtcaggagttaggtgtcaagtgaagtctccttgttatggggcagtgcagctgtaggccaagctrtatcygtttgggaagggagaaaaaacagtagctggcatccatatccacttctccgggtgagtggtgctggagaggtatgtaggactcaatgtggccagccacacaaactaccctatattgtaatatccagtctgtcccttttgttctttttatgtgccattaatatctgctaaatgtgactgaaaatttgttagtcacctaggcattagtggagcaaaccctgaagcacctgcagtaaggagtctgaaacatacgtgctgacctttttgcctaaagttggcacttgtgttacrgcatccagaaagtagaggctttaattttttcctcattttgtggtggatttgcatctgcactttattctgttgtagcagcatataatcattaggtcgatggcgagaggtcaggatgcagtttgtgccataagtggaacaaagcaaagagaatagtccctgtaattagtcctgtgtttgaacttaacagcactactaagcagagagcttgggttccatctgaaagctagacctttagggattttccaatttagtgaaaaaagataagataggccaaccaatgtcttaaaaactagaactactagtcattctccattacaacaaatatcacaatacaactacatcaaaaatctcaagattgctaagtcagtatttgacccattattttaatttatagttcatagaacaaaattctggtatagcagaatggaaccattcatcctgggaacgtataataggatctgattaataaatattttggttttgctgatcaactctttataacttcttaaaatttggaaaatatagaactaatttaaaattcctgttagaatccagttaccttctggtattcaatggaatatagtcatatatcatctcatggtcataccctctgtgaaatctatcattaaacgattcatcattgtgtaaacatcgtagaatgtacttacataaacctaaatggtttagcctactgcatacctattgctcccaggctacaaaacctgtacagtgtgttactgtactgtactgaatactgtaggcagttgtaacacaatggtaagtacatatgtatgtaaacatagaaaaggtacagtaatcttatggagccacctctgactatgtggttcgttattgactgaaacattctgtggcgcatgactgtacttgggcagcttctgcttctctttcgattgcaaatacaaacctgtttttgttttaatctttgactaaataaaaatccctctgtaagtccatagagagtaagcacatcttaaaacacaataaggaagagagaggagaaaaagacagtcaaaacaaaaactctggggcttcccttatcaattacctaaataatccttgttaaaactaagtgcaggctatgtttccattttctacttttttatgcttcttctcttctgttccttcagtggtggtagcgcggatgttcaaattttcagttctcagtaaagattgtatagacagtcccacggtcttcaggtttttactctgtgctacccaaacctacagtaaatactataaaagaaaacttattcaaacrtaatctttatctgcaaaaactattgaaaaacgttaccatttaactattgctgtaatatagggggttccttgaaatatgataacctgcttgttatagctacttcagcagatcttatcctgttgcatagggtatcagcatatgcttaatcatttaggtatattattctccctttatttctttctatgtaaacatagaaaaggtatagtaatcatacatagaactgacatgctaggtattggaatttttgcttcagccctgcaaacaatctttcaggagggtatggatgggaagttagggttaggaaccttggaagaggaatttaaagggctaaaagaagatagccttcatggataatattttaactaacttctccgttctgttcatttgaactaccatgtacttcagttattttggtatatccttttcctgcttcatgctagaaagtctttgacttgttaagaaagcagggcagtgcagcctgagtagataggataatgggacaagctggacctgggatgggagtaacatcccagggagtaacaagtaatgagagaagaaatgagaatgatgagttcccaccagctccttggctgctttcttacccatatatttctctgtccctagttttttgtttaattttttcttcatttgtatattatttggaagaggaattgtagaggaatgggatggggtgtaatacagaatcatttgatgcatgctaactactttgggaaaagatttgtgtaaggctgggagtttgactgttggctaaagtgaaaaggggggrttagtagggaatgaaaattgttcaggctctttgctcatcattgcaaagaattggatgtgttgtggacctaggaaaacactcaaattcagtcatccccgtttgggataggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcaggtaacactttccttggtcatattaatattgaattataccaaggcctaactctgaggctttggtataatctaaaattagcagctttgtaaatgtcagagatagttaccttactaygtattaaaaccgtagtatcttcacatcagttaggagcttgagaagtcatcatgttcatgtcctgtggctcagggaagacagcacataaggaccctaatggtattcggaattacagatttcaaagagtcctcagtaatctattctgaaatttaaccttcactgtgacaagtagttttttttcccttttcccttttcttttttcttttttttttgagacgtagtctcgctctgtcacccaggctggagtgcagtggctcaatctcagctcactgcaagctctgcctcccgggttcacgccattctcctgcctcagcctcccgagtagctgtgactacagggactcgccaccacacccagctaattttttgtatttttagtagagacagggttcactgtgttagccaggatggtctcgatctcctaacctcgtgatccacccgcctcggcctcccagagtgctgggattacacgcgtgagtcactgcgcccggccttttccttttctaatctcagttcctcctctgtttagaggttaaacttcctctggttctgtcattttgttcaagggaacatgtctgagaaatttatgccaagatcctacgttgttctcacactctttgcagaaagcaaaatttgtgtcataaagttgcaaacatcttagttaatgactctctggtggctgggtgcagtggctcacacatgtaatcccagcactttgggaggctgaggtgggaggattgcttgagcaggggagttcaaaagcagcctggacaacatagtgagactctgtctctacaaaaaataaaaataaggctgggcacagtggctcacacctgtaatcccagcactttgggaggccaaggcgggtgaatcatgaggtcaggagtttgaggcaagcctggccaacatggtgaaaccccgtctctacgaaaacaaaaaattagctgggtgtggcggcgggcacctgtaatcccagctactcgggaggttgaggcaagagaatcacttgaacctgggaggcagaggttacagtgagccgagatcacgccattgcactccagcccaaaagtcagtgcgagactctgtctaaaaataataataataataataataaaataaattagccaggcattgtggtcacagctacttgggaggctgaggtgggaagattgcttgagcacaggtggttgagagggcattgagtcatggttgcaccactgcactccaagctgtgtgacagagcaagaccctgtctccagggggaaaaaaaaatatctctgggctcctgaaatggcagtgtcataacatatcactgcattattttctttctctccccagcatgttcagctcttgacacaaatccaccttcttgccacctgcaaccccaatctcaatccggaggccagtagcaccaggatatgtcttgtaagtttccaaattgccgtaattctatagactagaatataaaattagcttggcaggttatttctcacagttattctctcaggtatttttgattgctgtggcttcctatgtttgctgagtgaacataagccactgattcacatgaaaggacaaagagtgtattcaattttttcttttcttttttgagacagggtcttgctctttcacccaggatggagtgcggtggaacaatttcagttcactgcaacccctgcctcccgggttcaagtgattctcctgcctcagcctcccaagtagctgggactacaggcgggcaccaccacgggtaattttttttgtatttttagtagagacagggttttgcsatgttggccaggctggtctcgaattcctgacttcaagtgatctgcccacctctacctcccaaagtactgggattacagccatgagccactgcgcctggcctgtccttctgatatttttattgggtcctcctcctcatctttagattcaccctgacttcttaggtttttggtaccgctattcatttcatagatgttgaggctgggcatagtggctcacacctgtaattccagcactttgggaggctgaggtgataggatcacttgagcccagtggtcaagaacagcctgggcaacatagtaagacccggtctgtgttttttttgttttgttttgttttaatttaaataatgaagtaaatatacatgtagatgttgaattcattatccattcatgaagctcaatattagtgttttatgtgtagagctagttttgctcatgacgttttgaggtattttgagctttttttttttttttttttttttttgagacggagtctcgctctgtcgcccaggcyggagtgcagtggcgggatctcggctcactgcaagctccgcctcccgggttcacgccattctcttgcctcagcctcccaagtagctgggactacaggcacccgccactatgcccggctaattttttgtatttttagtagagacggggtttcaccgttttagccgggatggtctcgatctcctgacctcgtgatccgcccacctcrgcctcccaaagtgctgggattacaggcgtgagccaccgcgcccggcctattttgagattttaaatttgaaatttggccaggtatggtggctcatgcctgtagtcccagcactttggtaggtcaaggtgggaggattgcttgagcccaggagtttgagaccagcctgggcaacatagtaagaccccatccctaccaaaaaaataaaaaataaaaaaattagctggggatggtgccgagtgcctgtagtcccagcaacttgggagactgaggtaggaggatcacttgagcctgggacgttgagactgtagggagccrtgcttatatatcactccagcctgggtgacagagtgagaacctgtctcacaaaaacaaaaccatactttacctcataaaaattgcctcaaacttttggacaggtaatgataatactctcagcttcttcagtaagtcttctttggattttgaagagtacatttgctagtattctaaaacttccttggtgatcaacaggatgtcttcatctcttactgtattcagaggaggatgaggagtacttggttgtaggcattaytctgagaccaaaagacaaaacaattttaaaagtaatggtcctggtcgggtgaggtgactcatccctgtaatcccagcactatgagaggccgaggcaggcggattgtgagcccaggagttcgagatcagcctggccaagatgggaaaacgctgtctctgcaaaaaatacaaaaatcagctaggtttggaggtgtatgcctatagtcccagcttctcaggaggcagtgggaggatggcttgagcctgggagggggagtttgcagtgagctgagatcatgccactgcagtccagcctgagcggcagagtgagaccatgtctcaaaataaattaattaattaaattaaagtaatagtccccattcttgagactcttaattctagctcgggagctagaccatgtattccttagtgagaaacagtttaaaaataaaacaagaatataatccctgaatatctgagaactcaggcataatcttaacagtagtttattgtgaaagactttatgattatttttacctgtttttatcctgtagtaggaaggtcagcttctcatttagattctgaaggctaytggtattaattgtctggaattgtcttaratcttycttgtgtcstgttttcccagaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactggtaggagacagatgtgtcagctttaagtttttacttgcggtgagaggtggtgggaatcttatcccatagataacttcctaggatacttgcctaggaatggaggacacaggacatttgtaatttcttccttctctcttttatcctccctttgtactcattatccaagttctagaattacatgataatctcyrggcctgggtaaggcatggaggcagtggacagtataggaatatgggaggtagagatctgaggctcagtgctaagaattggactacagcaatatgaggggtaagtattaggartcagatcragataaactggggcctggtaaagatgaaagtcaggtggtaaagttyggtcatgtttagctttttaytctcttcattaagatcaactaactttatttaccataatgattgtagcataggtgatatctccattctgaatgaaatgttgacttgcaagttaggcgtaaattagagattgtacatttgccgtgttcagtattttaaagaaatttgccggtttagattctaccttgcattggtttagtattttttgagaaaatatttgctatttacttaagccaaatatttacttctgatttgtttgctgacttagcaaattagttgtggtttgttctggatttgggtttgtctttggattctattttaaatccctaagtcttatcattacattgaatgtagttgaatttaagtgtactatatcatagacacagatcccaaactactttaatagctatattatatgaaatggtaatgaaaacgtgatttaataccaaattatagtattatcttacacatctagtgtcctgtgtttttcttctggagatataaaaatgacacttatggaaggagaaatatggatatagtagttttgtctctagaaatgcagaggtgcctaaaattgagaggctgagagagggagacagaaatgaatgagactgaattgtctcattccttttatggttcttttgttcccaacctcaggaggaatctgggagaacttaatgaaagttaagaaagaatgaaataaaagtaaaatttggaataccaggtttgtgagggagattaaagaagttggaatcttttttcttttttttttttttaagatggagtctcgctctgtcacctaggctggagtgcagtggggtgatctcggctcactgcaacctccgcctcccaggttcaaacaattctcctgcctcagcctcccaagtagctggaattacaggtgcgtgccaccatgcctggctaatttttacatttttggtagagatggggtttcactatgttggccaggctggtcttgaactcctgacctcaggtgatccacctgcctcggcctcccaaagtgctgggattacaggcgtgagccagcacgcctggcctggaatcttatcctggaagaaaaaagcattgttgaaggtctgttatccttcagagatttaaaggggaaaggaggtaaaacatttttgagcatacactatgtgacaggtattactaggtactttttaagtgtttgttttactttgtgaataaagtgttacacgtaagaaagagtaagagaggccgggcgccgtggctyacgcctgtaatccaacactttaggaggccgaggctgtcggatgacaaggtcaggagatcaagaccatcctgtctacagtgaaaccccgtctctactaaaaatacaaaaaatcagccaggcgtggtggcaggcgcctgtagtcccagctactcaggaggctgaggcaggagaatggcctgaacccgggaggcggagcttgcagtgagccaagattgcgccacgcactccagtctgggcgacagagccagactccgtctaaaaaaaaaaaaaaaaaaagtcaacttttattgccagtgaatgggactccctttagacctaatgttagttgaggaaagactgtggaaactctttggggagtggtaggcagatgggagggaatcaagttagataaggacagctctacctaaatgcaaaaatgcattcacaggctttttgaagccctcttttttcctagaagttgatttatcagagatttattttcttatagccaatgaatttccctgtttgccaaagcaagtggcttggatcctggccacaagcaaggttttcatgtatccagagttacttccagtgtgttccctgaaggcaaagaatccccaggataagatcctcttcaccaaggctgaggacaagtaagtgtttactctgggggatcaaatatcccaaggagaagatgtagttcctttgaggagtttaggggaagtaagacttgtataataagacatggacacaaaaggaaaagcagtatagatgagcagagtcctctagaacgtgcttgttctagcagtgccaaatactgctttttggggggatgttacacacatttttaaaatgttttagactggacatggcggctcccacctgtaatcccagcactttgaaaggccaaggcaggaggttggcttttctaatgttattatttatttagagacaggatcttactctgtcacccaggctggagtacagtgttgcaatcacagctcactgcagccttgaactcctgggatcaagtgatcctcctgcctcagcctccatggagtagctgggaccacaagcgtgtgccaccatacatggctgattttttttgtacaggtgagggtatctctgtgttgcccaggctgctcttgaattcctgacctcaaatgatcctcccactcctggcctcccaaagtgctgggactataggcataagccaccacacccagctagattatgaacatttttatggccctttgtgtgtattgccacactgttaacagcaaatatgtatatatgtaaccatgattatatatgttatgttagagggtagtattggtgccagtttaatttgtctgacggggtacctattattcattttatatttgttttattagaatcattctccttcccatgtattctctttgaacttcctttgtgttgttaatatacagctcatcatgatctgacatttattgatgatttatgactagtttctcttgctcctacttaattgtgaactatttgattcttattcatagtacttaatcactactcactaaatacctgaaattttctactgagtagtcaccaacttgtagtagtcactacaagaattagttgtagaaaaagtagattggccagccatggtggctcacacctgtaatgacgacactttgggaggccgaggcaggaggatcacttgaggccagaagttcaagatcagcctaggcaacaaagtgagaactggtctctacaaataatgaaataaaacattagttaggcatggtagcaaacgtttatagccacagatactcaggaggctgaagtgcgggaatcgattgaacccaggcattcaagactgcagtgcactgtaatcatgccactgctctccagcctggacaacagagcaaaaccctgtctgaaaaaaatgaaaaagtagattgggccacacgccatgggctcatgcctgtaatctcagcactttgggaggctgagactggagaatcgcttcagcttaggaagtagcagctgcagtgggctgcgatcacgccactgcactccagcccaggtgacagagtgagaccttgttttaagaacaagtaagaaaaagtagattgtaaaatgtgttagtctggggaggccctttagaaggaaggactgtgaagtgagatttagtgttattgctcctttctcagtttgttagctttaggactgaagcattttgaagggactgagtttcttaaccctctaatcagcaagtaccttctaacctgcaagactgcccgccaactgacagtgagaatcaagaacctcaacatgaacagagctcctgacaacatcattaaagtgagtgtttcctgcatgcactatccaggcacctcaccaacacatatctgttcttttctcttgttattctcaaagaaaagaagaaccttcttttatctaaagctaatttctcctacttatatactagattaattcccctgttgccttttcagggacattgattcattcattacgttcctctggagtatcttcatcctcttaaaagattccacaaatccatgtttccctgtaataattctctttcttgaactttctagaaatgataygcagtattccacttacatgctttgggtttttgttttgttttgtttttttggtcagacataatcttgcactgtcacccaggctggagtgcaggagtatagtggcatgatcttggctcactgcagcttccgcctcccgggttcaagtgattctcctgcctcagcctcccaaatagctgagattacaggcgtgcccaccacgctcagctaattttttgtatttttagtagatacgggtttcaccatgttggccaggctggtcttgaacttctgacctcaagtgatccaccagttttggcttcccagaggctaggattgcaggcataagccaccgtgcccagcctatatactttttctcaattttgtgtttgtatgtatgcatgtatgtgtgtgtgtgtgtgtgtgtgtgtttgtgtgtgtctgtgtctgtatgtatgtatgtatgtatgtatgtattgagatggagtttcgctcttgtcgcccaggcccrgcctatatactttttctcaactctttttacttattgattgattgattgagatggagtctcgctcttgacccccaggctggagtgcaatggtgcgatcttggctgactgcaacctctgcctcctgggttcaagtgattctcctgcctcagcctcccttgtagctgggattacaggcccctgccaccatgcccagctgatttttgtatttagtagagtcggggtttcaccatgttggccaggctggtctcgaactcctgacctcaggtgatccatctgcctcggcctccctaagtgctgggattacaaatgtgagccattgcccccagccttcttttttatttagatatttatttatgtttttttttttttttagagacaggttctcactctgtcatcctggctggagtgcatgggcacaatcataggtcactgcaacctcaaattcctgggtgatccttccacttcagccttccaagtagcttggactacaggtgcatgccaccaaggctagccgattattttattttgtgtgaagacagggtgtcattttgtttcccaggctggtcttgaagtcctgacctcaagcagtcctcttgcctcagctcggcctcccagagtgttgggattacaggcgtgagccatgatgcccagcctttggtttcattgtgtttttgtatttttcttgagacaaggtcttactctcctgcctaggctggagtacagtggtatagtcatagctcactgcagccttgaactcctaggctcaagcattcttccaacgtcagcctcccaaggagctgggattatatgcattagccactgtgcttggccattaaatttatttatttatttattttattttatttttttgagacagaatctgtctctgtcacccaggctggagtgcagtggcacaattttagctcactgcaacctccacctaccgggttcaagcaattttcatgccttagcctcctaagtagctgggactacaggcatgcgccaccacacctggctaatttttatatttttagtagaaacataatttcaccatgttggtcagtctgatcttgaactcctgatctcaggtgatctgcccacctcggcctcccaaagtgctggaattataggcrtgagcctctgtgcctggcaaaaaactttttttttttagggatggggtgtccctatattgcccaggctggtcttcaatttttggccttaggcaattctcctgtctcagcctctaattggtactgcctggtgtattggatttaggccttacttattaaccataaaccacggaagccgaagatttacctctctcctcactcccttactcccaccacaaacatgcacattttctgctctccaaactcctcactagtagttatggtagaattttggttagattgtattcagggtttacattgtaagattttaaggactgttggctgggcgcggtggctcacgcctgtaatcccagcactttgggaggccaaggcaggtggataacgaggtcaggaaatcgagaccatcctggctaacatggtgaaaccccagctctactaaaaatacaaaaaactggctgggcgtggtggcgggcgcctgtagtcccagctactcgggaggctgaggcaggagaatggtgtgaacccgggaggtggagcttgcagtgagccgagatcgcgccactgcactccagtcttgccagagcaagactccgtctcaaaaaaaaaaaatagattttaaggactgtataaatgctcttcacagctcagctatgttactgtgttaccttgcctttcctgctgaacattttgtttcccagatcatcttctttcagtgtgttcaggtattctagatattctgtcactttcatcttgaagaaattgctccctgagccctctgacattattccactttaagcgtgttgctctccatgttgctgcactgatgtcttcttgggctttttcttcaccatcatcccaggaattccttttgcctcatactgtgttagatcctcttatttcctgaattccacatctttgcttttgcattactttttttttttttttttttttttttgagacacagagtcttgctctgtcccccaggctggatctcggctcactgcaacctgcaaccttggtcttggtcttgaactcctgacctcaggggatccacccacctcagcctcccagagtgcggggattacaggcgtragacaccacgcctggccttgttttttgttttgttttgcttttttttgagaccgagtctcgctttgttgcccaggctggagtccaaaggcgcgatgatcttggctcactgcaacgtccgcctcccgggttcaagcaattctcctgcctcagcctcccgagtagctgggattataggcacatgccactacgcctggctaattttttgtatttttagtagagacagggtttcaccatgttagccaggatggttttgatctcctgacctcttgatccacccgtttcggtctcccaaagtgctgggattacaggcgtgagtattacttctttactttagtggaacacattctagtagcttttttttaaaaaaaatttttttctgaattttaaaaaattgaggtgggggggtctcagttttttgcccaggctggtctcagactcctgggttcaagtgatcctcctgcttcagcatcccaaagtgctgrgattataggcatgagccaccctgcatggccccattccagtagcatcctgagggagagtgcttgggaagggaattttcacatttaaaccatctccggggccgggcgcagtggctcacgcctgtaatcccagcactttgggaggctgaggcgggtggatcacgaggtcgggaaatcgagaccatcctggctaatgtggtgaaaccccgtctctactaaaagtacaaaaaaattagccgggtgtggtggcgggcgtctgtagtcccaggtactctggaggctgaggcaggagaatggcgtgaacctgggaggtggagcttgcagtgagccgagatctcgccactacactccagcctgggtgacagagcgagactccgtattaaaaaaaaaaaaaaaaaaatctccattcatggtcttttgattgtatcgatgtcagtttcctcgtttttgtttttgttttattttttttctttttttgagacagagtctcactgttgctcactgcagcctctgcctcctgggttcaagcgattctcctgcctcagcctcctgagtagctgggattagccaccacacccagctaatttttgtatttttagtagagatggggttttgccatgttggccaggtgatctcgaacccctgacctcaagtgatctgcccaccttggcctcccatagtgctgggattacaggcatgagccaccacatcctccatgtctggccagtttcctggtagtaatattgtactgtgtaccttgtttatatgtatagctcttgtttctatgtaacataaaaacattatattgggagaaactggttgaagggtacatgggacctcttggtactattttttgcaatttcctatgaatataattatttcaaaataaaaggaaaaaataatactctcctctgtcactgtatctagaattctagataggaaataatttttttaagaagcttttaagggcctcacttcattttcttctaactcctagtgtggtgttaagaaatttcatgccatttaactttttttttttttttccgagacagggtcccaccctgttgcccagtttggagcgtggctaaatcatggctcactggtgtctccaacccggtgtgcaccactatgcccagctaattttttttttttttttttttaaracatggtctcgttatgttggccaggctggtctcaaactcctggcctcaagtgctcgtcctgtcttggcctcccaaagtaatgggattataggcatgagccatggccccatttaactcttgagtctttgtgtaacacctgtttttctcaacctctgacagcatgcaggatttttcctttggcttcaatattttgaaaatgcatgataatatgccttagtatttgtctatttttatccatggttttttaaaaagtactttctttttgtttttgtttgtttgtttgttttgagacagagtctcgctccattgcccaggctggagtgcaatggcgtgatcttggctcactggaacctctgcctcccaggttcaagcaattgtcctgtttcagcgtcccgaggagctgggactacaggcgctcaccaccacaccctgctaatttttgtatttttagtagagacggggtttcaccttgttggtcaggctggtctcraactcctgacctcgtgacccacccacctcagcctcccagagtgctgggattacaggtgtgggccaccatgcctggcgtatccatggttttaaggcacacgtgataaaccttattcttctgcagaaataatttttttttttttttttgagatggagtctcactctgttgccaggctggagtgcagtggcgtgatgtcggcccactgcactctccacctcctgggttcaagtgattctcgtgcctcagcctcccgagtagctgagattacaggcacgcgccaccacacttagctaatttttgtatttttagtagagatggggtttcaccatgttggccaggatggtcttgatctcctgaccttgtgatctgcctgcctcggcctcccaaagtgctgggattacaggcataagccaccacgcctggccagaagtaatttgtgtttaagttttagttttgtgtcatttttcgtgcacacctttgtacttttgttgggggatggggcggggtgtcggggttggagtcttgctctgttgcccaggctggagtgcagtggtgcagtcttggctcactgcaacctcttaattcctcagttcaagtgattctcctgcctcagcctgccaagtagctaggatcacaggcgtgcaccaccacacccagctaatttttttttgtactttattagagacagggtttcgccatgttggccaggctggtcatgaactcctgacctccagtgatccatcctcctcgttctcccaaagtgctggcattacaggcatgagccaccatgcccagccctttgtacattttttaatgtaggatgccatttgtccacttgactctcccactagtctgtaagctccatgagagcaggaattgcttcccttatgtgtgtgcttagcttttagcacagtgcctaggatatagaaaacatcttatgttcatcatgttggatgaacagatgcttattgtcagtggtttaagttcagttcttatcttctttttttttttttgagatggagtctcaccctgttaccaacgctggagtgcagtggcatgatcttggctcactgcaatctccaccctaccacccccactgccaggttcaagcgattcttttgccccagcctcccaagtaactgggattacaggcacccaccaccacacccagctaatttttgtatttttagtagagatggagtttcaccatgttggccaggctggtctcaaactctcaatctcaagtgatctgcccgcctcagcctcacaaagtgctgggtttacagatgtgagccaccaaggccagcctatttactcttaaaactgaactgcctcggtctttttttttttccttcccttctgatgcccttcacaccatcatttgcttaaagtctttgatgtgtccattttatagattacgatgctgtctttgcagctgttgagcaggaacaaatcttacataagattgctcttagcatctgcttccttttctctctgtgacctaaactctccccttcctggcaaccagaatggagatcatcagttagaaaatattgaatagggctgggcgcggtggctgacgcctgtaatcctagcactttgggaggccgaggcgggtggatcacgaggtcaggagatcgagaccatcctggctaacacagtgaaaccctgtctctactaaaaatacaaaaaaatcagccgggtgtggtggcgggcacctgtagtcccagctactccggaggctgaggcaggagaatggcgtgaacctgggaggtggagcttgcagtgagcggagatcgcgccattgcactccatcctgggcgacagagcaagactccgtctcaaaaagaaaatactgaataactataaaatctttaaatagagattagtttaatttgaaatgtacaagtattcagcatatgctattcgtatatgtgtgttcatggatgtttgtgtatgtggtcttgtgtgkgtgtgtgtgtgtgtgtgtgtgtgtgtgtgtgtgtttctcttgatccaccaccaccccattcaccagcctgacagargacagtgtttccagaaggaatgtaattcatgcgcatttttttcatgttaagttttataagaagaccaaacagctgccagtcctaggaaaatgctgtgaagagatccagccacatcagtggaagccacctatagagagagaagaacaccggctcccattctggttaaaggtacagccctcttcctcgaagtctgtaggaggcagaaggtcactgaaagttctgagagaatatcaaggrcttccttaatcgtctaatgctttagttgtagaactaggacttcaggaatcttcctgattcacctttcttcccttacttttctgcccttctccgggtgattctacaacattttcaaaataatgggtaaaatggtaatttgctaaaggaaattcagagaagagtttctaaagtgtataattggactgtggtctttgtagaaatttcatatgcagagtcccttggaaagatgccttgagcttgtctcaggtccctaaacttagaaagtcctattcttttycccaaattctgacatgtgctggatcagagtgttctcatttccaataggccagtctgccatccatccaggaagaactgcggcacatggctgatggtgctagagaggtaggaaatatgactggaaccactgagatcaactcagatcaargcctagaaaaagacaactcagagttggggagtgaaactcggtacccactgctattgcctaagggtgtagtcctgaaactgaagccagttgccgaccgtttccccaagaaggcttggagacagaagcgttcatcagtcctgaarcccctccttatccaacccagcccctctctccagcccagcttcaaccctgggaaaacaccagcccaatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctatgccccctgaggccaggacaagcttccctctgtctgagtcccagactttgctctcttctgcccctgtgcccaaggtaatgatgccctcccctgcctcttccatgtttcgaaagccatatgtgagacggagaccctcaaaaagaaggggagccagggcctttcgctgtatcaaacctgcccctgttatccaccctgcatctgttatcttcactgttcctgctaccactgtgaagattgtgagccttggcggtggctgtaacatgatccagcctgtcaatgcggctgtggcccagagtccccagactattcccatcgcyaccctcttggttaaccctacttccttcccctgtccattgaaccagccccttgtggcctcctctgtctcacccttaattgtttctggcaattctgtgaatcttcctataccatccacccctgaagataaggcccacrtgaatgtggacattgcttgtgctgtggctgatggggaaaatgcctttcagggcctagaacccaaattagagccccaggaactatctcctctctctgctactgttttcccsaaagtggaacatagcccagggcctccaccagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctsaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccmctctgtggaatatacttttgcttcaataaatctgtgcttttattgcttmattgtttcattgatttgtgcaatttgttcagttcttcattcaacattccaagaacctggacaaattgtagtcaagaccctccgacagtaacatattttggcaagccagcctggaggtaagtccaaattgcggtgcaggggaagggggcggttatttttcttttcttctttcctttttctttccctgtcaagccttcatttttcggcatgggctggagctatatctctgtgcagggctccactccatacaggggaaccttttcctctctctctttcccttttccaacttgagactcagcagatagcatgtgaacatggaggcaactgcaggtctctggccagggccactctccagtgagactgaagggtatccacgtggaagcacctgatcaccatcacccagtttgggtgacagacctgagttctctttttttgagtctttcagctgctgttttctaacagctctttggtaattgagggcaactggacagggccactctccagtgttacctgaaggccaaggaatgaatcgggatagcttccctgcccggaagggagaaagactcttttatctttcctggttatagtctctgagttctacacgtgacaccattggcastggtagctcattcagggcgaattcacactcaggcctcttaaaccctcctttcttaggccaaattctcttacagagttagccagtgagggcaaaagatagtatctcctagatattttgacccttctactggatccatttggctggctgatgacctttgggacccacaagctttagaatacattctacatcttggacctccactgaggggaccttgtttcctttgtcttcaccatattatttcaatagaatggcctgcccttacacaggacccattgccatggtggtggatttttaaacattccctctcttgcccagggccagaatggaatagccagccctattttatctttcatgcctaaaatcaacctttttccctgaaattacccataatccacatgacaaaagaaayctaccagcctcctgttcctcttattagggttcacagctatcactctagtggaacaggaagtgtgggaaaccatggccttaccaaattataaggatgctagaggccaggtgctgtggcccacacctgtaatcccagcactttgggaggctgaggcggatagatcacctgaggtcaggagttcgagacctgcctggccaacatggtgaaaccccgtctctactaaaaatacaaaatgagcctggcatggtgatgcagacctgcaaccctagctatttgggaggctgaaataggagaattacttgaacccaggaggtggaggtttcagtgagccaagatcatgtccactgctctccagcctgggcaacaagagtgaaactccatctccaaaaaaaaaaaaaaaaaaaaaagatgctagaagtcaaggccttcatctaggaataaaaggagttaatagtgggtcaccagtggtggagagaaccttgccaaagtagtgctggcacccatcaaaggtcacatgtcacactaagatgggaccctaaagggggacacccttagggaccccaaacaagcagccaggaacaatgggcagtcaatggaattcttaattattaacaccatctgcaattagacctattttgcaaaatgcagggtaaattgccagaaatcccatatgtgcaggtcttcatgggtgtatatcaaaacccaaccatgtgcaaaactccaggacctgtcccataatcaaaggtcctaaggcagaaccagatattgtagatgatcctattttgacaagggtcacctgtctcgggaaatggcaacctctcccgtatagcctgttgccaagtgttcctgaggctcaaacccaagagcaaaaaccaggaaccctgccaagttcccctcacagtggaacaccttattcaactccctttcagccctaccactcctgagggaagtagcaggagccaaggggccagttagagtgcaggcctgcttctccataacacaatgtaaagaaaagcttggaagctattctgagaaccccaggaaatttgcagatgggttccaaactttgactttagcctttggtttctcatggagggatgttcaattaattctagcaacgtgttgtaccccctgggaacgaatctttgaggccgcctgccaggaagtccacgatttatttgcctgaagcctttagggcaatcaccagggcccagccccagcccctactactgatcctaattgacacccctgcgggaatgaacaactgggccaaatttcttgaggctctccttggaggaatgaaaaagacaatatcttaaggtagcaaattatgatcagggaggttatacaaggcaaggaggaaaatccagccatgttttatggtaggctggggaaaggaaatatgccaatctggacacttcctctccagaaggcaaaatattaatgcaaggaggaaaatccagccatcttttatggtaggctggggaaaggaaatataccaatctggacgcttcctctccagaggcaaaatattaatggcacagcatttcattagccaatccgctccagccattaggctccaaaagctatagatgatgccacagactaatcaaaatcaacttcttgatactgccttatggtgtataacaatcatgacctggaggaaggaaaaggaataaagaagaagcaagccaaaattacgatagccatcattggagatgccctgaatgcccaaagagtgcccaagggaatcccaatgggccataaggataatgccagcaaaggctcttgcttcaaatgcaagaaaaatgggaattgggcaaaggactgtagtaagcccccactgggaccctgttggcagtacaaaggcaccagtcacaacccctggtgctggagaattaactgccccctgttacacagaggaggtcagtcaaaactcttaacagtgcaaaaggagaaattgatgaaaactgatggggcccagggccttcctcaccacccctgcccaggaacatcattcattactattgaggagccctgggtaactctggacatgttgggcacccaaatttggtttctttttgatacagggacaaattactttgcccttactacttacgtaggaaaagcttcctccccatccacaagcgttatgggaatggaaggagagccacaaaaaagattctttattcctcttttgacttgccaatttgagaaacaaatcttccaacaagaatttctagtagtaacaagctgcccagtccccttgttgggaggggatattatagttaaaatagggacactgctacgatttaggcaccacccagcaaaattgctaatagtaatgcagacaatgtcccagaccacattaataaataggtcaacgcactagcatggtatactgggaaactgggtagggctaaaacagaaatacacttggacagtgcccctccctcagggctttcaggataaccatgtttgtttgttttttgcacaagccttggggatctaagggatctaaaattggaaaatggagtgtactctagtatgtacatgaccttcttgtgtgtagcccaacccagggggtgactaaaatactataagaaccttaaatttmtctgcagatgggatataaagtgtccaaaaggaaggctcagattgcccaccaaygggttcaatatttaaggtgtatcttaacacccagagcccagcaaatatccccagaatgagtgcaagccgtatgtggtttggagctcctcccacaccaagcaacagcttcgtcgttttctggggatggctgggttttgcagaagatgggtaccaaattttgggctcatagcaaaacccctttatgaaagcaacaagggagccagaaaatgagccaattgaatggactttggaaatgagagaaggctttatcaagttaaaacaggctctcagccagcctcccgctcttagcatcctagacctcactaagcccttgtatgtagcagaagggaaaggcatagccatgggagtgccaactgcctacttctcaaagaaattggacacggtggccaagctgcttgccgtcgatggcagacactgctattttagtggaagaagccgctaaaatcaccctgggtcagccactggaagtattaaccccacatcaagtcaatcctagaaataaaaggacacaactgtatgatgggggaaaggttaaccaaataccaggctatgctcctggaaaatctagatgtgacccttaaaacctgtaacactgtgaatccagyttgattgctgcccacaggcccaataattaatcattcctgcgagcaagttattgcacatacatatgttagccagcctgatttaaaaggttgacctctcccagattcagaggatgactggttcacagacctcagcagctttatatcaaacgggaacactgggccagatatacaacagtaaattacaatacaattattgaggtccaacccctgcccccaggtatgtcagcacaaaaagctgagatcattgctcttactcgagttctgacattaggaaaagggaaaaagcttaacatctatacagattccaaacatgcatttctcgtgtttcatgctcatgctgcaatttgaaaagaaagagaaagaggactactaactagtaaatcttccaccataaagcatgggtctgaaattcttcaactgttggaagcaatacacttgccaaaagcatagccataattcattgtagggggcatcaaaagaacctaacccctgtaacacaagggcacagaaaggctgataagccaaagccgcactgctcagggtgtaatcccgacaaattctagcactgcttcctttctatgattccccaatagaacctgaatatccctgtgatgtattcagggatattcgaagtaaaggaggaagatggacacaaacaaggatcctggtggtatatagtatcaaaagtgtatctccctcaaacagcccaatggagaattataaaaatcctgcatgactctttccatatrtgaggagatgccactcttgccatgataaacaggctcttcattgggcctgacttaacttccgtggttaagcaggtctgtcaaacctgttcactgtgagcattcaacaaccccaggaacaaaatgcctcctctaatagaaccagtccggagaaggggcacttccccaggggaagactggcaattggattttacccatatgccagcttgtaggggatacaagtttttgctagtactaatagacacatttactggcttaccctagcagaacaaagaaggctaatgaagttataaaagttctcctaagataaataatccccagtttgggttaccccaaagcctccaaggtgagagcagtatgtctttcgtctcccaaataactaaaagggttgctaaggctctcggaatctaatactatttacattcagcatggagacctcaatcctctgggaaagtagaaagggctaatcaacctctaaaatcggcattagctaagctatgtcaggaaacttcagaaacttgggtcagcttgctgcccatagtccttttaaggatccataattcccctagagcaaaaattaatatgagcccatttaaaatgttatacagaagtcttttttttttttttttgagacagagtctcactctgttgtccagactggagtgcagtggcacagtcttggcttactgcaacctccacctcccaggttcaagtaattctcctgcctcagcctcccaagtagctggcattacaggtgtgagccaccacaccccgctaatttttgtatttttagtatagatggggtttcactatgttggccaggctggtcttgaactcatgacctcaagtgatccacccaccttggcctcccaaagtgctgggattataagaatgagccactgcacctggctgggaaggccatttttaatggatgatctaattactgatccagaaatagccagtttagtaaaatacgtaattaaccggagacaatttcagcaggcatttcaaaagtttggaactcaaaggttctctgcattgggaactaaccagcaacccaagatcaggccaggagagaaaagtatttgttaaaacacagaaagaggggtcacctgctcaacaactccaacccaaatggaagggactttttcagtggtgttggccacgccttctgtagtcaaagtaccaggattagaagttggatacgtctttctagggtcaagcctgcaatacctgaagccccagacctgtaacttgaagcttccgtcagccactatacctgtgaacctgtggaagacctgaagtacctgttttaaagacagtcaaaagataagtgaatgcctaccaactctccttggtgtctatgctgcatagttactgtaggtttgataatagtagcagtttttatatttttataatttattgccttcttccaaatggatggaatcatttcctttgtaataattaagcaaaatgttttacttcatttttgtaacattattcctgagaggataggtatacaccccctgaagttcccattcaaaagaacaaaataacagataagtatttttagtcccataatggttagccctggcctgtgtatactgggaccaggcatactgggaatcagcttaattttacagcagggttttattttacttctctggcaattaatggattctgggtatttattaagactttaaaatttaacccaaagactgttaaataccaccagtccagctctggcaaaggactgttggctttgttcatctccaacatcaccaaaacacactgccatcgcaacccaggcttatcttgggcccttgaaaaaatgtcctaccacctcaactacaagggagggactcccttcaaattaatggatctgcatgacttctatgacttcaaaattacataaacaacaaaagttacaatgtcaggatgagcagtaaaccttctccagtcctaccaaagtaacatttctggggttgcatctcctcaaaaacctatttggggcccaagaacgcacaaagaactaaaatcccaggtgccactttgtattaaaaaattctagtcaaaccctgggaaccttgagtcatcagagtaactacaccctagggattaacctctcacatgatatgtaagctatgcagttacctaggctgcatcatttagaaaacctgtatggtttgcatgaaactattcctaattaagggcactttaaaggacacacagtctaagtactgtcaaggtaggaccactagctgtgttcacattttcacttgggaagactgtagtaatcctaagacagctagttgccttttggttctccagtatgaaaatacctctgggtggttgctggtggacactaagcataactaccttcaccaggaaaacttaactgctaggacaactgaggatacttcccaaggtcctttccagcctttaactggagccaccttagcagggaccttaaccactggggaaagaaaaacaaaaagctaacccatatgttcaccatagagaatgatttttatcttgaaaaacacggagtctttttcctgtgtggaactagttcctagttatgtttaccaatcaaatggactgaaacctctacacttctttatttagcccctgaaatctgtatagctctcaataaccagtctctcatacctttaactgcacccgccaggcacaaatgaaccatcaaactcatactccttttggtaggactaggaataaccgcagaagtaggaacaggagttagcaggcttgcaacattcctatcctattaccaacgtttgtccaaggatctttcagagagcttggaagacattgcccaaagtactgtcaccttacaaaatcagatagactccttggcaacggtcgttttacaaaataataggagactggatttcctagctgctgaaaaaggtggcatatgtcttttcctaaaagaagaatgctggggttttttgttgttgttgttttgttttgttttgagatggagtctcactctgtcatccaggctggagtgcagtggcgcgatctcggctcactgcaagctcctcctcccggatttatgccattctcccgcctcagcctcccaagtagctgggactacagacgcctggcaccacgcccggctaattttttttttttttttttttttttcagtagagacagggtttcaccgtgttagccaggatggtctccagctcctgacctcttgatccgcccgcctcagcctcccaaagtgctgggattacaggcgtgagccaccgcgccccaccgaagaatgctgtttttatgtcaaccaatcaggattagcaagagatgccgcctgaaaattagctgatggggcctctaaaatataacaacagctgtccgagtcatggggcttctggtcaagggcactaagttgggcttcatgtctacttcccttagctggcacattattaacaattatgctcgcattgaccatgttggaccatgtttgttaaatcttttaaccaaatgtattttttctcacctagaggccattaagcttcaaatgatcatgcagcagggcttctatccagggaatgatgccagccccggccaacaagaagtcatcctgtctccactagacagagcagggtgagagttccatggtccccaagtagatagggacagtgccccaaacagcatgaagcagttacagaagaaagactgtcagtccctctacctcctgtaaatatttgatattaagtctctcaagggggaatgaggcaggagaataggatctggagacagggagccttcactttagcctctgattggtcgcaggcgaaatcttcatttgcatagggtgtaatttcacttcagcctccaattggtcatgggctacgtcttcatttacaaagggtgtaaccaataggaaacctctaaagggtactcaaacccaagaagattttgcaactggggtgcttgagcctcttgcccaagcctgcttctgctctgtggaatgtactttcacttcaataaatctgtgctttcgttgcttcattcatttgttgctttgcttgtgcattttgttccattctctgttcaatacgccaagaacctggacaacttgtagtcaagaccgtccactggtaacaccctgagcacggtatttgtgatgacatcaaggaagaacacactgtggaattagacactggctccccaagtgaggagttgagcagtgctagagaggtaaagaaacagacaatcttacagaaggaagaagagaggattcagccaactaaaaccccttcatcttctcaagaacccccaatgaaggaaacttggggggagatgagggcaaaggatcaccaaataatgcttcatcctccatgaatcctgaagtgaggcttagtagcccccagggaagcccaaagactcatccagtgttgatggtcagtcagtggggaccccagttggaccagaaactggaggagagaaagataggccagaaaaagaggaagaagatgactttgatgacctcacccaaaatgaggaagatgaaatgtcatcagcttctgaggaatctgtgctttctgtcccagaactccaggtgagagctagagaatactctcaagtattttgtggactcagtaatatgtttaacttattgatatgccacctgcttgcttgctgcactatggatagtcctaaaatcatttgtatttgatttgtgaatgcattatgggacatgattgtggagttgaggtgaaatgagatggaaaggatgaaattttacttattatattaaactcgtttacacattaaattgaatcacctgaccatactttaaatgccttaaaaaatagtatatagggccaggtgcggtggctcatgcctgtaatctcaggcatgggaggccgaggcaggcagatcacctgaggttgggagttcgagaccagcctgaccaacaaggagaaatcctgtctctaccaaaaatacaaaattagccgagcatagtggtgcatgcctgtaatcccagctactcgggaggctgaggcaggagaattgcttgaacctgggaggtggaggttgcagtgagccaagatcacgccattgcactccagccygggcaacaagagcaaaactccatctcaaaaaaaaaaaaaaaaatagtaaatagtccaggcttggtcgctcacacctgtagttccagcactttagaaggccgaggtgggcggatcacaaaacgaggtcaggagtttgagaccagcctggccaacatggtgaaaccctgactctactaaaaatacaaaaattagcccggcgtggtagcatgctcctataatttcagccattcagggggctgaggcatgaaaatccctcgaacccaggaggtggagtttgcagtgagccaagattgtgccgctgcactccagcttgggtgatggagtgagacgctgttgcaagccaaaaaaaaaaaaaaaaaaaaaaaaaaaaggaagaggcacataaatatgggctaaggcaaaggaaaactaatttcagggtaaagaagaagttttcaaaaggcatcttttccactttcctgctgtcaggcccaatgtcagctatcactgggatttcataactcagggaattccgctctgacagctgtagtgggttccccattgtttaacttcagattatcctgatacagctctgtgctgttctgcaattcatgagccactaggagccgtaagtactctttggagggttttacaggaaacaatggagaaactgacttggctggcatctgaaaggcgcatgagtcaggagggtgagtctgaagaagagaattctcaggaggagaactctgagccggaagaagaggaagaagaagaagcagaaggaatggaaagcctggagaaagaggatgaaatgacggatgaagcagttggagactctgctgagaagcctccttctacttttgcytcacctgagactgctccagaagtggagaccagcagaactccaccaggtgagctaggcaaacctatactgaaggaccattctcacttaacctcattgtctagagaacagtgtgcagggtgggtagcttataaaccaggtggaggatttccagaggaaaacttctggatttcttctgcaaccccactcccccaaaacacatttaatgtggtatctttgtggagaacagatacgcagatattttgaaatggagtttttgctcttttttttttttttttttttttgagatggagtctcgctctgtcgcccaggctggagtgcagtggtgcgatctcggctcactgcaagctccgcctcctgggttcacgtcattctcctgcctcagcctctccgagtagctgggactacaggcgcccgccaccacgcccagctaatttttttgtatttttagtaaagacggggtttcaccgtggtctcaatctcctgacctcatgatccgcccgcctcggcctcccaaagtgctgggattacaagcgtgagccaccgcgcctggccagagtttttgctcttgttgcccagactagtgtgcagtgtcatcgcaatctcacctcaatgcaacctccacctccagggttcaagcaattctcctgcgtcagcctcctgagaagctgggattacaggcacacgccaccacgcccggctaaatttttttttgtatttttagtagagacgaggtttcatcatgttggctaggctggtctcgaactcctgacgtcaggtgatccaaccatctcggcctcccaaagtgctgggattacaggtgtgaaccacagctgctggcctactcaaaaaatttttaaattgattctcatccattgctagatttgtattagcttcgttcacttttatttatttatttatttatttaatttatttattttttgagacagagtcttgctctgtcacccaggctggagtgcaatggcacgatctcggctcactgcaacctccatctcccggacttaagcaattctcctgcctcagcctcccgagtagctgggattacaggagcccgccaccacgctcagttaatttttgttttgttttgttttgagacggagtttcactctcgttgcccaggctggagtgcagtggcacaatcttggctctctgcaacctccacctcccagcttcaatagattctcctgcctcagcctcctgagtagctgggattacaggtgagagctaccacgcccggctaatttttgtatttctttagtagagacggggtttcaccatgttggccaggctggtctcaaactactgacctcagataatctgtccccctcggcctcccaaagtgctgggattacaggcatgagccactgcacccagcctcattcactttcttgtactggttcttagctcacctgtcatgtgtggggctaagacctatgtttatttcagaaaacactgcttgttcctcatca

SEQ ID NO: 12257 - DNA, 13216 bp, Homo sapiens
catttaacacacactgctcctctgtcattagggatcgggtgctttttgctgacctagagaaaccccatgcctgaaacctactcatctgctctcaggagaggtagtaattgtcactgctcattgataaacactccctgtcttcattggagcaggcccaggggttgttgggtttaactccatcccaaattccagagatgagccaggttgatgtaagctagtcaggggatctccctccacctgtctcttccctgtacctacaagcatgcacaaacagggcacagcacttccctggtcaaagggcttggttcgattgaggatagagcagtggatggcacaggagacacccccctcccttgctctgaatcaggcagagtgtagatgtgaggcctgggaatgataacagccatttagttcccccaagataagccagacttggaacattgccacttgacacccccattacccaaagacaactggagatagctgagctaaagctcaagcatcgtcatttggaggttggttggttcgtttgtttgtttgtttgttttgagacagggtctctgtcacctgggctggaatgcagtggcatgatctcggctcgctgcaacctctgcctctcggtttcaagcgattctcctgcctcagcctccccagtagctgggattacaggcgtgcaccaccatgcccagctaatttttgtatttttagtagagatggagtttcaccatgttgcccaggctggtcttgaactcctgacctcaagtgatctgcctacctcggcctccaaaagtgctggaattacaggcatgagccacagtgccactgcactccagtctgggcgatagagggagactttgtcttaaaaaagggccaggtgcagtggctcacttctgtaatcccagcactttgggaggccgaggcgggcagatcatctgaggtcaggagttcgagaccaacctggccaacattgtgaaaccccatctctactaaaaatacaaaaattatccaggtgtagtagctcacgcctgtattcctagcaactcgggaggctgagtcatgagaatcgcttgaacctgggaggcagagaatgcagtgagccgagatcacgccattgtactccagcctggatgacagagcaagactctgtctccaaaaaaaaaaaaaaaaagaaagaaaaaggaaaagaaaaccattgccctcaggtcacatctggcctactacctatttttgtacagcatgtgatggtaaatctcatgaacataaaagacacacaggcacacgttacaaaatagtacatactacatgattccatttatataaggtgcaaaaatgatctatagtgttggggatcaggatacaggctacctttggggagatggggaatagtgtctgagacaggacacaaagggatgtttgtttgtttgtttgtttgtttttgagatggagtcttgctctgtaacccaggctggagtgcagtggtgccatcttgactcactgcaatctccatctcccaaattcaagcgattctactgcctcagactcccgagtagctgggattacaagcgtgcaccaccacgcctgactaatttttgtattttagtagagacggggtttcaccatgtttatcaggctggtcttgaactcctgacctcaggtgatccacctgccttgccctcccaaagagctgggattacaggcatgagccacggcacccagccaaatagtatttttatatacctttttattaaaatatattatacgtagctgtgaagtgcattaatgtgaagtgcatagttcaataaagctttgcataggaatacatccaggaaagcaccacccagattaagatatagaacttttttttttttttttttcagacggagtttcactcttgttgcccaggctcgagtgcaatggcacaatcttggctcaccgcaacttccacctcctgggttcaggcgattctcttgcctcagcctccggaatagctgggattacaggcatgtgccaccacgaacagctaatttttgtatttttagtagagacagggtttctccatgttggtcaggctggtctttaactcctgacctcaggtgatccgcccaccttggcttcccaaagtgctgggattacaggtgtgagccactgagcctggcaagatatagaacatttccgtatctaataaagacatcacagattgttcctccctacccccacccttccaccccctcaaaggttaaccatggatttgttttgcctctcttgattctagcataaatgaagtcacacacagttaccttttgtgtctggcttattttgttcagcagaatgaatgtgagattaattcatgctgttgggttatctattgctcattctttctattgccatatattacctcattatatgaatataaaatgtgtttattctccaggtgatactcttgagctattttgacattttggctgctgtgagtaatgttgctgtaaacaatcttgaacttgtcttttgatggacatatgcacgtccttctctcacctaagaagtgaattttctggtcatagggtgggcatacttttagatttagtagttagctaatacagtggtagatgctgccaaactgttttccaaagtgtatgaacccaccaggcatggtcagtgatcacgtctgtaatcctagcactttgggagtacaaggggggaggatggcttgagcccaggagttcgagaccagcctggacaacataatgagaccctgtctcttaaaaaaacaaaaacactgctaaatttgaccggctttaaaaatatatttaaaacaagtttttaaaaagtgcatgaaccaatttacaatcccaccagcaaaatataaaagtcatagttgcttcacattcttgtcaacacttggtattgccattctattttagttcttctagttatgtagtagtgtctacttgtggttttaatgacatttccctgtggttaaatacatttcatatttattgtccctttggatatcatctttttttgaaatgcccattaaaatattatgcccattttttagatggattacttgtcttttatttatttatttgtagttatttatatattccaatgtaaattgtttgggtatgtgtaattcaaatatcttctgccagtgaagctgcatcttcactcagtgatgactttttttttttctttttgaaacagagtttagctcttgttgcccaggctggagtgcagtggcgcgatctcagctcactgcaacctctgcctcccaggttcaggcgattcttctgcctcagcctcctgaatagctgggattacaggcatgcaccaccatggcctgctaattttgtatttttagtagtgacgaggtttctccacgttggtcagactgatctcgaactcctgacctcaggtgatccgcccgccttggcctcccaaagtgctgggattacaggcgtgggccaccgtgctcggccattgatgacttttaagaaacagcagtggccaggcacggtggctcacacctataatcccagcactttgggaggccaaggtgggtggatcacgagttcaggagatcaagaccattctggctaacacggtgaaaccccatctctactaaaaatacaaaaaaatctagccaggcatggtggtgggtgcctgtattcccagctactcaggaggctgaggcaggagaatggcgtgaacctgggaggcggagcttttagtgagctgagatcgtgccactgcactccagcctgggcgacagagcaagactcgtctcaaaaaaaaaaaagaaaagaaaaacaagaaacagcagttctggggctggcatggtggctcacgcctgtaatcccagcactttgggaggccgaggcgggcggatcatgaggtcaggagatcaagtccagcctggctaacgtggtgaaaccccgtctctactaaaaatacaaaaatttagctaggtgtggtggcacgcagcagtggtcccagtgacttgggaggctgaggcaggagaatcacttgaacccaggaggcagaggttgcagtgagccgagattgcgccactgcacttcagcctgggtgacagagtgagattgcatctcaaaaagaaagaaagagagagagagagagagagagagggagggagggagggagagagagagagagagagagagaaagaaagaaagaaagaaagaaagagaaagaaagaaagaaagaaagaaagaaagaaagaaagaaagaaagaaacatacatcacttcttggctgactgggtgcactgcctatgagttagccctactctacaaggagcagtaaaaaatagatacataaaaatacattttaaaaaaaggaaacagaagttcttcattttaataaaatttctttctgttgatattttaattttatggttaatacttttgtgtcttctttaaatctttctctacttcaaggtcataaaaatagacttgttttcttctaggagatatattgttttaccttgaccattttggcctatgatttgttttgaatcaatttttcttggtacatgatgtgaggtaggggtcaatatttattttttccatatatatccaacaactccagcactatttattcaaaagaacatctaattgtttatagtatatagaaacagaaataattggctagtctcagtggttcacatctataatcctagctctttgggaggccaaggtgggtagattacttgagtccaggagtttgagatcagcctgggcaacacggggaaaccccatctctacaaaaaataaaaaaattagccaggactggtggcacctgcctatagtcccagttgcttgggaggctgaggtggggaggatagcttgagctcaggaggctgaggttacagtgagccaagattgtgccagtgcactttagcctgggtgatagagcaaaactctgtgtcaaaagaaaaaaaaagggaatacaattaattggcatgggtgaacaaggtcaggtccagggactctggcaccttgctgcttaagaaatgtcttcccttagtgaggagtgcctctgcctggccgccaactatctgggaagtgatgagggcctctgcccggccgccccactgtctgggatgtgaggagtgcctctgcctggctgccgccccatctgggaagtgaggagcacctctgcccagctccccacagtccgggaagtaaggaacgcctctgcccagccgccaactgtctgggaagtgaggatcgcctttgcctggctcctgccccatctgggaagtgaggagcgcctctgcttggccgccaactgtctgggaagtgaggagtgcctctgcctggctgccaaccatctgggaagtgaggagtgcctttgcctggctgccctcccatccggggaattgaggagtgcctttgcctggccgccaaccgtctgagaagtgaggagcgcctctgcccggccgccaaccatctgggaagtaaggagcgtctctgcccagctgccaactgtctgggaagtgaggagggcctctgcctggctgccaaccgtccaggaagtgaggagcgcctctgctcggctgccaaccgtctgggaagtgaggagcgcctttgcctggctgctgccccatctgggaaatgaggagcgcctccgcttggccgccaaccgtccgggaagtgaggagcgcctctgccgggcttctgccccatctggcaagtgaagagcaccactgcccggccgccccaccgtctgggaagtgaggagcgcctctgcccggcctctgtgcaaccttccaagtgtgaagtgacagccttgtgtgtgatcttttctgtcttccccaagtttgcatttttgacattaaagtttactttttaattaaaaaaagaaatttaaaaaaaaagagatgtcttctctttcagaatgtgccttgcacacgtkctcttctgaatgcctggctatttggtgaagttgcctggcctgctgattcctagtctatgaaagtggtgaaactgctttttctgcgcggcctacagaggggtccataccgtgttgttctggattcccgttgtaacttaaagggaaattttcacaatgtccagagcccttgatgtcctgcaaatgaaggaggaggatgtccttaagttccttgcagcaggaacccacttaggtggcactaatcttgacttccagatggaacagtacatctataaaaggaaaagtgatggcatctacatcataaatctgaagaggacctgggagaagcttctgctggcagctcgtgccattgttgccattgaaaaccctgctgatgtcagtgttatatcctccaggratactggccagagggccaygctgaagtttgctgctgccactggagmcactccaattgctggccacttcactcctgsaaccttcactaaccggatccaggcagccttccgggagccacagcttcytgtggttactgaccccagggctgaccaccagcctctcacggaggtatcttatgttaacttacctaccattgcgctgtgtaacacagattctcctctgcgctatgtggacattgccatcccatgcarcaataagggagctcactcagtgggttggatgtggtggatgctggctcaggaagttctgcgcatgcgtggcaccatttcccgtgaacacccatgggaggtcatgcctgatctctgcttctacagagatcctgaagagattgaaaaagaagagcaggctgctgctgaagaggcagtgaccaaggaggaatttcagggtgaatggactgctccagctcctgagttcactgctactcagcctgaggttgcagactggtctgaaggtctgcaggtgccctctgtgtctattcagtagttccctactgaagactggagygctcagcctgccayggaagactggtctgcagctcccactgctcaggccactgaatgggtaggagcaaccactgaatggtcttaagctgttcttgcatgggctcttaagcaacatggaaaaatggttgatggaaaataaataaacatcagtttctaaaaaaaaaaaagaaaaaaagaaagtggtgaaactgtttagtgaacagcctttggccaagaagaagacttatgactggtatccagattacaatacttattttgtactcatggggacattcttatgccttggcctctacagagatgagcatcaagattttaaggatgagccaggcacggtggctcatgcctgtaatcctagcacttttgaaggccgaggtgggtggatcacctgaagtcaggagttcaagaccagcctggccaacatggtgaatccccgtctctactcaaaatataaaaattagccgggcgtggtggcaggaatctgtaatcccagctacttgggagtctaaggcaggagaattgcttgaacccgggaggcggaggtggcagtgagtcaagatagcgccacagcactccagcctgggtgataagagcaaaactccgtctcaaaaaaaaaagaaagagagagagaccaatctggccaacaaaaagaccacatctctcaaaaaaaaaaaaaaaattaaggataaacaaatgtgtttaacacttttcctgtctgccccaggaatatttgccagcagtgcttgtggttgcagtgtttacctcgagataactttgccaggagatatctcgtttttattattatttcacatcgctctagtatatcacatctttggaaacaaaaggcatcattctattcatagcattctgtttctagtagtggtatttccatttacaaaatatagtaattctcgatcactgaaaatgtcaaatgctagaaaatgtagcattcctacacgtgatgttaacatcattctggaacagttgctggctgaagattcatttgatgaatcggatttttcctaaatagatgattctgatgattcaggcaattctgatgttagctctgttcagaaataactccaagaacagtttcgatattttattttcatattgaaaatcagacagatttgcttcagcctcaaagagcctgtttatrtaaaattaaatgagtgctggcagtgaactgcactttttttttaaatgggaaattaaagaagctctgtgtaacttgattgcctctgtaaagaaaaaagaaaataaataaataaaagaagctccatggaagggggaaaccaagtaaaggaaaagagaaaagagcagtgggctgggcgtggtggctcacacctgtaatcccagcactttgggaggccgaggcaggcaaatctcgaggtcaggagatcgagaccatcctggctaagacggtgaaaccccgtctctactaaaaataaaaaaaaaattagccgggcatggtggcgggcacctgtagtcccagctactcaggaggctgaggcaggagaatggcgtgaacccaggaggcggagcttgcagtgagccgagattgcgccactgcactccagcctgggcgacagagctagactccctctcaaaaaaaataaaataaaataaagagcagcaaaaacgaaatagtgtcggcccatcaagagggaaaatttcctcctcagtgacagaaaaaagtgtatttattagccaggcgtagtggctcatgcctgtaatcccagcactttgggaggccgaggcagacggatcacctgagatcaggagtttgaaaccagcttggccaacatggtgaaaaccctgtctctactaaaaatacaaaaattagccaggcatggtggcacactcctataattccaattactcgtgagcctgaggcacaagaattacttgaacccaggagacaagttgcagtgagctgagatggcaccattgcactccagcctgggggacacagtgagactctgtctcaaaaaaaaataataatcacaatcataaaataaaaaaggaagtgtatttattgtctgtccagatactggaggaatgtaatattcctaaatgaaggttatttagggaacaccgtgttgaagtctaatccagttaaattgtagctggtttcttgaccacattctaaccatgcaaaattattttgctttggctttctgatccgaggtttacctaattttctaatgaaatgagtacactaaaaaaaaaaaaaaaaaagaaatataggccgggcacggtggctcacgcctgtaatcccagcactttgggaggccgaggcaggcggatcacgaggtcagaagatcgagaccatcctggctaacacagtgaaaccctgtctctactaaaaatacaaaaaattagccaggcgtgctggcacttgcctgtagtcccagctactcaggaggctagggaagcagaatggcttgaacccgggagggggagattgcagtgagccaagatcacgccactgaactccagcctgggtgacagagcgagactccatctcaaataaataaataaatataatgaatttttattcactcttgtatccataatcttacaaatgcatttattaatgttaatagtttatctatagactctgtagttttgttttgttttgtttttgagatggagtcttgctctgttgcccaggctggagggcagtggagcaatcttggctcactgcaaactccatctccagggttcaagccattctcctgccccagcctttcaagtagctggaattacaggtgcccaccaccacaaccagctaatttttgtatttttagtagagacggggtttcaccatgctggccaggctggtctcgaactcctgccctcaagtgatccacccccacttggcctcccaaagtgctgggattacaggcatgagccacagcaccaggtgggagcttttttttttttttttaaaggtggcatagcattttatgaaacacttttcctgtatctattgagacagtgagagagccatgtgtttttctcatttattctgttatcatgatgaatcatcaatgtcagaatcaaaactcataattttttttttttttctgagatggagtcttgctctgtcacccagagctggagtgcaatggcacaatcttggctcactgcaacctccacctcctcggttcaagcaattctcctgcctcaacctcccaagtagctgggattacaggcactcaccaccacacctggctaatttttgtatttttagtagagacggggtttcaccatgttggccaggctgctctcgattgaactcctgacctcgtgatccacccgccttggcctcccaaagtactgggattacagctgtgagccaccatacccagccaaaaatcataaatttttaactcttacacaaatcttgctttcctagaataaattcaagtttattgtaatgagtaagctctttatatgcagttggaatctaatattattagaattagattaatattataatatagtatatggttagaatctaatgtgtagttactactactttgttcagaatttttatatttatgttcataagagagattagcctgtaattcttttctgttgctgttatgaaggttctgctgatctcccaaaatgaattggaagaatttgagtaagattaatgtgactcctttcttagatgtttggagattctctggtgaagtcattagtgcttggagttttctttactgaaaggttttaaattttagatccaatttctttaacagatataggactcttcagattcgtatgttctacttcttttttgcggggctggggatggagtttcgctcttgtcacccaggctggagtgtagtggtgcgatctcggctcactgcaacctctctcccttctgggttcaagtgattctcctgtatcagcctcccgagtagctgggattacaggcaactgccactaaccccggctaatttttgtatttttagtagagatgggtttcactttgttggcctggctggtctcaaactcctgacctcagatgatccacccacctcagcctcccacagtgctgggattacaggcatgagccaccgcacccagcccatatttcctacttcttgtttccggtggtggtggtggtggtggtggttgagacagagtctcactctgtcccccaagctggagtgcagtggcacaatcatagctcactatagccttgaactcctgggctcaagtagttaggactataggtacatatcaccacactggcctaatttttttgttgcttttatagatgagggtcttgctatgttgcccaggctggtctcaatctcctgtcctgaaatgatcctcctgcctcaaccccgaaaagtgttagattagaggtatgagccaccatgcccagccccttttcattcctgatattggcactttgtgcctttgaaaaatgtttatgaggccgggcgtggtggctcattcctgtaatcccagcactttgggaggctgaggcaagcggatcacaaggtcaggagatcgagaccatcctggctaacacggtgaaaccccatctctactaaaaatacaaaaaaattagccaggcatgctggcgggcgcctgtagtcccagctgctggggaggcaggagaatggcgtgaacccgggaggtggagcttgcagtgagccgatatcgcgccactgcactccagcctgagctacagagtgagattccgtctcaaaaaatatatatatatttatggctgggcgcagtggctcacacctgtaatcccagcactttgggaggccaaggtgggcggaccacgaggtcaggagatcgagaccttcctggctaatacggtaaaaccccgtctctactaaaaatacaaaaaattagccgggcgtggtggcaggcgcctgtagtcccagctacttgggaggctgaggcacgagaatggcttgaacccgagaggcggagcttgcagtgagctgagattgtaccactgcactccagcctgggcgacagagtgagactccgtctcaaaaaaaaaaaaagtttattaatcttagttctttcaaacaaaccaactttttgctttgttaatttatactgggctatgtttggtttttgtttcactagtttctgttcttagatttattatttccttcttcctttttttttttttttaaacagagtctctatctcccaggctagagtgcagtggcagcatctcggctcactgaaacctctgcctcccgggttcaagtgattctccggcctcagcctcctgggtagctgggactacaggcatgcaccaccacccccggctaatttttgtttttgtatttttagtagagacggggttttgccgtgttagccaggcatggttttaacatrttttgccatgttagccaggctggtctcgaacttctgacctcaggggatccatctcccaaagtgctgggattacaggagtgagccaccgcacccggccctatgtgttttttattttattttatttatttatttagtttttgagacagggtctcgctctgtggcccaggctggagtgcagtgccatgatcttagctcactgcaacctccacctctcaggttcaagccattctcctgcctcagcctccctagtagcttggatttcaggcatgtgccaccaagcccggctaatttttatatttttagtagagacgggattttgctatgttggccaggctggtcttgaactcctggcctcaagtaatccacccactgcctcagcctcccaaagtgctgggaatacaagagtgaaactccgtctcaaacagaacaaaacaaaaataataattaaggctggccaggcatggtggctcatgcctgtatcccagcatgctgggagactgaggtggcgtgagccaccacacctgccccgtatgtgttattttattttatgtatttttttttttttttttgagatggagtctcgcactgtcaccaggctggagtgcagtggagagatcttggttcgctgcaacctccgcctcccaggttcaagcgattctcctgcctcagcctcccaagtagctggatttacaggcacccgccaccatgcctggctaattttttttttgtatttttagtagagacaagatttcactatgttggccaagctggtcttgaactcctgaccttgtgatcagcccactaaagactaaagctcagggccaaccaggcccaaaatgaagcagttgaggagaagaccaaggtcataagagaatatcaaggtcacaaggtcacaagagagtattaaggtcacaagagagtattaagacaagc
